US006783961B1

(12) United States Patent
Edwards et al.

(10) Patent No.: US 6,783,961 B1
(45) Date of Patent: Aug. 31, 2004

(54) EXPRESSED SEQUENCE TAGS AND ENCODED HUMAN PROTEINS

(75) Inventors: Jean-Baptiste Dumas Milne Edwards, Paris (FR); Aymeric Duclert, Saint-Maur (FR); Jean-Yves Giordano, Paris (FR)

(73) Assignee: Genset S.A. (FR)

( * ) Notice: Subject to any disclaimer, the term of this patent is extended or adjusted under 35 U.S.C. 154(b) by 0 days.

(21) Appl. No.: 09/513,999

(22) Filed: Feb. 24, 2000

Related U.S. Application Data

(60) Provisional application No. 60/122,487, filed on Feb. 26, 1999.

(51) Int. Cl.$^7$ ................................................ C12P 19/34
(52) U.S. Cl. ..................................... 435/91.1; 536/23.1
(58) Field of Search .............................. 536/23.1, 23.5; 435/6, 320.1, 252.3, 91.1, 69.1

(56) References Cited

U.S. PATENT DOCUMENTS 5,376,533 A * 12/1994 Maclaren et al. ............ 435/7.4

FOREIGN PATENT DOCUMENTS

| EP | 625 572 | 11/1994 |
| WO | WO 96/34981 | 11/1996 |

OTHER PUBLICATIONS

Adams, et al., Nature, "Initial Assessment of Human Gene Diversity and Expression Patterns Based Upon 83 Million Nucleotides of cDNA Sequence", vol. 377 Supp., Sep. 28, 1995, pp. 3–17.

Caminci, et al., "High–Efficiency Full–Length cDNA Cloning by Biotinylated CAP Trapper", Genomics 37: 327–336 (1996).

Hillier, et al., "Generation and Analysis of 280,000 Human Expressed Sequence Tags", Genome Res. 6: 807–828 (1996).

Kato, et al., "Construction of a Human Full–Length cDNA Bank", Gene 150:243–250 (1994).

Nomura, et al., DNA Research, "Prediction of the Coding Sequences of Unidentified Human Genes. I. The Coding Sequences of 40 New Genes (KIAA0001–KIAA0040) Deduced by Analysis of Randomly Sampled cNDA Clones from Human Immature Myeloid Cell Line KG–1", vol. 1, pp. 27–35 (1994).

Gunnar von Heijne, Nucleic Acids Research, "A New Method for Predicting Signal Sequence Cleavage Sites", vol. 14, No. 11 (1986).

* cited by examiner

*Primary Examiner*—James Martinell
(74) *Attorney, Agent, or Firm*—Saliwanchik, Lloyd & Saliwanchik

(57) ABSTRACT

The sequences of 5' ESTs derived from mRNAs encoding secreted proteins are disclosed. The 5' ESTs may be to obtain cDNAs and genomic DNAs corresponding to the 5' ESTs. The 5' ESTs may also be used in diagnostic, forensic, gene therapy, and chromosome mapping procedures. Upstream regulatory sequences may also be obtained using the 5' ESTs. The 5' ESTs may also be used to design expression vectors and secretion vectors.

5 Claims, 5 Drawing Sheets

| Minimum signal peptide score | false positive rate | false negative rate | proba(0.1) | proba(0.2) |
|---|---|---|---|---|
| 3.5 | 0.121 | 0.036 | 0.467 | 0.664 |
| 4 | 0.096 | 0.06 | 0.519 | 0.708 |
| 4.5 | 0.078 | 0.079 | 0.565 | 0.745 |
| 5 | 0.062 | 0.098 | 0.615 | 0.782 |
| 5.5 | 0.05 | 0.127 | 0.659 | 0.813 |
| 6 | 0.04 | 0.163 | 0.694 | 0.836 |
| 6.5 | 0.033 | 0.202 | 0.725 | 0.855 |
| 7 | 0.025 | 0.248 | 0.763 | 0.878 |
| 7.5 | 0.021 | 0.304 | 0.78 | 0.889 |
| 8 | 0.015 | 0.368 | 0.816 | 0.909 |
| 8.5 | 0.012 | 0.418 | 0.836 | 0.92 |
| 9 | 0.009 | 0.512 | 0.856 | 0.93 |
| 9.5 | 0.007 | 0.581 | 0.863 | 0.934 |
| 10 | 0.006 | 0.679 | 0.835 | 0.919 |

FIG. 2

Description of Transcription Factor Binding Sites present on promoters isolated from SignalTag sequences

Promoter sequence P13H2 (546 bp):

| Matrix | Position | Orientation | Score | Length | Sequence | Location in: SEQ ID NO: 17 |
|---|---|---|---|---|---|---|
| CMYB_01 | -502 | + | 0.983 | 9 | TGTCAGTTG | 17-25 |
| MYOD_Q6 | -501 | - | 0.961 | 10 | CCCAACTGAC | complement of 18-27 |
| S8_01 | -444 | - | 0.960 | 11 | AATAGAATTAG | complement of 75-85 |
| S8_01 | -425 | + | 0.966 | 11 | AACTAAATTAG | 94-104 |
| DELTAEF1_01 | -390 | - | 0.960 | 11 | GCACACCTCAG | complement of 129-139 |
| GATA_C | -364 | - | 0.964 | 11 | AGATAAATCCA | complement of 155-165 |
| CMYB_01 | -349 | + | 0.958 | 9 | CTTCAGTTG | 170-178 |
| GATA1_02 | -343 | + | 0.959 | 14 | TTGTAGATAGGACA | 176-189 |
| GATA_C | -339 | + | 0.953 | 11 | AGATAGGACAT | 180-190 |
| TAL1ALPHAE47_01 | -235 | + | 0.973 | 16 | CATAACAGATGGTAAG | 284-299 |
| TAL1BETAE47_01 | -235 | + | 0.983 | 16 | CATAACAGATGGTAAG | 284-299 |
| TAL1BETAITF2_01 | -235 | + | 0.978 | 16 | CATAACAGATGGTAAG | 284-299 |
| MYOD_Q6 | -232 | - | 0.954 | 10 | ACCATCTGTT | complement of 287-296 |
| GATA1_04 | -217 | - | 0.953 | 13 | TCAAGATAAAGTA | complement of 302-314 |
| IK1_01 | -126 | + | 0.963 | 13 | AGTTGGGAATTCC | 393-405 |
| IK2_01 | -126 | + | 0.985 | 12 | AGTTGGGAATTC | 393-404 |
| CREL_01 | -123 | + | 0.962 | 10 | TGGGAATTCC | 396-405 |
| GATA1_02 | -96 | + | 0.950 | 14 | TCAGTGATATGGCA | 423-436 |
| SRY_02 | -41 | - | 0.951 | 12 | TAAAACAAAACA | complement of 478-489 |
| E2F_02 | -33 | + | 0.957 | 8 | TTTAGCGC | 486-493 |
| MZF1_01 | -5 | - | 0.975 | 8 | TGAGGGGA | complement of 514-521 |

Promoter sequence P15B4 (861 bp):

| Matrix | Position | Orientation | Score | Length | Sequence | Location in: SEQ ID NO: 20 |
|---|---|---|---|---|---|---|
| NFY_Q6 | -748 | - | 0.956 | 11 | GGACCAATCAT | complement of 60-70 |
| MZF1_01 | -738 | + | 0.962 | 8 | CCTGGGGA | 70-77 |
| CMYB_01 | -684 | + | 0.994 | 9 | TGACCGTTG | 124-132 |
| VMYB_02 | -682 | - | 0.985 | 9 | TCCAACGGT | complement of 126-134 |
| STAT_01 | -673 | + | 0.968 | 9 | TTCCTGGAA | 135-143 |
| STAT_01 | -673 | - | 0.951 | 9 | TTCCAGGAA | complement of 135-143 |
| MZF1_01 | -556 | - | 0.956 | 8 | TTGGGGGA | complement of 252-259 |
| IK2_01 | -451 | + | 0.965 | 12 | GAATGGGATTTC | 357-368 |
| MZF1_01 | -424 | + | 0.986 | 8 | AGAGGGGA | 384-391 |
| SRY_02 | -398 | - | 0.955 | 12 | GAAAACAAAACA | complement of 410-421 |
| MZF1_01 | -216 | + | 0.960 | 8 | GAAGGGGA | 592-599 |
| MYOD_Q6 | -190 | + | 0.981 | 10 | AGCATCTGCC | 618-627 |
| DELTAEF1_01 | -176 | + | 0.958 | 11 | TCCCACCTTCC | 632-642 |
| S8_01 | 5 | - | 0.992 | 11 | GAGGCAATTAT | complement of 813-823 |
| MZF1_01 | 16 | - | 0.986 | 8 | AGAGGGGA | complement of 824-831 |

Promoter sequence P29B6 (555 bp):

| Matrix | Position | Orientation | Score | Length | Sequence | Location in: SEQ ID NO: 23 |
|---|---|---|---|---|---|---|
| ARNT_01 | -311 | + | 0.964 | 16 | GGACTCACGTGCTGCT | 191-206 |
| NMYC_01 | -309 | + | 0.965 | 12 | ACTCACGTGCTG | 193-204 |
| USF_01 | -309 | + | 0.985 | 12 | ACTCACGTGCTG | 193-204 |
| USF_01 | -309 | - | 0.985 | 12 | CAGCACGTGAGT | complement of 193-204 |
| NMYC_01 | -309 | - | 0.956 | 12 | CAGCACGTGAGT | complement of 193-204 |
| MYCMAX_02 | -309 | - | 0.972 | 12 | CAGCACGTGAGT | complement of 193-204 |
| USF_C | -307 | + | 0.997 | 8 | TCACGTGC | 195-202 |
| USF_C | -307 | - | 0.991 | 8 | GCACGTGA | complement of 195-202 |
| MZF1_01 | -292 | - | 0.968 | 8 | CATGGGGA | complement of 210-217 |
| ELK1_02 | -105 | + | 0.963 | 14 | CTCTCCGGAAGCCT | 397-410 |
| CETS1P54_01 | -102 | + | 0.974 | 10 | TCCGGAAGCC | 400-409 |
| AP1_Q4 | -42 | - | 0.963 | 11 | AGTGACTGAAC | complement of 460-470 |
| AP1FJ_Q2 | -42 | - | 0.961 | 11 | AGTGACTGAAC | complement of 460-470 |
| PADS_C | 45 | + | 1.000 | 9 | TGTGGTCTC | 547-555 |

FIG. 5

EXPRESSED SEQUENCE TAGS AND ENCODED HUMAN PROTEINS

RELATED APPLICATION DATA

This application claims priority from U.S. Provisional Patent Application Serial No. 60/122,487, filed Feb. 26, 1999, the disclosure of which is incorporated herein by reference in its entirety.

BACKGROUND OF THE INVENTION

The estimated 50,000–100,000 genes scattered along the human chromosomes offer tremendous promise for the understanding, diagnosis, and treatment of human diseases. In addition, probes capable of specifically hybridizing to loci distributed throughout the human genome find applications in the construction of high resolution chromosome maps and in the identification of individuals.

In the past, the characterization of even a single human gene was a painstaking process, requiring years of effort. Recent developments in the areas of cloning vectors, DNA sequencing, and computer technology have merged to greatly accelerate the rate at which human genes can be isolated, sequenced, mapped, and characterized. Cloning vectors such as yeast artificial chromosomes (YACs) and bacterial artificial chromosomes (BACs) are able to accept DNA inserts ranging from 300 to 1000 kilobases (cb) or 100–400 kb in length respectively, thereby facilitating the manipulation and ordering of DNA sequences distributed over great distances on the human chromosomes. Automated DNA sequencing machines permit the rapid sequencing of human genes. Bioinformatics software enables the comparison of nucleic acid and protein sequences, thereby assisting in the characterization of human gene products.

Currently, two different approaches are being pursued for identifying and characterizing the genes distributed along the human genome. In one approach, large fragments of genomic DNA are isolated, cloned, and sequenced. Potential open reading frames in these genomic sequences are identified using bioinformatics software. However, this approach entails sequencing large stretches of human DNA which do not encode proteins in order to find the protein encoding sequences scattered throughout the genome. In addition to requiring extensive sequencing, the bioinformatics software may mischaracterize the genomic sequences obtained. Thus, the software may produce false positives in which non-coding DNA is mischaracterized as coding DNA or false negatives in which coding DNA is mislabeled as non-coding DNA.

An alternative approach takes a more direct route to identifying and characterizing human genes. In this approach, complementary DNAs (cDNAs) are synthesized from isolated messenger RNAs (mRNAs) which encode human proteins. Using this approach, sequencing is only performed on DNA which is derived from protein coding portions of the genome. Often, only short stretches of the cDNAs are sequenced to obtain sequences called expressed sequence tags (ESTs). The ESTs may then be used to isolate or purify extended cDNAs which include sequences adjacent to the EST sequences. The extended cDNAs may contain all of the sequence of the EST which was used to obtain them or only a portion of the sequence of the EST which was used to obtain them. In addition, the extended cDNAs may contain the full coding sequence of the gene from which the EST was derived or, alternatively, the extended cDNAs may include portions of the coding sequence of the gene from which the EST was derived. It will be appreciated that there may be several extended cDNAs which include the EST sequence as a result of alternate splicing or the activity of alternative promoters. Alternatively, ESTs having partially overlapping sequences may be identified and contigs comprising the consensus sequences of the overlapping ESTs may be identified.

In the past, these short EST sequences were often obtained from oligo-dT primed cDNA libraries. Accordingly, they mainly corresponded to the 3' untranslated region of the mRNA. In part, the prevalence of EST sequences derived from the 3' end of the mRNA is a result of the fact that typical techniques for obtaining cDNAs, are not well suited for isolating cDNA sequences derived from the 5' ends of mRNAs. (Adams et al., *Nature* 377:3–174, 1996, Hillier et al., *Genome Res.* 6:807–828, 1996).

In addition, in those reported instances where longer cDNA sequences have been obtained, the reported sequences typically correspond to coding sequences and do not include the full 5' untranslated region (5' UTR) of the mRNA from which the cDNA is derived. 5' UTRs are often involved in the regulation of gene expression, by affecting either the stability or translation of mRNAs. Indeed, 5' UTRs may contain several features known to affect the initiation of translation: (i) the distance between the cap structure and the initiation codon, (ii) the presence of cis-acting elements which may be either linear sequences such as polypyrimidine tracts (Kaspar et al, *J. Biol. Chem.* 267, 508–514, 1992; Severson et al., *Eur J Biochem* 229:426–32, 1995) or secondary structures such as IREs (Rouault and Klausner, *Curr Top Cell Regul* 35:1–19, 1997), and (iii) upstream open reading fraes or uORFs (Geballe and Morris, *Trends Biotech Sci* 19:159–64, 1994). Thus, regulation of gene expression may be achieved through the use of alternative 5' UTRs. For instance, the translation of the tissue inhibitor of metalloprotease mRNA is enhanced in mitogenically activated cells through modification of the start codon of an uORF in its 5' UTR using an alternative promoter (Waterhouse et al, *J Biol Chem.* 265:5585–9. 1990). Furthermore, modification of 5' UTR through mutation, insertion or translocation events may even be implied in pathogenesis. For instance, the fragile X syndrome, the most common cause of inherited mental retardation, is partly due to an insertion of multiple CGG trinucleotide's in the 5' UTR of the fragile X mRNA resulting in the inhibition of protein synthesis via ribosome stalling (Feng et al, *Science* 268:731–4, 1995). An aberrant mutation in regions of the 5' UTR known to inhibit translation of the proto-oncogene c-myc was shown to result in upregulation of C-myc protein levels in cells derived from patients with multiple myelomas (Willis et al, *Curr Top Microbiol Immunol* 224:269–76, 1997). However, the use of oligo-dT primed cDNA libraries does not allow the isolation of complete 5' UTRs since such obtained incomplete sequences may not include the first exon of the mRNA, particularly in situations where the first exon is short. Furthermore, they may not include some exons, often short ones, which are located upstream of splicing sites. Thus, there is a need to obtain sequences derived from the 5' ends of mRNAs.

While many sequences derived from human chromosomes have practical applications, approaches based on the identification and characterization of those chromosomal sequences which encode a protein product are particularly relevant to diagnostic and therapeutic uses. In some instances, the sequences used in such therapeutic or diagnostic techniques may be sequences which encode proteins which are secreted from the cell in which they are synthesized, as well as the secreted proteins themselves, are particularly valuable as potential therapeutic agents. Such proteins are often involved in cell to cell communication and may be responsible for producing a clinically relevant response in their target cells. In fact, several secretory proteins, including tissue plasminogen activator, G-CSF, GM-CSF, erythropoietin, human growth hormone, insulin, interferon-α, interferon-β, interferon-γ, and interleukin-2, are currently in clinical use. These proteins are used to treat a wide range of conditions, including acute myocardial infarction, acute ischemic stroke, anemia, diabetes, growth hormone deficiency, hepatitis, kidney carcinoma, chemotherapy-induced neutropenia and multiple sclerosis. For these reasons, extended cDNAs encoding secreted proteins or portions thereof represent a valuable source of therapeutic agents. Thus, there is a need for the identification and characterization of secreted proteins and the nucleic acids encoding them.

In addition to being therapeutically useful themselves, secretory proteins include short peptides, called signal peptides, at their amino termini which direct their secretion. These signal peptides are encoded by the signal sequences located at the 5' ends of the coding sequences of genes encoding secreted proteins. These signal peptides can be used to direct the extracellular secretion of any protein to which they are operably linked. In addition, portions of the signal peptides called membrane-translocating sequences, may also be used to direct the intracellular import of a peptide or protein of interest. This may prove beneficial in gene therapy strategies in which it is desired to deliver a particular gene product to cells other than the cell in which it is produced. Signal sequences encoding signal peptides also find application in simplifying protein purification techniques. In such applications, the extracellular secretion of the desired protein greatly facilitates purification by reducing the number of undesired proteins from which the desired protein must be selected. Thus, there exists a need to identify and characterize the 5' portions of the genes for secretory proteins which encode signal peptides.

Sequences coding for non-secreted proteins may also find application as therapeutics or diagnostics. In particular, such sequences may be used to determine whether an individual is likely to express a detectable phenotype, such as a disease, as a consequence of a mutation in the coding sequence for a non-secreted protein or for a secreted protein. In instances where the individual is at risk of suffering from a disease or other undesirable phenotype as a result of a mutation in such a coding sequence, the undesirable phenotype may be corrected by introducing a normal coding sequence using gene therapy. Alternatively, if the undesirable phenotype results from overexpression of the protein encoded by the coding sequence, expression of the protein may be reduced using antisense or triple helix based strategies.

The secreted or non-secreted human polypeptides encoded by the coding sequences may also be used as therapeutics by administering them directly to an individual having a condition, such as a disease, resulting from a mutation in the sequence encoding the polypeptide. In such an instance, the condition can be cured or ameliorated by administering the polypeptide to the individual.

In addition, the secreted or non-secreted human polypeptides or portions thereof may be used to generate antibodies useful in determining the tissue type or species of origin of a biological sample. The antibodies may also be used to determine the cellular localization of the secreted or non-secreted human polypeptides or the cellular localization of polypeptides which have been fused to the human polypeptides. In addition, the antibodies may also be used in immunoaffinity chromatography techniques to isolate, purify, or enrich the human polypeptide or a target polypeptide which has been fused to the human polypeptide.

Public information on the number of human genes for which the promoters and upstream regulatory regions have been identified and characterized is quite limited. In part, this may be due to the difficulty of isolating such regulatory sequences. Upstream regulatory sequences such as transcription factor binding sites are typically too short to be utilized as probes for isolating promoters from human genomic libraries. Recently, some approaches have been developed to isolate human promoters. One of them consists of making a CpG island library (Cross et al., *Nature Genetics* 6: 236–244, 1994). The second consists of isolating human genomic DNA sequences containing SpeI binding sites by the use of SpeI binding protein. (Mortlock et al., *Genome Res.* 6:327–335, 1996). Both of these approaches have their limits due to a lack of specificity or because they are not universally applicable since only a limited number of promoters have either a CpG island or a SpeI recognition site and because SpeI binding sites are not specifically found in promoter regions. Thus, there exists a need to identify and systematically characterize the 5' portions of the genes.

The present 5' EST's may be used to efficiently identify and isolate 5' UTRs and upstream regulatory regions which control the location, developmental stage, rate, and quantity of protein synthesis, as well as the stability of the mRNA. Once identified and characterized, these regulatory regions may be utilized in gene therapy or protein purification schemes to obtain the desired amount and locations of protein synthesis or to inhibit, reduce, or prevent the synthesis of undesirable gene products.

In addition, ESTs containing the 5' ends of protein genes may include sequences useful as probes for chromosome mapping and the identification of individuals. Thus, there is a need to identify and characterize the sequences upstream of the 5' coding sequences of genes.

SUMMARY OF THE INVENTION

The present invention relates to purified, isolated, or enriched 5' ESTs which include sequences derived from the authentic 5' ends of their corresponding mRNAs. The term "corresponding mRNA" refers to the mRNA which was the template for the cDNA synthesis which produced the 5' EST. These sequences will be referred to hereinafter as "5' ESTs." The present invention also includes purified, isolated or enriched nucleic acids comprising contigs assembled by determining a consensus sequences from a plurality of ESTs containing overlapping sequences. These contigs will be referred to herein as "consensus contigated ESTs."

As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either form the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message. Purification of starting material or natural material to at least one order of magnitude, preferably two or three orders, and more preferably four or five orders of magnitude is expressly contemplated.

As used herein, the term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated.

As used herein, the term "enriched" means that the 5' EST is adjacent to "backbone" nucleic acid to which it is not adjacent in its natural environment. Additionally, to be "enriched" the 5' ESTs will represent 5% or more of the number of nucleic acid inserts in a population of nucleic acid backbone molecules. Backbone molecules according to the present invention include nucleic acids such as expression vectors, self-replicating nucleic acids, viruses, integrating nucleic acids, and other vectors or nucleic acids used to maintain or manipulate a nucleic acid insert of interest. Preferably, the enriched 5' ESTs represent 15% or more of the number of nucleic acid inserts in the population of recombinant backbone molecules. More preferably, the enriched 5' ESTs represent 50% or more of the number of nucleic acid inserts in the population of recombinant backbone molecules. In a highly preferred embodiment, the enriched 5' ESTs represent 90% or more of the number of nucleic acid inserts in the population of recombinant backbone molecules.

"Stringent", "moderate," and "low" hybridization conditions are as defined below.

The term "polypeptide" refers to, a polymer of amino acids without regard to the length of the polymer; thus, peptides, oligopeptides, and proteins are included within the definition of polypeptide. This term also does not specify or exclude post-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used interchangeably herein, the terms "nucleic acids", "oligonucleotides", and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. The polynucleotide sequences of the invention may be prepared by any known method, including synthetic, recombinant, ex vivo generation, or a combination thereof, as well as utilizing any purification methods known in the art.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, $4^{th}$ edition, 1995).

The terms "complementary" or "complement thereof" are used herein to refer to the sequences of polynucleotides which is capable of forming Watson & Crick base pairing with another specified polynucleotide throughout the entirety of the complementary region. For the purpose of the present invention, a first polynucleotide is deemed to be complementary to a second polynucleotide when each base in the first polynucleotide is paired with its complementary base. Complementary bases are, generally, A and T (or A and U), or C and G. "Complement" is used herein as a synonym from "complementary polynucleotide", "complementary nucleic acid" and "complementary nucleotide sequence". These terms are applied to pairs of polynucleotides based solely upon their sequences and not any particular set of conditions under which the two polynucleotides would actually bind. Preferably, a "complementary" sequence is a sequence which an A at each position where there is a T on the opposite strand, a T at each position where there is an A on the opposite strand, a G at each position where there is a C on the opposite strand and a C at each position where there is a G on the opposite strand.

Thus, 5' ESTs in cDNA libraries in which one or more 5' ESTs make up 5% or more of the number of nucleic acid inserts in the backbone molecules are "enriched recombinant 5' ESTs" as defined herein. Likewise, 5' ESTs in a population of plasmids in which one or more 5' ESTs of the present invention have been inserted such that they represent 5% or more of the number of inserts in the plasmid backbone are "enriched recombinant 5' ESTs" as defined herein. However, 5' ESTs in cDNA libraries in which 5' ESTs constitute less than 5% of the number of nucleic acid inserts in the population of backbone molecules, such as libraries in which backbone molecules having a 5' EST insert are extremely rare, are not "enriched recombinant 5' ESTs."

In some embodiments, the present invention relates to 5' ESTs which are derived from genes encoding secreted proteins. As used herein, a "secreted" protein is one which, when expressed in a suitable host cell, is transported across or through a membrane, including transport as a result of signal peptides in its amino acid sequence. "Secreted" proteins include without limitation proteins secreted wholly (e.g. soluble proteins), or partially (e.g. receptors) from the cell in which they are expressed. "Secreted" proteins also include without limitation proteins which are transported across the membrane of the endoplasmic reticulum.

Such 5' ESTs include nucleic acid sequences, called signal sequences, which encode signal peptides which direct the extracellular secretion of the proteins encoded by the genes from which the 5' ESTs are derived. Generally, the signal peptides are located at the amino termini of secreted proteins.

Secreted proteins are translated by ribosomes associated with the "rough" endoplasmic reticulum. Generally, secreted proteins are co-translationally transferred to the membrane of the endoplasmic reticulum. Association of the ribosome with the endoplasmic reticulum during translation of secreted proteins is mediated by the signal peptide. The signal peptide is typically cleaved following its co-translational entry into the endoplasmic reticulum. After delivery to the endoplasmic reticulum, secreted proteins may proceed through the Golgi apparatus. In the Golgi apparatus, the proteins may undergo post-translational modification before entering secretory vesicles which transport them across the cell membrane.

The 5' ESTs of the present invention have several important applications. For example, they may be used to obtain and express cDNA clones which include the full protein coding sequences of the corresponding gene products, including the authentic translation start sites derived from the 5' ends of the coding sequences of the mRNAs from which the 5' ESTs are derived. These cDNAs will be referred to hereinafter as "full-length cDNAs." These cDNAs may also include DNA derived from mRNA sequences upstream of the translation start site. The full-length cDNA sequences may be used to express the proteins corresponding to the 5' ESTs. As discussed above, secreted proteins and non-secreted proteins may be therapeutically important. Thus, the proteins expressed from the cDNAs may be useful in treating or controlling a variety of human conditions. The 5' ESTs may also be used to obtain the corresponding genomic DNA. The term "corresponding genomic DNA" refers to the genomic DNA which encodes the mRNA from which the 5' EST was derived.

Alternatively, the 5' ESTs may be used to obtain and express extended cDNAs encoding portions of the protein. In the case of secreted proteins, the portions may comprise the signal peptides of the secreted proteins or the mature proteins generated when the signal peptide is cleaved off.

The present invention includes isolated, purified, or enriched "EST-related nucleic acids." The terms "isolated", "purified" or "enriched" have the meanings provided above. As used herein, the term "EST-related nucleic acids" means the nucleic acids of SEQ ID NOs: 24–4100 and 8178–36681, extended cDNAs obtainable using the nucleic acids of SEQ ID NOs: 24–4100 and 8178–36681, full-length cDNAs obtainable using the nucleic acids of SEQ ID NOs: 24–4100 and 8178–36681 or genomic DNAs obtainable using the nucleic acids of SEQ ID NOs: 24–4100 and 8178–36681. The present invention also includes the sequences complementary to the EST-related nucleic acids.

The present invention also includes isolated, purified, or enriched "fragments of EST-related nucleic acids." The terms "isolated", "purified" and "enriched" have the meanings described above. As used herein the term "fragments of EST-related nucleic acids" means fragments comprising at least 10, 12, 15, 18, 20, 23, 25, 28, 30, 35, 40, 50, 75, 100, 200, 300, 500, or 1000 consecutive nucleotides of the EST-related nucleic acids to the extent that fragments of these lengths are consistent with the lengths of the particular EST-related nucleic acids being referred to. The present invention also includes the sequences complementary to the fragments of the EST-related nucleic acids.

The present invention also includes isolated, purified, or enriched "positional segments of EST-related nucleic acids." The terms "isolated", "purified", or "enriched" have the meanings provided above. As used herein, the term "positional segments of EST-related nucleic acids" includes segments comprising nucleotides 1–25, 26–50, 51–75, 76–100, 101–125, 126–150, 151–175, 176–200, 201–225, 226–250, 251–300, 301–325, 326–350, 351–375, 376–400, 401–425, 426–450, 451–475, 476–500, 501–525, 526–550, 551–575, 576–600 and 601-the terminal nucleotide of the EST-related nucleic acids to the extent that such nucleotide positions are consistent with the lengths of the particular EST-related nucleic acids being referred to. The term "positional segments of EST-related nucleic acids also includes segments comprising nucleotides 1–50, 51–100, 101–150, 151–200, 201–250, 251–300, 301–350, 351–400, 401–450, 450–500, 501–550, 551–600 or 601-the terminal nucleotide of the EST-related nucleic acids to the extent that such nucleotide positions are consistent with the lengths of the particular EST-related nucleic acids being referred to. The term "positional segments of EST-related nucleic acids" also includes segments comprising nucleotides 1–100, 101–200, 201–300, 301–400, 501–500, 500–600, or 601-the terminal nucleotide of the EST-related nucleic acids to the extent that such nucleotide positions are consistent with the lengths of the particular EST-related nucleic acids being referred to. In addition, the term "positional segments of EST-related nucleic acids" includes segments comprising nucleotides 1–200, 201–400, 400–600, or 601-the terminal nucleotide of the EST-related nucleic acids to the extent that such nucleotide positions are consistent with the lengths of the particular EST related nucleic acids being referred to. The present invention also includes the sequences complementary to the positional segments of EST-related nucleic acids.

The present invention also includes isolated, purified, or enriched "fragments of positional segments of EST-related nucleic acids." The terms "isolated", "purified", or "enriched" have the meanings provided above. As used herein, the term "fragments of positional segments of EST-related nucleic acids" refers to fragments comprising at least 10, 15, 18, 20, 23, 25, 28, 30, 35, 40, 50, 75, 100, 150, or 200 consecutive nucleotides of the positional segments of EST-related nucleic acids. The present invention also includes the sequences complementary to the fragments of positional segments of EST-related nucleic acids.

The present invention also includes isolated or purified "EST-related polypeptides." The terms "isolated" or "purified" have the meanings provided above. As used herein, the term "EST-related polypeptides" means the polypeptides encoded by the EST-related nucleic acids, including the polypeptides of SEQ ID NOs: 4101–8177.

The present invention also includes isolated or purified "fragments of EST-related polypeptides." The terms "isolated" or "purified" have the meanings provided above. As used herein, the term "fragments of EST-related polypeptides" means fragments comprising at least 5, 10, 15, 20, 25, 30, 35, 40, 50, 75, 100, or 150 consecutive amino acids of an EST-related polypeptide to the extent that fragments of these lengths are consistent with the lengths of the particular EST-related polypeptides being referred to.

The present invention also includes isolated or purified "positional segments of EST-related polypeptides." As used herein, the term "positional segments of EST-related polypeptides" includes polypeptides comprising amino acid residues 1–25, 26–50, 51–75, 76–100, 101–125, 126–150, 151–175, 176–200, or 201-the C-terminal amino acid of the EST-related polypeptides to the extent that such amino acid residues are consistent with the lengths of the particular EST-related polypeptides being referred to. The term "positional segments of EST-related polypeptides also includes segments comprising amino acid residues 1–50, 51–100, 101–150, 151–200 or 201-the C-terminal amino acid of the EST-related polypeptides to the extent that such amino acid residues are consistent with the lengths of the particular EST-related polypeptides being referred to. The term "positional segments of EST-related polypeptides" also includes segments comprising amino acids 1–100 or 101–200 of the EST-related polypeptides to the extent that such amino acid residues are consistent with the lengths of particular EST-related polypeptides being referred to. In addition, the term "positional segments of EST-related polypeptides" includes segments comprising amino acid residues 1–200 or 201-the C-terminal amino acid of the EST-related polypeptides to the extent that amino acid residues are consistent with the lengths of the particular EST related polypeptides being referred to.

The present invention also includes isolated or purified "fragments of positional segments of EST-related polypeptides." The terms "isolated" or "purified" have the meanings provided above. As used herein, the term "fragments of positional segments of EST-related polypeptides" means fragments comprising at least 5, 10, 15, 20, 25, 30, 35, 40, 50, 75, 100, or 150 consecutive amino acids of positional segments of EST-related polypeptides to the extent that fragments of these lengths are consistent with the lengths of the particular EST-related polypeptides being referred to.

The present invention also includes antibodies which specifically recognize the EST-related polypeptides, fragments of EST-related polypeptides, positional segments of EST-related polypeptides, or fragments of positional segments of EST-related polypeptides. In the case of secreted proteins, such as those of SEQ ID NOs: 7798–7888 antibodies which specifically recognize the mature protein generated when the signal peptide is cleaved may also be obtained as described below. Similarly, antibodies which specifically recognize the signal peptides of SEQ ID NOs: 4101–4729 or 7798–7888 may also be obtained.

In some embodiments and in the case of secreted proteins, the EST-related nucleic acids, fragments of EST-related nucleic acids, positional segments of EST-related nucleic acids, or fragments of positional segments of nucleic acids include a signal sequence. In other embodiments, the EST-related nucleic acids, fragments of EST-related nucleic acids, positional segments of EST-related nucleic acids, or fragments of positional segments of nucleic acids may include the full coding sequence for the protein or, in the case of secreted proteins, the full coding sequence of the mature protein (i.e. the protein generated when the signal polypeptide is cleaved off). In addition, the EST-related nucleic acids, fragments of EST-related nucleic acids, positional segments of EST-related nucleic acids, or fragments of positional segments of nucleic acids may include regulatory regions upstream of the translation start site or downstream of the stop codon which control the amount, location, or developmental stage of gene expression.

As discussed above, both secreted and non-secreted human proteins may be therapeutically important. Thus, the proteins expressed from the EST-related nucleic acids, fragments of EST-related nucleic acids, positional segments of EST-related nucleic acids, or fragments of positional segments of nucleic acids may be useful in treating or controlling a variety of human conditions.

The EST-related nucleic acids, fragments of EST-related nucleic acids, positional segments of EST-related nucleic acids, or fragments of positional segments of nucleic acids may be used in forensic procedures to identify individuals or in diagnostic procedures to identify individuals having genetic diseases resulting from abnormal gene expression.

In addition, the EST-related nucleic acids, fragments of EST-related nucleic acids, positonal segments of EST-related nucleic acids, or fragments of positional segments of nucleic acids are useful for constructing a high resolution map of the human chromosomes.

The present invention also relates to secretion vectors capable of directing the secretion of a protein of interest. Such vectors may be used in gene therapy strategies in which it is desired to produce a gene product in one cell which is to be delivered to another location in the body. Secretion vectors may also facilitate the purification of desired proteins.

The present invention also relates to expression vectors capable of directing the expression of an inserted gene in a desired spatial or temporal manner or at a desired level. Such vectors may include sequences upstream of the EST-related nucleic acids, fragments of EST-related nucleic acids, positional segments of EST-related nucleic acids, or fragments of positional segments of nucleic acids, such as promoters or upstream regulatory sequences.

The present invention also comprises fusion vectors for making chimeric polypeptides comprising a first polypeptide and a second polypeptide. Such vectors are useful for determining the cellular localization of the chimeric polypeptides or for isolating, purifying or enriching the chimeric polypeptides.

The EST-related nucleic acids, fragments of EST-related nucleic acids, positional segments of EST-related nucleic acids, or fragments of positional segments of nucleic acids may also be used for gene therapy to control or treat genetic diseases. In the case of secreted proteins, signal peptides may be fused to heterologous proteins to direct their extracellular secretion.

Bacterial clones containing Bluescipt plasmids having inserts containing the sequence of the non-clustered 5' ESTs are presently stored at 80° C. in 4% (v/v) glycerol in the inventor's laboratories under the designations. The non-clustered 5' ESTs are those which comprise a single EST from a single tissue in the listing of Table II. The inserts may be recovered from the stored materials by growing the appropriate clones on a suitable medium. The Bluescript DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the inserted EST-related nucleic acids, fragments of EST-related nucleic acids, positional segments of EST-related nucleic acids, or fragments of positional segments of nucleic acids. The PCR product which corresponds to the EST-related nucleic acids, fragments of EST-related nucleic acids, positional segments of EST-related nucleic acids, or fragments of positional segments of nucleic acids can then be manipulated using standard cloning techniques familiar to those skilled in the art.

One embodiment of the present invention is a purified nucleic acid comprising a sequence selected from the group consisting of SEQ ID NOs: 24–4100 and SEQ ID NOs: 8178–36681 and sequences complementary to the sequences of SEQ ID NOs: 24–4100 and SEQ ID NOs: 8178–36681.

Another embodiment of the present invention is a purified nucleic acid comprising at least 10 consecutive nucleotides of a sequence selected from the group consisting of SEQ ID NOs: 24–4100 and SEQ ID NOs: 8178–36681 and sequences complementary to the sequences of SEQ ID NOs: 24–4100 and SEQ ID NOs: 8178–36681.

Another embodiment of the present invention is a purified nucleic acid comprising at least 15 consecutive nucleotides of a sequence selected from the group consisting of SEQ ID NOs: 24–4100 and SEQ ID NOs: 8178–36681 and sequences complementary to the sequences of SEQ ID NOs: 24–4100 and SEQ ID NOs: 8178–36681.

A further embodiment of the present invention is a purified nucleic acid comprising the coding sequence of a sequence selected from the group consisting of 24–4100.

Yet another embodiment of the present invention is a purified nucleic acid comprising the fall coding sequences of a sequence selected from the group consisting of SEQ ID NOs: 3721–3811 wherein the full coding sequence comprises the sequence encoding the signal peptide and the sequence encoding the mature protein.

Still another embodiment of the present invention is a purified nucleic acid comprising a contiguous span of a sequence selected from the group consisting of SEQ ID NOs: 3721–3811 which encodes the mature protein.

Another embodiment of the present invention is a purified nucleic acid comprising a contiguous span of a sequence selected from the group consisting of SEQ ID NOs: 24–652 and 3721–3811 which encodes the signal peptide.

Another embodiment of the present invention is a purified nucleic acid encoding a polypeptide comprising a sequence selected from the group consisting of the sequences of SEQ ID NOs: 4101–8177.

Another embodiment of the present invention is a purified nucleic acid encoding a polypeptide comprising a sequence selected from the group consisting of the sequences of SEQ ID NOs: 7798–7888.

Another embodiment of the present invention is a purified nucleic acid encoding a polypeptide comprising a mature protein included in a sequence selected from the group consisting of the sequences of SEQ ID NOs: 7798–7888.

Another embodiment of the present invention is a purified nucleic acid encoding a polypeptide comprising a signal peptide included in a sequence selected from the group consisting of the sequences of SEQ ID NOs: 4101–4729 and 7798–7888.

Another embodiment of the present invention is a purified nucleic acid at least 15, 18, 20, 23, 25, 28, 30, 35, 40, 50, 75, 100, 200, 300, 500 or 1000 nucleotides in length which hybridizes under stringent conditions to a sequence selected from the group consisting of SEQ ID NOs: 24–4100 and SEQ ID NOs: 8178–36681 and sequences complementary to the sequences of SEQ ID NOs: 24–4100 and SEQ ID NOs: 8178–36681.

Another embodiment of the present invention is a purified or isolated polypeptide comprising a sequence selected from the group consisting of the sequences of SEQ ID NOs: 4101–8177.

Another embodiment of the present invention is a purified or isolated polypeptide comprising a sequence selected from the group consisting of SEQ ID NOs: 7798–7888.

Another embodiment of the present invention is a purified or isolated polypeptide comprising a mature protein of a polypeptide selected from the group consisting of SEQ ID NOs: 7798–7888.

Another embodiment of the present invention is a purified or isolated polypeptide comprising a signal peptide of a sequence selected from the group consisting of the polypeptides of SEQ ID NOs: 4101–4729 and 7798–7888.

Another embodiment of the present invention is a purified or isolated polypeptide comprising at least 10 consecutive amino acids of a sequence selected from the group consisting of the sequences of SEQ ID NOs: 4101–8177.

Another embodiment of the present invention is a method of making a cDNA comprising the steps of contacting a collection of mRNA molecules from human cells with a primer comprising at least 15 consecutive nucleotides of a sequence selected from the group consisting of the sequences complementary to SEQ ID NOs: 24–4100 and SEQ ID NOs: 8178–36681, hybridizing said primer to an mRNA in said collection that encodes said protein reverse transcribing said hybridized primer to make a first cDNA strand from said mRNA, making a second cDNA strand complementary to said first cDNA strand and isolating the resulting cDNA encoding said protein comprising said first cDNA strand and said second cDNA strand.

Another embodiment of the present invention is a purified cDNA obtainable by the method of the preceding paragraph.

In one aspect of this embodiment, the cDNA encodes at least a portion of a human polypeptide.

Another embodiment of the present invention is a method of making a cDNA comprising the steps of obtaining a cDNA comprising a sequence selected from the group consisting of SEQ ID NOs: 24–4100 and SEQ ID NOs: 8178–36681, contacting said cDNA with a detectable probe comprising at least 15 consecutive nucleotides of a sequence selected from the group consisting of SEQ ID NOs: 24–4100 and SEQ ID NOs: 8178–36681 and the sequences complementary to SEQ ID NOs: 24–4100 and SEQ ID NOs: 8178–36681 under conditions which permit said probe to hybridize to said cDNA, identifying a cDNA which hybridizes to said detectable probe, and isolating said cDNA which hybridizes to said probe.

Another embodiment of the present invention is a purified cDNA obtainable by the method of the preceding paragraph.

In one aspect of this embodiment, the cDNA encodes at least a portion of a human polypeptide.

Another embodiment of the present invention is a method of making a cDNA comprising the steps of contacting a collection of mRNA molecules from human cells with a first primer capable of hybridizing to the polyA tail of said mRNA, hybridizing said first primer to said polyA tail, reverse transcribing said mRNA to make a first cDNA strand, making a second cDNA strand complementary to said first cDNA strand using at least one primer comprising at least 15 consecutive nucleotides of a sequence selected from the group consisting of SEQ ID NOs: 24–4100 and SEQ ID NOs: 8178–36681, and isolating the resulting cDNA comprising said first cDNA strand and said second cDNA strand.

Another embodiment of the present invention is a purified cDNA obtainable by the method of the preceding paragraph.

In one aspect of this embodiment, said cDNA encodes at least a portion of a human polypeptide.

In another aspect of the preceding method the second cDNA strand is made by contacting said first cDNA strand with a first pair of primers, said first pair of primers comprising a second primer comprising at least 15 consecutive nucleotides of a sequence selected from the group consisting of SEQ ID NOs: 24–4100 and SEQ ID NOs: 8178–36681 and a third primer having a sequence therein which is included within the sequence of said first primer, performing a first polymerase chain reaction with said first pair of primers to generate a first PCR product, contacting said first PCR product with a second pair of primers, said second pair of primers comprising a fourth primer, said fourth primer comprising at least 15 consecutive nucleotides of said sequence selected from the group consisting of SEQ ID NOs: 24–4100 and SEQ ID NOs: 8178–36681, and a fifth primer, wherein said fourth and fifth hybridize to sequences within said first PCR product, and performing a second polymerase chain reaction, thereby generating a second PCR product.

One aspect of this embodiment is a purified cDNA obtainable by the method of the preceding paragraph.

In another aspect of this embodiment, said cDNA encodes at least a portion of a human polypeptide.

Alternatively, the second cDNA strand may be made by contacting said first cDNA strand with a second primer comprising at least 15 consecutive nucleotides of a sequence selected from the group consisting of SEQ ID NOs: 24–4100 and SEQ ID NOs: 8178–36681, hybridizing said second primer to said first strand cDNA, and extending said hybridized second primer to generate said second cDNA strand.

One aspect of the above embodiment is a purified cDNA obtainable by the method of the preceding paragraph.

In a further aspect of this embodiment said cDNA encodes at least a portion of a human polypeptide.

Another embodiment of the present invention is a method of making a polypeptide comprising the steps of obtaining a cDNA which encodes a polypeptide encoded by a nucleic acid comprising a sequence selected from the group consisting of SEQ ID NOs: 24–4100 or a cDNA which encodes a polypeptide comprising at least 10 consecutive amino acids of a polypeptide encoded by a sequence selected from the group consisting of SEQ ID NOs: 24–4100, inserting said cDNA in an expression vector such that said cDNA is operably linked to a promoter, introducing said expression vector into a host cell whereby said host cell produces the protein encoded by said cDNA, and isolating said protein.

Another aspect of this embodiment is an isolated protein obtainable by the method of the preceding paragraph.

Another embodiment of the present invention is a method of obtaining a promoter DNA comprising the steps of obtaining genomic DNA located upstream of a nucleic acid comprising a sequence selected from the group consisting of SEQ ID NOs: 24–4100 and SEQ ID NOs: 8178–36681 and the sequences complementary to the sequences of SEQ ID NOs: 24–4100 and SEQ ID NOs: 8178–36681, screening said genomic DNA to identify a promoter capable of directing transcription initiation, and isolating said DNA comprising said identified promoter.

In one aspect of this embodiment, said obtaining step comprises walking from genomic DNA comprising a sequence selected from the group consisting of SEQ ID NOs: 24–4100 and SEQ ID NOs: 8178–36681 and the sequences complementary to SEQ ID NOs 24–4100 and SEQ ID NOs: 8178–36681. In another aspect of this embodiment, said screening step comprises inserting genomic DNA located upstream of a sequence selected from the group consisting of SEQ ID NOs: 24–4100 and SEQ ID NOs: 8178–36681 and the sequences complementary to SEQ ID NOs: 24–4100 and SEQ ID NOs: 8178–36681 into a promoter reporter vector. For example, said screening step may comprise identifying motifs in genomic DNA located upstream of a sequence selected from the group consisting of SEQ ID NOs: 24–4100 and SEQ ID NOs: 8178–36681 and the sequences complementary to SEQ ID NOs: 24–4100 and SEQ ID NOs: 8178–36681 which are transcription factor binding sites or transcription start sites.

Another embodiment of the present invention is a isolated promoter obtainable by the method of the paragraph above.

Another embodiment of the present invention is the inclusion of at least one sequence selected from the group consisting of SEQ ID NOs: 24–4100 and SEQ ID NOs: 8178–36681, the sequences complementary to the sequences of SEQ ID NOs: 24–4100 and SEQ ID NOs: 8178–36681 and fragments comprising at least 15 consecutive nucleotides of said sequence in an array of discrete ESTs or fragments thereof of at least 15 nucleotides in length. In some aspects of this embodiment, the array includes at least two sequences selected from the group consisting of SEQ ID NOs: 24–4100 and SEQ ID NOs: 8178–36681, the sequences complementary to the sequences of SEQ ID NOs: 24–4100 and SEQ ID NOs: 8178–36681, and fragments comprising at least 15 consecutive nucleotides of said sequences. In another aspect of this embodiment the array includes at least five sequences selected from the group consisting of SEQ ID NOs: 24–4100 and SEQ ID NOs: 8178–36681, the sequences complementary to the sequences of SEQ ID NOs: 24–4100 and SEQ ID NOs: 8178–36681 and fragments comprising at least 15 consecutive nucleotides of said sequences.

Another embodiment of the present invention is an enriched population of recombinant nucleic acids, said recombinant nucleic acids comprising an insert nucleic acid and a backbone nucleic acid, wherein at least 5% of said insert nucleic acids in said population comprise a sequence selected from the group consisting of SEQ ID NOs: 24–4100 and SEQ ID NOs: 8178–36681 and the sequences complementary to SEQ ID NOs: 24–4100 and SEQ ID NOs: 8178–36681.

Another embodiment of the present invention is a purified or isolated antibody capable of specifically binding to a polypeptide comprising a sequence selected from the group consisting of SEQ ID NOs: 4101–8177.

A purified or isolated antibody capable of specifically binding to a polypeptide comprising at least 10 consecutive amino acids of a sequence selected from the group consisting of SEQ ID NOs: 4101–8177.

An antibody composition capable of selectively binding to an epitope-containing fragment of a polypeptide comprising a contiguous span of at least 8 amino acids of any of SEQ ID NOs: 4101–8177, wherein said antibody is polyclonal or monoclonal.

Another embodiment of the present invention is a computer readable medium having stored thereon a sequence selected from the group consisting of a nucleic acid code of SEQ ID NOs: 24–4100 and 8178–36681 and a polypeptide code of SEQ ID NOs: 4101–8177.

Another embodiment of the present invention is a computer system comprising a processor and a data storage device wherein said data storage device has stored thereon a sequence selected from the group consisting of a nucleic acid code of SEQ ID NOs: 24–4100 and 8178–36681 and a polypeptide code of SEQ ID NOs: 4101–8177. In one aspect of this embodiment the computer system further comprises a sequence comparer and a data storage device having reference sequences stored thereon. For example, the sequence comparer may comprise a computer program which indicates polymorphisms. In another aspect of this embodiment, the computer system further comprises an identifier which identifies features in said sequence.

Another embodiment of the present invention is a method for comparing a first sequence to a reference sequence wherein said first sequence is selected from the group consisting of a nucleic acid code of SEQ ID NOs: 24–4100 and 8178–36681 and a polypeptide code of SEQ ID NOs: 4101–8177 comprising the steps of reading said first sequence and said reference sequence through use of a computer program which compares sequences and determining differences between said first sequence and said reference sequence with said computer program. In some aspects of this embodiment, said step of determining differences between the first sequence and the reference sequence comprises identifying polymorphisms.

Another embodiment of the present invention is a method for identifying a feature in a sequence selected from the group consisting of a nucleic acid code of SEQ ID NOs: 24–4100 and 8178–36681 and a polypeptide code of SEQ D NOs: 4101–8177 comprising the steps of reading said sequence through the use of a computer program which identifies features in sequences and identifying features in said sequence with said computer program.

Another embodiment of the present invention is a vector comprising a nucleic acid according to any one of the nucleic acids described above.

Another embodiment of the present invention is a host cell containing the above vector.

Another embodiment of the present invention is a method of making any of the nucleic acids described above comprising the steps of introducing said nucleic acid into a host cell such that said nucleic acid is present in multiple copies in each host cell and isolating said nucleic acid from said host cell.

Another embodiment of the present invention is a method of making a nucleic acid of any of the nucleic acids described above comprising the step of sequentially linking together the nucleotides in said nucleic acids.

Another embodiment of the present invention is a method of making any of the polypeptides described above wherein said polypeptides is 150 amino acids in length or less comprising the step of sequentially linking together the amino acids in said polypeptide.

Another embodiment of the present invention is a method of making any of the polypeptides described above wherein said polypeptides is 120 amino acids in length or less comprising the step of sequentially linking together the amino acids in said polypeptides.

BRIEF DESCRIPTION OF THE SEQUENCE LISTING

SEQ ID NOs: 1, 3, 5, 7, 9, 11, and 13 are full-length cDNAs prepared using the methods described herein.

SEQ ID NOs: 2, 4, 6, 8, 10, 12, and 14 are the polypeptides encoded by the nucleic acids of SEQ ID NOs: 1, 3, 5, 7, 9, 11, and 13.

SEQ ID NOs: 15, 16, 18, 19, 21 and 22 are primers whose use is described in the specification.

SEQ ID NOs: 17, 20, and 23 are the sequences of nucleic acids containing transcription factor binding sites which were obtained as described below.

SEQ ID NOs: 24–652 are nucleic acids having an incomplete ORF which encodes a signal peptide. As used herein, an "incomplete ORF" is an open reading frame in which a start codon has been identified but no stop codon has been identified. The locations of the incomplete ORFs and sequences encoding signal peptides are listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein.

SEQ ID NOs: 653–3720 are nucleic acids having an incomplete ORF in which no sequence encoding a signal peptide has been identified to date. However, it remains possible that subsequent analysis will identify a sequence encoding a signal peptide in these nucleic acids. The locations of the incomplete ORFs are listed in the accompanying Sequence Listing.

SEQ ID NOs: 3721–3811 are nucleic acids having a complete ORF which encodes a signal peptide. As used herein, a "complete ORF" is an open reading frame in which a start codon and a stop codon have been identified. The locations of the complete ORFs and sequences encoding signal peptides are listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "a" in the signal peptide sequence indicates the location where proteolytic cleavage of the signal peptide occurs to generate a mature protein.

SEQ ID NOs: 3812–4100 are nucleic acids having a complete ORF in which no sequence encoding a signal peptide has been identified to date. However, it remains possible that subsequent analysis will identify a sequence encoding a signal peptide in these nucleic acids. The locations of the complete ORFs are listed in the accompanying Sequence Listing.

SEQ ID NOs: 4101–4729 are "incomplete polypeptide sequences" which include a signal peptide. Incomplete polypeptide sequences" are polypeptide sequences encoded by nucleic acids in which a start codon has been identified but no stop codon has been identified. These polypeptides are encoded by the nucleic acids of SEQ ID NOs: 24–652. The location of the signal peptide is listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "P" in the signal peptide sequence indicates the location where proteolytic cleavage of the signal peptide occurs to generate a mature protein.

SEQ ID NOs: 4730–7797 are incomplete polypeptide sequences in which no signal peptide has been identified to date. However, it remains possible that subsequent analysis will identify a signal peptide in these polypeptides. These polypeptides are encoded by the nucleic acids of SEQ ID NOs: 653–3720.

SEQ ID NOs: 7798–7888 are "complete polypeptide sequences" which include a signal peptide. "Complete polypeptide sequences" are polypeptide sequences encoded by nucleic acids in which a start codon and a stop codon have been identified. These polypeptides are encoded by the nucleic acids of SEQ ID NOs: 3721–3811. The location of the signal peptide is listed in the accompanying Sequence Listing. In addition, the von Heijne score of the signal peptide computed as described below is listed as the "score" in the accompanying Sequence Listing. The sequence of the signal-peptide is listed as "seq" in the accompanying Sequence Listing. The "/" in the signal peptide sequence indicates the location where proteolytic cleavage of the signal peptide occurs to generate a mature protein.

SEQ ID NOs: 7889–8177 are complete polypeptide sequences in which no signal peptide has been identified to date. However, it remains possible that subsequent analysis will identify a signal peptide in these polypeptides. These polypeptides are encoded by the nucleic acids of SEQ ID NOs: 3812–4100.

SEQ ID NOs: 8178–36681 are nucleic acid sequences in which no open reading frame has been conclusively identified to date. However, it remains possible subsequent analysis will identify an open reading frame in these nucleic acids.

In the accompanying Sequence Listing, all instances of the symbol "n" in the nucleic acid sequences mean that the nucleotide can be adenine, guanine, cytosine or thymine. In some instances the polypeptide sequences in the Sequence Listing contain the symbol "Xaa." These "Xaa" symbols indicate either (1) a residue which cannot be identified because of nucleotide sequence ambiguity or (2) a stop codon in the determined sequence where applicants believe one should not exist (if the sequence were determined more accurately). In some instances, several possible identities of the unknown amino acids may be suggested by the genetic code.

BRIEF DESCRIPTION OF THE DRAWINGS

FIG. 2 is an analysis of the 43 amino terminal amino acids of all human SwissProt proteins to determine the frequency of false positives and false negatives using the techniques for signal peptide identification described herein.

FIG. 5 describes the transcription factor binding sites present in each of these promoters.

DETAILED DESCRIPTION OF THE PREFERRED EMBODIMENT

Figure 1:
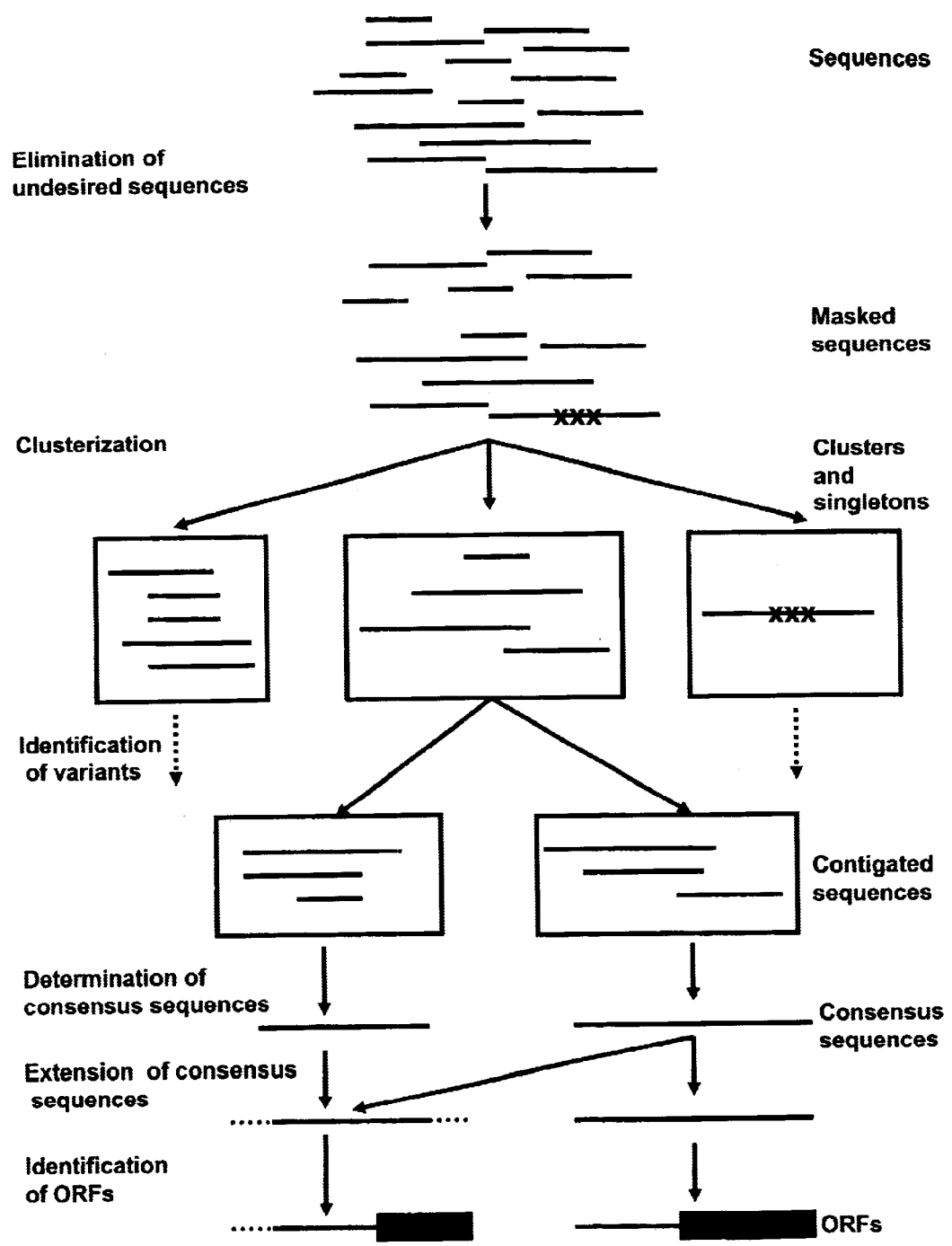
FIG. 1 summarizes the computer analysis procedure for obtaining consensus contigated ESTs.

I. General Methods for Obtaining 5' ESTs Derived From mRNAs With Intact 5' Ends In order to obtain the 5' ESTs of the present invention, mRNAs with intact 5' ends must be obtained. Example 1 below describes the preparation of 5' ESTs.

EXAMPLE 1

Preparation of mRNA

Total human RNAs or polyA+ RNAs derived from 30 different tissues were respectively purchased from LABIMO and CLONTECH and used to generate 42 cDNA libraries as described below. The purchased RNA had been isolated from cells or tissues using acid guanidium thiocyanate-phenol-chloroform extraction (Chomczyniski and Sacchi, *Analytical Biochemisty* 162:156–159, 1987). PolyA+ RNA was isolated from total RNA (LABIMO) by two passes of oligo dT chromatography, as described by Aviv and Leder., *Proc. Natl. Acad. Sci. USA* 69:1408–1412, 1972) in order to eliminate ribosomal RNA.

The quality and the integrity of the polyA+ RNAs were checked. Northern blots hybridized with a globin probe were used to confirm that the mRNAs were not degraded. Contamination of the polyA+ mRNAs by ribosomal sequences was checked using Northern blots and a probe derived from the sequence of the 28S rRNA. Preparations of mRNAs with less than 5% of rRNAs were used in library construction. To avoid constructing libraries with RNAs contaminated by exogenous sequences (prokaryotic or fungal), the presence of bacterial 16S ribosomal sequences or of two highly expressed fingal mRNAs was examined using PCR.

Following preparation of the mRNAs from various tissues an oligonucleotide tag was specifically attached to the caps at the 5' ends of the mRNAs. The oligonucleotide tag had an EcoRI site therein to facilitate later cloning procedures. Following attachment of the oligonucleotide tag to the mRNA, the integrity of the mRNA was examined by performing a Northern blot with 200 to 500 ng of mRNA using a probe complementary to the oligonucleotide tag before performing the first strand synthesis described in Example 2.

EXAMPLE 2 cDNA Synthesis Using mRNA Templates Having Intact 5' Ends

For the mRNAs joined to oligonucleotide tags, first strand cDNA synthesis was performed using a reverse transcriptase with random nonamers as primers. In order to protect internal EcoRI sites in the cDNA from digestion at later steps in the procedure, methylated dCTP was used for first strand synthesis. After removal of RNA by an alkaline hydrolysis, the first strand of cDNA was precipitated using isopropanol in order to eliminate residual primers.

The second strand of the cDNA was synthesized with a Klenow fragment using a primer corresponding to the 5' end of the ligated oligonucleotide. Methylated dCTP was also used for second strand synthesis in order to protect internal EcoRI sites in the cDNA from digestion during the cloning process.

Following cDNA synthesis, the cDNAs were cloned into pBlueScript as described in Example 3 below.

EXAMPLE 3

Cloning of cDNAs Derived From mRNA With Intact 5' Ends Into BlueScript

Following second strand synthesis, the ends of the cDNA were blunted with T4 DNA polymerase (Biolabs) and the cDNA was digested with EcoRI. Since methylated dCTP was used during cDNA synthesis, the EcoRI site present in the tag was the only hemi-methylated site, hence the only site susceptible to EcoRI digestion. The cDNA was then size fractionated using exclusion chromatography (AcA, Biosepra) and fractions corresponding to cDNAs of more than 150 bp were pooled and ethanol precipitated. The cDNA was directionally cloned into the SmaI and EcoRI ends of the phagemid pBlueScript vector (Strajagene). The ligation mixture was electroporated into bacteria and propagated under appropriate antibiotic selection.

Clones containing the oligonucleotide tag attached were then selected as described in Example 4 below.

EXAMPLE 4

Selection of Clones Having the Oligonucleotide Tag Attached Thereto

The plasmid DNAs containing 5' EST libraries made as described above were purified (Qiagen). A positive selection of the tagged clones was performed as follows. Briefly, in this selection procedure, the plasmid DNA was converted to single stranded DNA using gene II endonuclease of the phage F1 in combination with an exonuclease (Chang et al., *Gene* 127:95–8, 1993) such as exonuclease III or T7 gene 6 exonuclease. The resulting single stranded DNA was then purified using paramagnetic beads as described by Fry et al., *Biotechniques*, 13: 124–131, 1992. In this procedure, the single stranded DNA was hybridized with a biotinylated oligonucleotide having a sequence corresponding to the 3' end of the oligonucleotide tag. Clones including a sequence complementary to the biotinylated oligonucleotide were captured by incubation with streptavidin coated magnetic beads followed by magnetic selection. After capture of the positive clones, the plasmid DNA was released from the magnetic beads and converted into double stranded DNA using a DNA polymerase such as the Thermosequenase obtained from Amersham Pharmacia Biotech. The double stranded DNA was then electroporated into bacteria. The percentage of positive clones having the 5' tag oligonucleotide was estimated to typically rank between 90 and 98% using dot blot analysis.

Following electroporation, the libraries were ordered in 384-microtiter plates (MTP). A copy of the MTP was stored for future needs. Then the libraries were transferred into 96 MTP and sequenced as described below.

EXAMPLE 5

Sequencing of Inserts in Selected Clones

Plasmid inserts were first amplified by PCR on PE-9600 thermocyclers (Perkin-Elmer, Applied Biosystems Division, Foster City, Calif.), using standard SETA-A and SETA-B primers (Genset SA), AmpliTaqGold (Perkin-Elmer), dNTPs (Boehringer), buffer and cycling conditions as recommended by the Perkin-Elmer Corporation.

PCR products were then sequenced using automatic ABI Prism 377 sequencers (Perkin Elmer). Sequencing reactions were performed using PE 9600 thermocyclers with standard dye-primer chemistry and ThermoSequenase (Amersham Pharmacia Biotech). The primers used were either T7 or 21M13 (available from Genset SA) as appropriate. The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham.

Following the sequencing reaction, the samples were precipitated with ethanol, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

EXAMPLE 6

Obtaining 5' ESTs From Full-length cDNA Libraries Obtained From mRNA With Intact 5' Ends Alternatively, 5' ESTs may be isolated from other cDNA or genomic DNA libraries. Such cDNA or genomic DNA libraries may be obtained from a commercial source or made using other techniques familiar to those skilled in the art. One example of such cDNA library construction, a full-length cDNA library, is as follows.

PolyA+ RNAs are prepared and their quality checked as described in Example 1. Then, the caps at the 5' ends of the polyA+ RNAs are specifically joined to an oligonucleotide tag. The oligonucleotide tag may contain a restriction site such as EcoRI to facilitate further subcloning procedures. Northern blotting is then performed to check the size of mRNAs having the oligonucleotide tag attached thereto and to ensure that the mRNAs were actually tagged.

First strand synthesis is subsequently carried out for mRNAs joined to the oligonucleotide tag as described in Example 2 above except that the random nonamers are replaced by an oligo-dT primer. For instance, this oligo-dT primer may contain an internal tag of 4 nucleotides which is different from one tissue to the other. Following second strand synthesis using a primer contained in the oligonucleotide tag attached to the 5' end of mRNA, the blunt ends of the obtained double stranded full-length DNAs are modified into cohesive ends to facilitate subcloning. For example, the extremities of full-length cDNAs may be modified to allow subcloning into the EcoRI and HindIII sites of a Bluescript vector using the EcoRI site of the oligonucleotide tag and the addition of a HindIII adaptor to the 3' end of full-length cDNAs.

The full-length cDNAs are then separated into several fractions according to their sizes using techniques familiar to those skilled in the art. For example, electrophoretic separation may be applied in order to yield 3 or 6 different fractions. Following gel extraction and purification, the cDNA fractions are subcloned into appropriate vectors, such as Bluescript vectors, transformed into competent bacteria and propagated under appropriate antibiotic conditions. Subsequently, plasmids containing tagged full-length cDNAs are positively selected as described in Example 4.

The 5' end of full-length cDNAs isolated from such cDNA libraries may then be sequenced as described in Example 5.

II. 2. Computer Analysis of the Isolated 5' ESTs: Construction of NetGene™ and SignalTag™ Databases The sequence data from the 42 cDNA libraries made as described above were transferred to a database, where quality control and validation steps were performed. A base-caller, working using a Unix system, automatically flagged suspect peaks, taking into account the shape of the peaks, the inter-peak resolution, and the noise level. The proprietary base-caller also performed an automatic trimming. Any stretch of 25 or fewer bases having more than 4 suspect peaks was considered unreliable and was discarded. Sequences corresponding to cloning vector or ligation oligonucleotides were automatically removed from the EST sequences. However, the resulting EST sequences may contain 1 to 5 bases belonging to the above mentioned sequences at their 5' end. If needed, these can easily be removed on a case to case basis.

Following sequencing as described above, the sequences of the 5' ESTs were entered in NetGene™, a database for storage and manipulation as described below and as depicted in FIG. 1. Before searching the ESTs in the NetGene™ database for sequences of interest, ESTs derived from mRNAs which were not of interest, such as endogenous or exogenous contaminants, redundant sequences, small sequences, highly degenerate sequences, or repeated sequences were identified and eliminated from farther consideration.

In order to determine the accuracy of the sequencing procedure as well as the efficiency of the 5' selection described above, the analyses described in Examples 7 and 8 respectively were performed on 5' ESTs obtained from

EXAMPLE 7

Measurement of Sequencing Accuracy by Comparison to Known Sequences

To further determine the accuracy of the sequencing procedure described in Example 5, the sequences of Net-Gene™ 5' ESTs derived from known sequences were identified and compared to the original known sequences. First, a FASTA analysis with overhangs shorter than 5 bp on both ends was conducted on the 5' ESTs to identify those matching an entry in the public human mRNA database. The 6655 5' ESTs which matched a known human mRNA were then realigned with their cognate mRNA and dynamic programming was used to include substitutions, insertions, and deletions in the list of "errors" which would be recognized. Errors occurring in the last 10 bases of the 5' EST sequences were ignored to avoid the inclusion of spurious cloning sites in the analysis of sequencing accuracy.

This analysis revealed that the sequences incorporated in the NETGENE™ database had an accuracy of more than 99.5%.

EXAMPLE 8

Determination of Efficiency of 5' EST Selection

To determine the efficiency at which the above selection procedures isolated 5' ESTs which included sequences close to the 5' end of the mRNAs from which they derived, the sequences of the ends of the 5' ESTs derived from the elongation factor 1 subunit a and ferritin heavy chain genes were compared to the known cDNA sequences of these genes. Since the transcription start sites of both genes are well characterized, they may be used to determine the percentage of derived 5' ESTs which included the authentic transcription start sites.

For both genes, more than 95% of the obtained 5' ESTs actually included sequences close to or upstream of the 5' end of the corresponding mRNAs.

To extend the analysis of the reliability of the procedures for isolating 5' ESTs from ESTs in the NetGene™ database, a similar analysis was conducted using a database composed of human mRNA sequences extracted from GenBank database release 97 for comparison. The 5' ends of more than 85% of 5' ESTs derived from mRNAs included in the GeneBank database were located close to the 5' ends of the known sequence. As some of the mRNA sequences available in the GenBank database are deduced from genomic sequences, a 5' end matching with these sequences will be counted as an internal match. Thus, the method used here underestimates the yield of ESTs including the authentic 5' ends of their corresponding mRNAs.

EXAMPLE 9

Clustering of the 5' ESTs

Since the cDNA libraries made above include multiple 5' ESTs derived from the same mRNA, overlapping 5' ESTs may be assembled into continuous sequences. The following method (see FIG. 1) describes how to efficiently cluster 5' ESTs in order to yield not only consensus 5' EST sequences for mRNAs derived from different genes but also consensus 5' EST sequences for different mRNAs, so called variants, transcribed from the same gene such as alternatively spliced mRNAs. This clustering was performed on a set of NetGene™ 5' ESTs sequences following elimination of endogenous contaminants, elimination of uninformative sequences and masking of repeats.

The whole set of sequences was first partitioned into smaller sets, so-called clusters, containing sequences exhibiting perfect matches with each other on a given length. Such clusters contain 5' ESTs derived from a small number of different genes. Some 5' EST sequences were not clustered using this approach either because they were not homologous to any other sequence or because the homology was not properly detected. To overcome this problem, sequences not clustered, so called singletons, may be compared to the consensus contigated ESTs obtained later on and, if necessary, included in the appropriate clusters and used to compute other consensus contigated ESTs.

Thereafter, all variants of a given gene were identified in each cluster as follows. Overlapping sequences inside a given cluster were figured as oriented graphs where each sequence was a node and each overlap an edge. Then, the different genes contained within a single graph which were represented by different convex components were identified and isolated from each other. Subsequently, the different variants of a same gene were isolated using an algorithm based on the detection of forks within a convex component. If desired, the consensus contigated EST sequences may be verified by identifying clones in nucleic acid samples derived from biological tissues, such as cDNA libraries, which hybridize to the probes based on the sequences of the consensus contigated ESTs and sequencing them.

Overlapping 5' EST sequences belonging to the same variant as well as included 5' EST sequences belonging to the same cluster were then contigated and consensus contigated 5' EST sequences were generated for each variant. Some of the obtained consensus contigated 5' EST sequences were incomplete due to the fact that only included and overlapping 5' EST sequences were considered to isolate genes and due to the algorithm developed to find variants. These variant consensus contigated 5' EST sequences were extended as follows. Variants transcribed from the same gene were compared pairwise and the 5' EST consensus sequences that were incomplete either in 5' and/or in 3' were extended with the appropriate sequence from the other variants. All 5' EST consensus sequences eventually completed in 5' or 3' from each cluster were subsequently compared to the whole set of individual 5' EST sequences obtained for this cluster.

EXAMPLE 10

Identification of the Most Probable Open Reading Frame of 5' ESTs

Subsequently, the most probable coding open reading frame (ORF) may be determined for each consensus assembled 5' EST or 5' EST as follows.

Each nucleic acid sequence is first divided into several subsequences which coding propensity is evaluated using different methods known to those skilled in the art such as the evaluation of N-mer frequency and its variants (Fickett and Tung, *Nucleic Acids Res*; 20:6441–50 (1992)) or the Average Mutual Information method (Grosse et al, International Conference on Intelligent Systems for Molecular Biology, Montreal, Canada. Jun. 28–Jul. 1, 1998). Each of the scores obtained by the techniques described above are then normalized by their distribution extremities and then fused using a neural network into a unique score that represents the coding probability of a given subsequence.

The coding probability scores obtained for each subsequence, thus the probability score profiles obtained for each reading frame, are then linked to the initiation codons present on the sequence. For each open reading frame, defined as a nucleic acid sequence of at least 50 nucleotides beginning with an ATG codon, an ORF score is determined. Basically, this score is the sum of the probability scores computed for each subsequence corresponding to the considered ORF in the correct reading frame corrected by a function that negatively ponderates locally high score values and positively ponderates sustained high score values. The chosen ORF is the one with the highest score.

Two kinds of ORFs are considered. In some embodiments, 5' ESTs encoding ORFs of at least 50 amino acids extending up to the end of the consensus assembled 5' EST sequences are obtained. In other embodiments, 5' ESTs encoding complete ORFs, namely ORFs with start and stop codons, containing at least 100 amino acids are obtained.

EXAMPLE 11

Sequence Analysis

Application of the clustering method described in Example 9 to a selected set of 126,735 NetGene™ 5' ESTs free from endogenous contaminants and uninformative sequences yielded 9490 consensus assembled 5' EST sequences or variants for a total of 8037 genes clustered representing 98,973 individual 5' ESTs. One of them which contained 21,138 sequences and was shown to contain chimeras thanks to comparison to public sequences was removed from further analysis.

Both non clustered 5' ESTs, i.e. singletons, and consensus contigated 5' ESTs were then compared to already known sequences as follows. Those sequences matching human mRNA sequences were eliminated from further analysis. Then, following masking of repeats those sequences matching sequences that have already been discovered by the inventors, namely sequences exhibiting more than 90% homology over stretches longer than 40 nucleotides using BLAST2N with overhangs shorter than 10 nucleotides, were removed from further consideration. The final set represents the sequences of the invention (SEQ ID NOs:24–4100 and 8178–36681), i.e., 7609 consensus contigated 5' EST from 6398 clusters containing 31,267 5' ESTs and 24, 972 singletons.

Of the 6398 obtained clusters, 658 were shown to be multivariant, i.e. to contain several variants of the same gene. Table I gives for each of the multivariant clusters named by its internal reference (first column), the list of the consensus sequences of all variants, each variant being represented by a different SEQ ID NO.

Subsequently, the most probable open reading frame was determined, as described in Example 10, for all sequences of the invention. 3,697 5' ESTs (SEQ ID NOs:24–3720) encoding incomplete ORFs (SEQ ID NOs:4101–7797) of at least 50 amino acid long were found. In addition, 380 5' ESTs (SEQ IE NOs:3721–4100) encoding complete ORFs (SEQ ID NOs:7798–8177) of at least 100 amino acids were found.

The nucleotide sequences of the SEQ ID NOs: 24–4100 and 8178–36681 and the amino acid sequences encoded by SEQ ID NOs: 24–4100 (i.e. amino acid sequences of SEQ ID NOs: 4101–8177) are provided in the appended sequence listing. Some of the amino acid sequences may contain "Xaa", designators. These "Xaa" designators indicate either (1) a residue which cannot be identified because of nucleotide sequence ambiguity or (2) a stop codon in the determined sequence where applicants believe one should not exist (if the sequence were determined more accurately).

If one of the nucleic acid sequences of SEQ ID NOs: 24–4100 and 8178–36681 are suspected of containing one or more incorrect or ambiguous nucleotides, the ambiguities can readily be resolved by resequencing a fragment containing the nucleotides to be evaluated. If one or more incorrect or ambiguous nucleotides are detected, the corrected sequences should be included in the clusters from which the sequences were isolated, and used to compute other consensus contigated sequences on which other ORFs would be identified. Nucleic acid fragments for resolving sequencing errors or ambiguities may be obtained from deposited clones or can be isolated using the techniques described herein. Resolution of any such ambiguities or errors may be facilitated by using primers which hybridize to sequences located close to the ambiguous or erroneous sequences. For example, the primers may hybridize to sequences within 50–75 bases of the ambiguity or error. Upon resolution of an error or ambiguity, the corresponding corrections can be made in the protein sequences encoded by the DNA containing the error or ambiguity. The amino acid sequence of the protein encoded by a particular clone can also be determined by expression of the clone in a suitable host cell, collecting the protein, and determining its sequence.

In addition, if one of the sequences of SEQ ID NOs: 4101–8177 is suspected of containing an truncated ORF as the result of a frameshift in the sequence, such frameshifting errors may be corrected by combining the following two approaches. The first one involves thorough examination of all double predictions, i.e. all cases where the probability scores for two ORFs located on different reading frames are high and close, preferably different by less than 0.4. The fine examination of the region where the two possible ORFs overlap may help to detect the frameshift. In the second approach homologies with known proteins are used to correct suspected frameshifts.

EXAMPLE 12

Identification of Potential Signal Sequences in 5' ESTs

The amino acid sequences of SEQ ID NOs: 4101–8177 were then searched to identify potential signal motifs using slight modifications of the procedures disclosed in Von Heijne, *Nucleic Acids Res.* 14:4683–4690, 1986, the disclosure of which is incorporated herein by reference. Those sequences encoding a 15 amino acid long stretch with a score of at least 3.5 in the Von Heijne signal peptide identification matrix were considered to possess a signal sequence and were included in a database called SIGNALTAG™.

The sequences of the 720 nucleic acid sequences containing a signal sequence (SEQ ID NOs:24–652 and 3721–3811) and the corresponding polypeptides with a potential signal peptide (SEQ ID NO:4101–4729 and 7798–7888) are provided in the Sequence Listing appended hereto. The signal peptides of such polypeptides are indicated as features in the appended Sequence Listing. It should be noted that, in accordance with the regulations governing Sequence Listings, in the appended Sequence Listing, the full protein (i.e. the protein containing the signal peptide and the mature protein) extends from an amino acid residue having a negative number through a positively numbered C-terminal amino acid residue. Thus, the first amino acid of the mature protein resulting from cleavage of the signal peptide is designated as amino acid number 1, and the first amino acid of the signal peptide is designated with the appropriate negative number.

To confirm the accuracy of the above method for identifying signal sequences, the analysis of Example 13 was performed.

EXAMPLE 13

Confirmation of Accuracy of Identification of Potential Signal Sequences in 5' ESTs The accuracy of the above procedure for identifying signal sequences encoding signal peptides was evaluated by applying the method to the 43 amino acids located at the N terminus of all human SwissProt proteins. The computed Von Heijne score for each protein was compared with the known characterization of the protein as being a secreted protein or a non-secreted protein. In this manner, the number of non-secreted proteins having a score higher than 3.5 (false positives) and the number of secreted proteins having a score lower than 3.5 (false negatives) could be calculated.

Using the results of the above analysis, the probability that a peptide encoded by the 5' region of the mRNA is in fact a genuine signal peptide based on its Von Heijne's score was calculated based on either the assumption that 10% of human proteins are secreted or the assumption that 20% of human proteins are secreted. The results of this analysis are shown in FIG. 2.

Using the above method of identification of secretory proteins, 5' ESTs of the following polypeptides known to be secreted were obtained: human glucagon, gamma interferon induced monokine precursor, secreted cyclophilin-like protein, human pleiotropin, and human biotinidase precursor. Thus, the above method successfully identified those 5' ESTs which encode a signal peptide.

To confirm that the signal peptide encoded by the 5' ESTs or contigated consensus 5' ESTs actually functions as a signal peptide, the signal sequences from the 5' ESTs or consensus 5' ESTs may be cloned into a vector designed for the identification of signal peptides. Such vectors are designed to confer the ability to grow in selective medium only to host cells containing a vector with an operably linked signal sequence. For example, to confirm that a 5' EST or consensus 5' EST encodes a genuine signal peptide, the signal sequence of the 5' EST or consensus 5' EST may be inserted upstream and in frame with a non-secreted form of the yeast invertase gene in signal peptide selection vectors such as those described in U.S. Pat. No. 5,536,637, the disclosure of which is incorporated herein by reference. Growth of host cells containing signal sequence selection vectors with the correctly inserted 5' EST or consensus 5' EST signal sequence confirms that the 5' EST or consensus 5' ESTs encodes a genuine signal peptide.

Alternatively, the presence of a signal peptide may be confirmed by cloning the extended cDNAs obtained using the ESTs or consensus 5' ESTs into expression vectors such as pXT1 as described below, or by constructing promoter-signal sequence-reporter gene vectors which encode fusion proteins between the signal peptide and an assayable reporter protein. After introduction of these vectors into a suitable host cell, such as COS cells or NIH3T3 cells, the growth medium may be harvested and analyzed for the presence of the secreted protein. The medium from these cells is compared to the medium from control cells containing vectors lacking the signal sequence or extended cDNA insert to identify vectors which encode a functional signal peptide or an authentic secreted protein.

EXAMPLE 14

Assessment of the Novelty Rate of 5' ESTs

To assess the yield of new sequences, the obtained 5' ESTs and consensus contigated 5' ESTs were compared to all known human mRNAs extracted from the EMBL release 57 and daily updates available at the time of filing. The comparison was performed using BLAST2N on both strands following masking of the repeats. Sequences having more than 95% homology with public sequences over their whole length with at most 10 nucleotide overhangs on each extremity were considered as previously identified. Thus, about 90% of 5' ESTs or consensus assembled 5' ESTs were considered unidentified.

II. 3. Evaluation of Spatial and Temporal Expression of mRNAs Corresponding to the 5' ESTs or Extended cDNAs Each of the SEQ ID NOs: 24–4100 and 8178–36681 was also categorized based on the tissue from which its corresponding mRNA was obtained, as described below in Example 15.

EXAMPLE 15

Expression Patterns of mRNAs From Which the 5' ESTs Were Obtained

Table II shows the spatial distribution of each of the 5' ESTs (non-clustered ESTs) and of each consensus contigated ESTs respectively. Table II provides the SEQ ID NOs: of the 5' ESTs (referred to alternatively herein as non-clustered ESTs or singletons) and consensus contigated ESTs. Table II also lists the number of ESTs from each type of tissue which were used to assemble the contigated consensus ESTs. The SEQ ID NOs: in Table II which contain a single 5' EST from a single tissue are 5' ESTs. Each type of tissue listed in Table II is encoded by a letter. The correspondence between the letter code and the tissue type is given in Table III. For example, the consensus contigated EST of SEQ ID NO: 47 contains one 5' EST from cancerous prostate, two 5' ESTs from lymph ganglia, and two 5' ESTs from testes.

In addition to categorizing the 5' ESTs and consensus contigated 5' ESTs with respect to their tissue of origin, the spatial and temporal expression patterns of the mRNAs corresponding to the 5' ESTs and consensus contigated 5' ESTs, as well as their expression levels, may be determined as described in Example 16 below.

Characterization of the spatial and temporal expression patterns and expression levels of these mRNAs is useful for constructing expression vectors capable of producing a desired level of gene product in a desired spatial or temporal manner, as will be discussed in more detail below.

Furthermore, 5' ESTs and consensus contigated 5' ESTs whose corresponding mRNAs are associated with disease states may also be identified. For example, a particular disease may result from the lack of expression, over expression, or under expression of a mRNA corresponding to a 5' EST or consensus contigated 5' EST. By comparing mRNA expression patterns and quantities in samples taken from healthy individuals with those from individuals suffering from a particular disease, 5' ESTs or consensus contigated 5' ESTs responsible for the disease may be identified.

It will be appreciated that the results of the above characterization procedures for 5' ESTs and consensus contigated 5' ESTs also apply to extended cDNAs (obtainable as described below) which contain sequences adjacent to the 5' ESTs and consensus contigated 5' ESTs. It will also be appreciated that if desired, characterization may be delayed until extended cDNAs have been obtained rather than characterizing the 5' ESTs or consensus contigated 5' ESTs themselves.

EXAMPLE 16

Evaluation of Expression Levels and Patterns of mRNAs Corresponding to EST-related Nucleic Acids Expression levels and patterns of mRNAs corresponding to EST-related nucleic acids may be analyzed by solution hybridization with long probes as described in International Patent Application No. WO 97/05277, the entire contents of which are hereby incorporated by reference. Briefly, an EST-related nucleic acid, fragment of an EST related nucleic acid, positional segment of an EST-related nucleic acid, or fragment of a positional segment of an EST-related nucleic acid corresponding to the gene encoding the mRNA to be characterized is inserted at a cloning site immediately downstream of a bacteriophage (T3, T7 or SP6) RNA polymerase promoter to produce antisense RNA. Preferably, the EST-related nucleic acid, fragment of an EST related nucleic acid, positional segment of an EST-related nucleic acid, or fragment of a positional segment of an EST-related nucleic acid is 100 or more nucleotides in length. The plasmid is linearized and transcribed in the presence of ribonucleotides comprising modified ribonucleotides (i.e. biotin-UJT and DIG-UITP). An excess of this doubly labeled RNA is hybridized in solution with mRNA isolated from cells or tissues of interest. The hybridizations are performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

The EST-related nucleic acid, fragment of an EST related nucleic acid, positional segment of an EST-related nucleic acid, or fragment of a positional segment of an EST-related nucleic acid may also be tagged with nucleotide sequences for the serial analysis of gene expression (SAGE) as disclosed in UK Patent Application No. 2 305 241 A, the entire contents of which are incorporated by reference. In this method, cDNAs are prepared from a cell, tissue, organism or other source of nucleic acid for which gene expression patterns must be determined. The resulting cDNAs are separated into two pools. The cDNAs in each pool are cleaved with a first restriction endonuclease, called an anchoring enzyme, having a recognition site which is likely to be present at least once in most cDNAs. The fragments which contain the 5' or 3' most region of the cleaved cDNA are isolated by binding to a capture medium such as streptavidin coated beads. A first oligonucleotide linker having a first sequence for hybridization of an amplification primer and an internal restriction site for a so called tagging endonuclease is ligated to the digested cDNAs in the first pool. Digestion with the second endonuclease produces short tag fragments from the cDNAs.

A second oligonucleotide having a second sequence for hybridization of an amplification primer and an internal restriction site is ligated to the digested cDNAs in the second pool. The cDNA fragments in the second pool are also digested with the tagging endonuclease to generate short tag fragments derived from the cDNAs in the second pool. The tags resulting from digestion of the first and second pools with the anchoring enzyme and the tagging endonuclease are ligated to one another to produce so called ditags. In some embodiments, the ditags are concatamerized to produce ligation products containing from 2 to 200 ditags. The tag sequences are then determined and compared to the sequences of the EST-related nucleic acid, fragment of an EST related nucleic acid, positional segment of an EST-related nucleic acid, or fragment of a positional segment of an EST-related nucleic acid to determine which 5' ESTs, contigated consensus 5' ESTs, or extended cDNAs are expressed in the cell, tissue, organism, or other source of nucleic acids from which the tags were derived. In this way, the expression pattern of the 5' ESTs, contigated consensus 5' ESTs, or extended cDNAs in the cell, tissue, organism, or other source of nucleic acids is obtained.

Quantitative analysis of gene expression may also be performed using arrays. As used herein, the term array means a one dimensional, two dimensional, or multidimensional arrangement of EST-related nucleic acids, fragments of EST related nucleic acids, positional segments EST-related nucleic acids, or fragments of positional segments of EST-related nucleic acids. Preferably, the EST-related nucleic acids, fragments of EST related nucleic acids, positional segments EST-related nucleic acids, or fragments of positional segments of EST-related nucleic acids are at least 15 nucleotides in length. More preferably, the EST-related nucleic acids, fragments of EST related nucleic acids, positional segments EST-related nucleic acids, or fragments of positional segments of EST-related nucleic acids are at least 100 nucleotide long. More preferably, the fragments are more than 100 nucleotides in length. In some embodiments, the EST-related nucleic acids, fragments of EST related nucleic acids, positional segments EST-related nucleic acids, or fragments of positional segments of EST-related nucleic acids may be more than 500 nucleotides long.

For example, quantitative analysis of gene expression may be performed with EST-related nucleic acids, fragments of EST related nucleic acids, positional segments EST-related nucleic acids, or fragments of positional segments of EST-related nucleic acids in a complementary DNA microarray as described by Schena et al. (*Science* 270:467470, 1995; *Proc. Natl. Acad. Sci. U.S.A.* 93:10614–10619, 1996). EST-related nucleic acids, fragments of EST related nucleic acids, positional segments EST-related nucleic acids, or fragments of positional segments of EST-related nucleic acids are amplified by PCR and arrayed from 96-well microtiter plates onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 $cm^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of the expression of genes may also be performed with EST-related nucleic acids, fragments of EST related nucleic acids, positional segments EST-related nucleic acids, or fragments of positional segments of EST-related nucleic acids in complementary DNA arrays as described by Pictu et al. (*Genome Research* 6:492–503, 1996). The EST-related nucleic acids, fragments of EST related nucleic acids, positional segments EST-related nucleic acids, or fragments of positional segments of EST-related nucleic acids thereof are PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis of the EST-related nucleic acids, fragments of EST related nucleic acids, positional segments EST-related nucleic acids, or fragments of positional segments of EST-related nucleic acids can be done through high density nucleotide arrays as described by Lockhart et al. (*Nature Biotechnology* 14: 1675–1680, 1996) and Sosnowsky et al. (*Proc. Natl. Acad. Sci.* 94:1119–1123, 1997).

Oligonucleotides of 15–50 nucleotides corresponding to sequences of EST-related nucleic acids, fragments of EST related nucleic acids, positional segments EST-related nucleic acids, or fragments of positional segments of EST-related nucleic acids are synthesized directly on the chip (Lockhart et al., supra) or synthesized and then addressed to the chip (Sosnowsky et al., supra). Preferably, the oligonucleotides are about 20 nucleotides in length.

cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al, supra and application of different electric fields (Sonowsky et al, supra.), the dyes or labeling compounds are detected and quantified. Duplicate hybridizations are performed. Comparative analysis of the intensity of the signal originating from cDNA probes on the same target oligonucleotide in different cDNA samples indicates a differential expression of the mRNA corresponding to the 5' EST, consensus contigated 5' EST or extended cDNA from which the oligonucleotide sequence has been designed.

III. Use of 5' ESTs to Clone Extended cDNAs and to Clone the Corresponding Genomic DNAs Once 5' ESTs or consensus contigated 5' ESTs which include the 5' end of the corresponding mRNAs have been selected using the procedures described above, they can be utilized to isolate extended cDNAs which contain sequences adjacent to the 5' ESTs or contigated consensus 5' ESTs. The extended cDNAs may include the entire coding sequence of the protein encoded by the corresponding mRNA, including the authentic translation start site. If the extended cDNA encodes a secreted protein, it may contain the signal sequence, and the sequence encoding the mature protein remaining after cleavage of the signal peptide. Extended cDNAs which include the entire coding sequence of the protein encoded by the corresponding mRNA are referred to herein as "full-length cDNAs." Alternatively, the extended cDNAs may not include the entire coding sequence of the protein encoded by the corresponding mRNA, although they do include sequences adjacent to the 5' ESTs or contigated consensus 5' ESTs. In some embodiments in which the extended cDNAs are derived from an mRNA encoding a secreted protein, the extended cDNAs may include only the sequence encoding the mature protein remaining after cleavage of the signal peptide, or only the sequence encoding the signal peptide.

Example 17 below describes a general method for obtaining extended cDNAs using 5' ESTs or consensus contigated 5' ESTs. Example 28 below describes the cloning and sequencing of several extended cDNAs, including extended cDNAs which include the entire coding sequence and authentic 5' end of the corresponding mRNA for several secreted proteins.

The methods of Examples 17 and 18 can also be used to obtain extended cDNAs which encode less than the entire coding sequence of proteins encoded by the genes corresponding to the 5' ESTs or consensus contigated ESTs. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs: 24–4100 and 8178–36681. In some embodiments, the extended cDNAs isolated using these methods encode at least 5, 10, 15, 20, 25, 30, 35, 40, 50, 75, 100, or 150 consecutive amino acids of one of the proteins encoded by the sequences of SEQ ID NOs: 24–4100.

EXAMPLE 17

General Method for Using 5' ESTs to Clone and Sequence Extended cDNAs Which Include the Entire Coding Region and the Authentic 5' End of the Corresponding mRNA The following general method has been used to quickly and efficiently isolate extended cDNAs including sequence adjacent to the sequences of the 5' ESTs used to obtain them. This method may be applied to obtain extended cDNAs for any 5' EST or consensus contigated 5' EST of the invention, including those 5' ESTs and consensus contigated 5' ESTs encoding secreted proteins. This method is summarized in FIG. 3.

1. Obtaining Extended cDNAs a) First Strand Synthesis

The method takes advantage of the known 5' sequence of the mRNA. A reverse transcription reaction is conducted on purified mRNA with a poly dT primer containing a nucleotide sequence at its 5' end allowing the addition of a known sequence at the end of the cDNA which corresponds to the 3' end of the mRNA. Such a primer and a commercially-available reverse transcriptase enzyme are added to a buffered mRNA sample yielding a reverse transcript anchored at the 3' polyA site of the RNAs. Nucleotide monomers are then added to complete the first strand synthesis.

After removal of the mRNA hybridized to the first cDNA strand by alkaline hydrolysis, the products of the alkaline hydrolysis and the residual poly dT primer can be eliminated with an exclusion column.

b) Second Strand Synthesis

A pair of nested primers on each end is designed based on the known 5' sequence from the 5' EST or contigated consensus 5' EST and the known 3' end added by the poly dT primer used in the first strand synthesis. Software used to design primers are either based on GC content and melting temperatures of oligonucleotides, such as OSP (Illier and Green, *PCR Meth. Appl.* 1:124–128, 1991), or based on the octamer frequency disparity method (Griffais et al., *Nucleic Acids Res.* 19: 3887–3891, 1991 such as PC-Rare (http://bioinfomatics.weizmann.ac.il/software/PC-Rare/doc/manuel.html).

Preferably, the nested primers at the 5' end and the nested primers at the 3' end are separated from one another by four to nine bases. These primer sequences may be selected to have melting temperatures and specificities suitable for use in PCR.

A first PCR run is performed using the outer primer from each of the nested pairs. A second PCR run is performed using the same enzyme and the inner primer from each of the nested pairs is then performed on a small sample of the first PCR product. Thereafter, the primers and remaining nucleotide monomers are removed.

2. Sequencing of Full Length Extended cDNAs or Fragments Thereof

Due to the lack of position constraints on the design of 5' nested primers compatible for PCR use using the OSP software, amplicons of two types are obtained. Preferably, the second 5' primer is located upstream of the translation initiation codon thus yielding a nested PCR product containing the entire coding sequence. Such a full length extended cDNA may be used in a direct cloning procedure. However, in some cases, the second 5' primer is located downstream of the translation initiation codon, thereby yielding a PCR product containing only part of the ORF. Such incomplete PCR products are submitted to a modified procedure described in section b below.

a) Nested PCR Products Containing Complete ORFs

When the resulting nested PCR product contains the complete coding sequence, as predicted from the 5' EST or consensus contigated 5' EST sequence, it is cloned in an appropriate vector.

b) Nested PCR Products Containing Incomplete ORFs

When the amplicon does not contain the complete coding sequence, intermediate steps are necessary to obtain both the complete coding sequence and a PCR product containing the full coding sequence. The complete coding sequence can be assembled from several partial sequences determined directly from different PCR products.

Figure 3:
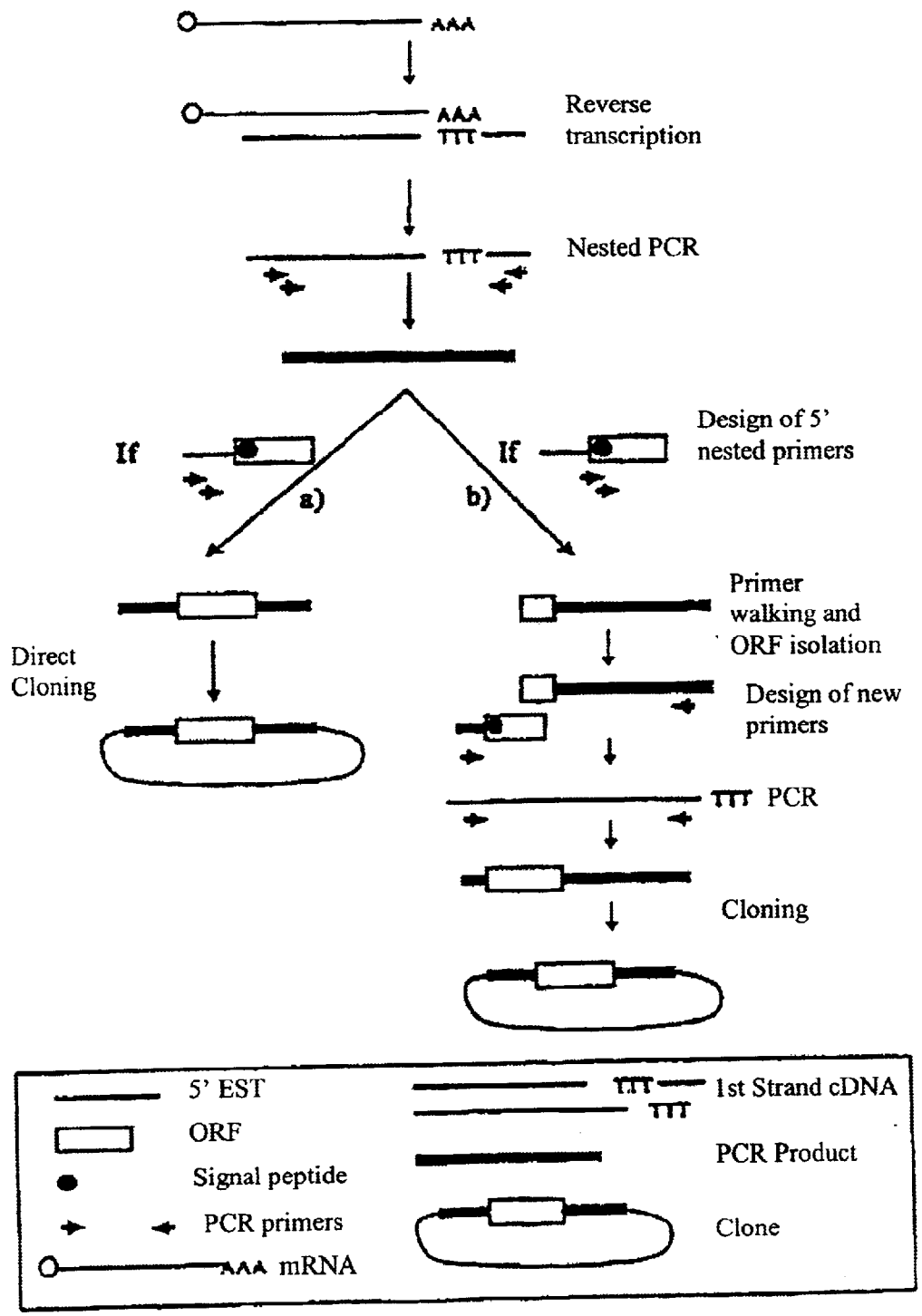
FIG. 3 illustrates methods for making extended cDNAs.

Once the full coding sequence has been completely determined, new primers compatible for PCR use are then designed to obtain amplicons containing the whole coding region. However, in such cases, 3' primers compatible for PCR use are located inside the 3' UTR of the corresponding mRNA, thus yielding amplicons which lack part of this region, i.e. the polyA tract and sometimes the polyadenylation signal, as illustrated in FIG. 3. Such full length extended cDNAs are then cloned into an appropriate vector.

c) Sequencing Extended cDNAs

Sequencing of extended cDNAs can be performed using a Die Terminator approach with the AmpliTaq DNA polymerase FS kit available from Perkin Elmer.

In order to sequence PCR fragments, primer walking is performed using software such as OSP to choose primers and automated computer software such as ASMG (Sutton et al., *Genome Science Technol.* 1: 9–19, 1995) to construct contigs of walking sequences including the initial 5' tag using minimum overlaps of 32 nucleotides. Preferably, primer walking is performed until the sequences of full length cDNAs are obtained.

3. Cloning of Full Length Extended cDNAs

The PCR product containing the full coding sequence is then cloned in an appropriate vector. For example, the extended cDNAs can be cloned into any expression vector known in the art.

Since the PCR products obtained as described above are blunt ended molecules that can be cloned in either direction, the orientation of several clones for each PCR product is determined. Then, 4 to 10 clones are ordered in microtiter plates and subjected to a PCR reaction using a first primer located in the vector close to the cloning site and a second primer located in the portion of the extended cDNA corresponding to the 3' end of the mRNA. This second primer may be the antisense primer used in anchored PCR in the case of direct cloning (case a) or the antisense primer located inside the 3' UTR in the case of indirect cloning (case b). Clones in which the start codon of the extended cDNA is operably linked to the promoter in the vector so as to permit expression of the protein encoded by the extended cDNA are conserved and sequenced. In addition to the ends of cDNA inserts, approximately 50 bp of vector DNA on each side of the cDNA insert are also sequenced.

Cloned PCR products are then entirely sequenced in order to obtain at least two sequences per clone. Preferably, the sequences are obtained from both sense and antisense strands according to the aforementioned procedure with the following modifications. First, both 5' and 3' ends of cloned PCR products are sequenced in order to confirm the identity of the clone. Second, primer walking is performed if the fall coding region has not been obtained yet. Contigation is then performed using primer walking sequences for cloned products as well as walking sequences that have already contigated for uncloned PCR products. The sequence is considered complete when the resulting contigs include the whole coding region as well as overlapping sequences with vector DNA on both ends. All the contigated sequences for each cloned amplicon are then used to obtain a consensus sequence.

4. Selection of Cloned Full Length Sequences Obtained From the 5' ESTs of the Present Invention A negative selection may be performed in order to eliminate unwanted cloned sequences resulting from either contaminants or PCR artifacts as follows. Sequences matching contaminant sequences such as vector DNA, tRNA, mtRNA, rRNA sequences are discarded as well as those encoding ORF sequences exhibiting extensive homology to repeats. Sequences obtained by direct cloning using nested primers on 5' and 3' tags (section 1, case a) but lacking polyA tail may be discarded. Only ORFs containing a signal peptide and ending either before the polyA tail (case a) or before the end of the cloned 3' UTR (case b) may be selected. Then, ORFs containing unlikely mature proteins such as mature proteins which size is less than 20 amino acids or less than 25% of the immature protein size may be eliminated.

Then, for each remaining full length extended cDNA containing several ORFs, a preselection of ORFs may be performed using the following criteria. The longest ORF with a signal peptide is preferred. If the ORF sizes are similar, the chosen ORF is the one which signal peptide has the highest score according to Von Heijne method Sequences of full length extended cDNA clones may then be compared pairwise with BLAST after masking of the repeat sequences. Sequences containing at least 90% homology over 30 nucleotides may be clustered in the same class. Each cluster may then be subjected to a cluster analysis that detects sequences resulting from internal priming or from alternative splicing, identical sequences or sequences with several frameshifts. This automatic analysis serves as a basis for manual selection of the sequences.

Manual selection can be carried out using automatically generated reports for each sequenced full length extended cDNA clone. During this manual procedure, a selection is operated between clones belonging to the same class as follows.

Selection of full length extended cDNA clones encoding sequences of interest is performed using the following criteria Structural parameters (initial tag, polyadenylation site and signal) may be checked. Then, homologies with known nucleic acids and proteins may be examined in order to determine whether the clone sequence match a known nucleic acid/protein sequence and, in the latter case, its covering rate and the date at which the sequence became public. Sequences resulting from chimera or double inserts or located on chromosome breaking points as assessed by homology to other sequences may be discarded during this procedure as well.

Extended cDNAs prepared as described above may be subsequently engineered to obtain nucleic acids which include desired portions of the extended cDNA using conventional techniques such as subcloning, PCR, or in vitro oligonucleotide synthesis. For example, if the extended cDNA is derived from a gene encoding a secreted polypeptide, it may include the full coding sequences (i.e. the sequences encoding the signal peptide and the mature protein remaining after the signal peptide is cleaved off), the sequences encoding the mature polypeptide (i.e. the polypeptide generated after the signal peptide is cleaved off), or only the coding sequences for the signal peptides.

Similarly, nucleic acids containing any other desired portion of the coding sequences for the encoded protein may be obtained. For example, the nucleic acid may contain at least 10, 12, 15, 18, 20, 23, 25, 28, 30, 35, 40, 50, 75, 100, 200, 300, 500, or 1000 consecutive bases of an extended cDNA.

Once an extended cDNA has been obtained, it can be sequenced to determine the amino acid sequence it encodes. Once the encoded amino acid sequence has been determined, one can create and identify any of the many conceivable cDNAs that will encode that protein by simply using the degeneracy of the genetic code. For example, allelic variants or other homologous nucleic acids can be identified as described below. Alternatively, nucleic acids encoding the desired amino acid sequence can be synthesized in vitro.

In a preferred embodiment, the coding sequence may be selected using the known codon or codon pair preferences for the host organism in which the cDNA is to be expressed.

In addition to PCR based methods for obtaining cDNAs which include the authentic 5' end of the corresponding mRNA as well as the full protein coding sequence of the corresponding mRNA, traditional hybridization based methods may also be employed. These methods may also be used to obtain the genomic DNAs which encode the mRNAs from which the 5' ESTs or contigated consensus 5' ESTs were derived, mRNAs corresponding to the extended cDNAs, or nucleic acids which are homologous to extended cDNAs, 5' ESTs, or contigated consensus 5' ESTs. Example 18 below provides examples of such methods.

Each identified ORF may be scanned for the presence of a signal peptide in the first 50 amino-acids or, where appropriate, within shorter regions down to 20 amino acids or less in the ORF, using the matrix method of von Heijne (*Nuc. Acids Res.* 14: 4683–4690 (1986)) and the modification described in Example 12.

d) Homology to Either Nucleotide or Protein Sequences

Sequences of full-length extended cDNAs are then compared to known nucleotide sequences. Polypeptides encoded by full-length extended cDNAs are then compared to known polypeptide sequences.

Sequences of full-length extended cDNAs are compared to known nucleic acid sequences such as the vertebrate and EST sequences of Genbank, EMBL databases and Genseq (Derwent's database of patented nucleotide sequences). Full-length cDNA sequences are also compared to the sequences of a private database (Genset internal sequences) in order to find sequences that have already been identified by applicants. Sequences of full-length extended cDNAs with more than 90% homology over 30 nucleotides using either BLASTN or BLAST2N are identified as sequences that have already been described. Matching vertebrate sequences are subsequently examined using FASTA; full-length extended cDNAs with more than 70% homology over 30 nucleotides are identified as sequences that have already been described.

ORFs encoded by full-length extended cDNAs as defined in section c) are subsequently compared to known amino acid sequences found in public databases such as Swissprot, PIR and Genptept (Derwent's database of patented protein sequences). These analyses were performed using BLASTP with the parameter W=8 and allowing a maximum of 10 matches. Sequences of full-length extended cDNAs showing extensive homology to known protein sequences are recognized as already identified proteins.

In addition, the three-frame conceptual translation products of the top strand of full-length extended cDNAs are compared to publicly known amino acid sequences of Swissprot using BLASTX with the parameter E=0.001. Sequences of full-length extended cDNAs with more than 70% homology over 30 amino acid stretches are detected as already identified proteins.

5. Selection of Cloned Full-length Sequences Obtained From the 5' ESTs of the Present Invention Cloned full-length extended cDNA sequences that have already been characterized by the aforementioned computer analysis are then submitted to an automatic procedure in order to preselect full-length extended cDNAs containing sequences of interest.

a) Automatic Sequence Preselection

All complete cloned full-length extended cDNAs clipped for vector on both ends are considered. First, a negative selection is operated in order to eliminate unwanted cloned sequences resulting from either contaminants or PCR artifacts as follows. Sequences matching contaminant sequences such as vector DNA, tRNA, mtRNA, rRNA sequences are discarded as well as those encoding ORF sequences exhibiting extensive homology to repeats as defined in section 4a). Sequences obtained by direct cloning using nested primers on 5' and 3' tags (section 1, case a) but lacking polyA tail are discarded. Only ORFs containing a signal peptide and ending either before the polyA tail (case a) or before the end of the cloned 3' UTR (case b) are kept. Then, ORFs containing unlikely mature proteins such as mature proteins which size is less than 20 amino acids or less than 25% of the immature protein size are eliminated.

Then, for each remaining full-length extended cDNA containing several ORFs, a preselection of ORFs is performed using the following criteria The longest ORF with a signal peptide is preferred. If the ORF sizes are similar, the chosen ORF is the one which signal peptide has the highest score according to Von Heijne method Sequences of full-length extended cDNA clones are then compared pairwise with BLAST after masking of the repeat sequences. Sequences containing at least 90% homology over 30 nucleotides are clustered in the same class. Each cluster is then subjected to a cluster analysis that detects sequences resulting from internal priming or from alternative splicing, identical sequences or sequences with several frameshifts. This automatic analysis serves as a basis for manual selection of the sequences.

b) Manual Sequence Selection

Manual selection can be carried out using automatically generated reports for each sequenced full-length extended cDNA clone. During this manual procedure, a selection is operated between clones belonging to the same class as follows. ORF sequences encoded by clones belonging to the same class are aligned and compared. If the homology between nucleotide sequences of clones belonging to the same class is more than 90% over 30 nucleotide stretches or if the homology between amino acid sequences of clones belonging to the same class is more than 80% over 20 amino acid stretches, than the clones are considered as being identical. The chosen ORF is either the one exhibiting matches with known amino acid sequences or the best one according to the criteria mentioned in the automatic sequence preselection section. If the nucleotide and amino acid homologies are less than 90% and 80% respectively, the clones are said to encode distinct proteins which can be both selected if they contain sequences of interest.

Selection of full-length extended cDNA clones encoding sequences of interest is performed using the following criteria. Structural parameters (initial tag, polyadenylation site and signal) are first checked. Then, homologies with known nucleic acids and proteins are examined in order to determine whether the clone sequence match a known nucleotide/protein sequence and, in the latter case, its covering rate and the date at which the sequence became public. If there is no extensive match with sequences other than ESTs or genomic DNA, or if the clone sequence brings substantial new information, such as encoding a protein resulting from alternative splicing of an mRNA coding for an already known protein, the sequence is kept. Examples of such cloned full-length extended cDNAs containing sequences of interest are described in Example 18. Sequences resulting from chimera or double inserts or located on chromosome breaking points as assessed by homology to other sequences are discarded during this procedure.

Extended cDNAs prepared as described above may be subsequently engineered to obtain nucleic acids which include desired portions of the extended cDNA using conventional techniques such as subcloning, PCR, or in vitro oligonucleotide synthesis. For example, nucleic acids which include only the full coding sequences (i.e. the sequences encoding the signal peptide and the mature protein remaining after the signal peptide is cleaved off) may be obtained using techniques known to those skilled in the art. Alternatively, conventional techniques may be applied to obtain nucleic acids which contain only the coding sequences for the mature protein remaining after the signal peptide is cleaved off or nucleic acids which contain only the coding sequences for the signal peptides.

Similarly, nucleic acids containing any other desired portion of the coding sequences for the encoded protein may be obtained. For example, the nucleic acid may contain at least 10, 15, 18, 20, 25, 28, 30, 35, 40, 50, 75, 100, 150, 200, 300, 400 or 500 consecutive bases of an extended cDNA.

Once an extended cDNA has been obtained, it can be sequenced to determine the amino acid sequence it encodes. Once the encoded amino acid sequence has been determined, one can create and identify any of the many conceivable cDNAs that will encode that protein by simply using the degeneracy of the genetic code. For example, allelic variants or other homologous nucleic acids can be identified as described below. Alternatively, nucleic acids encoding the desired amino acid sequence can be synthesized in vitro.

In a preferred embodiment, the coding sequence may be selected using the known codon or codon pair preferences for the host organism in which the cDNA is to be expressed.

In addition to PCR based methods for obtaining cDNAs which include the authentic 5' end of the corresponding mRNA as well as the complete protein coding sequence of the corresponding mRNA, traditional hybridization based methods may also be employed. These methods may also be used to obtain the genomic DNAs which encode the mRNAs from which the 5' ESTs or consensus contigated 5' ESTs were derived, mRNAs corresponding to the extended cDNAs, or nucleic acids which are homologous to extended cDNAs, 5' ESTs, or consensus contigated 5' ESTs. Example 18 below provides examples of such methods.

EXAMPLE 18

Methods for Obtaining Extended cDNAs Which Include the Entire Coding Region and the Authentic 5' End of the Corresponding mRNA or Nucleic Acids Homologous to Extended cDNAs, 5' ESTs or Consensus Contigated 5' ESTs A full-length cDNA library can be made using the strategies described in Examples 14 above by replacing the random nonamer used in Example 2 with an oligo-dT primer. Alternatively, a cDNA library or genomic DNA library may be obtained from a commercial source or made using techniques familiar to those skilled in the art.

Such cDNA or genomic DNA libraries may be used to isolate extended cDNAs obtained from 5' ESTs or consensus contigated 5' ESTs or nucleic acids homologous to extended cDNAs, 5' ESTs, or consensus contigated 5' ESTs as follows. The cDNA library or genomic DNA library is hybridized to a detectable probe. The detectable probe may comprise at least 10, 15, 18, 20, 25, 28, 30, 35, 40, 50, 75, 100, 150, 200, 300, 400 or 500 consecutive nucleotides of the 5' EST, consensus contigated 5' EST, or extended cDNA.

Techniques for identifying cDNA clones in a cDNA library which hybridize to a given probe sequence are disclosed in Sambrook et al., *Molecular Cloning: A Laboratory Manual 2d Ed.*, Cold Spring Harbor Laboratory Press, 1989, the disclosure of which is incorporated herein by reference. The same techniques may be used to isolate genomic DNAs.

Briefly, cDNA or genomic DNA clones which hybridize to the detectable probe are identified and isolated for further manipulation as follows. The detectable probe described in the preceding paragraph is labeled with a detectable label such as a radioisotope or a fluorescent molecule. Techniques for labeling the probe are well known and include phosphorylation with polynucleotide kinase, nick translation, in vitro transcription, and non radioactive techniques. The cDNAs or genomic DNAs in the library are transferred to a nitrocellulose or nylon filter and denatured. After blocking of non specific sites, the filter is incubated with the labeled probe for an amount of time sufficient to allow binding of the probe to cDNAs or genomic DNAs containing a sequence capable of hybridizing thereto.

By varying the stringency of the hybridization conditions used to identify cDNAs or genomic DNAs which hybridize to the detectable probe, cDNAs or genomic DNAs having different levels of homology to the probe can be identified and isolated as described below.

1. Identification of cDNA or Genomic DNA Sequences Having a High Degree of Homology to the Labeled Probe To identify cDNAs or genomic DNAs having a high degree of homology to the probe sequence, the melting temperature of the probe may be calculated using the following formulas:

For probes between 14 and 70 nucleotides in length the melting temperature (Tm) is calculated using the formula: Tm=81.5+16.6(log [Na+])+0.41(fraction G+C)−(600/N) where N is the length of the probe.

If the hybridization is carried out in a solution containing formamide, the melting temperature may be calculated using the equation Tm=81.5+16.6(log [Na+])+0.41(fraction G+C) 0.63% formamide)−(600/N) where N is the length of the probe.

Prehybridization may be carried out in 6×SSC, 5×Denhardt's reagent, 0.5% SDS, 100 µg denatured fragmented salmon sperm DNA or 6×SSC, 5×Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to extended cDNAs or genomic DNAs containing sequences complementary thereto or homologous thereto. For probes over 200 nucleotides in length, the hybridization may be carried out at 15–25° C. below the Tm. For shorter probes, such as oligonucleotide probes, the hybridization may be conducted at 15–25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

All of the foregoing hybridizations would be considered to be under "stringent" conditions.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

cDNAs or genomic DNAs which have hybridized to the probe are identified by autoradiography or other conventional techniques.

2. Obtaining cDNA or Genomic DNA Sequences Having Lower Dewees of Homology to the Labeled Probe The above procedure may be modified to identify cDNAs or genomic DNAs having decreasing levels of homology to the probe sequence. For example, to obtain cDNAs or genomic DNAs of decreasing homology to the detectable probe, less stringent conditions may be used. For example, the hybridization temperature may be decreased in increments of 5° C. from 68° C. to 42° C. in a hybridization buffer having a sodium concentration of approximately 1M. Following hybridization, the filter may be washed with 2×SSC, 0.5% SDS at the temperature of hybridization. These conditions are considered to be "moderate" conditions above 50° C. and "low" conditions below 50° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide.

cDNAs or genomic DNAs which have hybridized to the probe are identified by autoradiography.

3. Determination of the Degree of Homology Between the Obtained cDNAs or Genomic DNAs and 5′ ESTs, Consensus Contigated 5′ ESTs, or Extended cDNAs or Between the Polypeptides Encoded by the Obtained cDNAs or Genomic DNAs and the Polypeptides Encoded by the 5′ ESTs, Consensus Contigated 5′ ESTs, or Extended cDNAs To determine the level of homology between the hybridized cDNA or genomic DNA and the 5′ EST, consensus contigated 5′ EST or extended cDNA from which the probe was derived, the nucleotide sequences of the hybridized nucleic acid and the 5′ EST, consensus contigated 5′ EST or extended cDNA from which the probe was derived are compared. The sequences of the 5′ EST, consensus contigated 5′ EST or extended cDNA from which the probe was derived and the sequences of the cDNA or genomic DNA which hybridized to the detectable probe may be stored on a computer readable medium as described below and compared to one another using any of a variety of algorithms familiar to those skilled in the art, those described below.

To determine the level of homology between the polypeptide encoded by the hybridizing cDNA or genomic DNA and the polypeptide encoded by the 5′ EST, consensus contigated 5′ EST or extended cDNA from which the probe was derived, the polypeptide sequence encoded by the hybridized nucleic acid and the polypeptide sequence encoded by the 5′ EST, consensus contigated 5′ EST or extended cDNA from which the probe was derived are compared. The sequences of the polypeptide encoded by the 5′ EST, consensus contigated 5′ EST or extended cDNA from which the probe was derived and the polypeptide sequence encoded by the cDNA or genomic DNA which hybridized to the detectable probe may be stored on a computer readable medium as described below and compared to one another using any of a variety of algorithms familiar to those skilled in the art, those described below.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215(3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3):403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well known in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:49–61). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation).

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268).

The parameters used with the above algorithms may be adapted depending on the sequence length and degree of homology studied. In some embodiments, the parameters may be the default parameters used by the algorithms in the absence of instructions from the user.

In some embodiments, the level of homology between the hybridized nucleic acid and the extended cDNA, 5' EST, or 5' consensus contigated EST from which the probe was derived may be determined using the FASTDB algorithm described in Brutlag et al. Comp. App. Biosci. 6:237–245, 1990. In such analyses the parameters may be selected as follows: Matrix=Unitary, k-tuple=4, Mismatch Penalty=1, Joining Penalty=30, Randomization Group Length=0, Cutoff Score, Gap Penalty=5, Gap Size Penalty=0.05, Window Size=500 or the length of the sequence which hybridizes to the probe, whichever is shorter. Because the FASTDB program does not consider 5' or 3' truncations when calculating homology levels, if the sequence which hybridizes to the probe is truncated relative to the sequence of the extended cDNA, 5' EST, or consensus contigated 5' EST from which the probe was derived the homology level is manually adjusted by calculating the number of nucleotides of the extended cDNA, 5' EST, or consensus contigated 5' EST which are not matched or aligned with the hybridizing sequence, determining the percentage of total nucleotides of the hybridizing sequence which the non-matched or non-aligned nucleotides represent, and subtracting this percentage from the homology level. For example, if the hybridizing sequence is 700 nucleotides in length and the extended cDNA, 5' EST, or consensus contigated 5' EST sequence is 1000 nucleotides in length wherein the first 300 bases at the 5' end of the extended cDNA, 5' EST, or consensus contigated 5' EST are absent from the hybridizing sequence, and wherein the overlapping 700 nucleotides are identical, the homology level would be adjusted as follows. The non-matched, non-aligned 300 bases represent 30% of the length of the extended cDNA, 5' EST, or consensus contigated 5' EST. If the overlapping 700 nucleotides are 100% identical, the adjusted homology level would be 100−30=70% homology. It should be noted that the preceding adjustments are only made when the non-matched or non-aligned nucleotides are at the 5' or 3' ends. No adjustments are made if the non-matched or non-aligned sequences are internal or under any other conditions.

For example, using the above methods, nucleic acids having at least 95% nucleic acid homology, at least 96% nucleic acid homology, at least 97% nucleic acid homology, at least 98% nucleic acid homology, at least 99% nucleic acid homology, or more than 99% nucleic acid homology to the extended cDNA, 5' EST, or consensus contigated 5' EST from which the probe was derived may be obtained and identified. Such nucleic acids may be allelic variants or related nucleic acids from other species. Similarly, by using progressively less stringent hybridization conditions one can obtain and identify nucleic acids having at least 90%, at least 85%, at least 80% or at least 75% homology to the extended cDNA, 5' EST, or consensus contigated 5' EST from which the probe was derived.

Using the above methods and algorithms such as FASTA with parameters depending on the sequence length and degree of homology studied, for example the default parameters used by the algorithms in the absence of instructions from the user, one can obtain nucleic acids encoding proteins having at least 99%, at least 98%, at least 97%, at least 96%, at least 95%, at least 90%, at least 85%, at least 80% or at least 75% homology to the protein encoded by the extended cDNA, 5' EST, or consensus contigated 5' EST from which the probe was derived. In some embodiments, the homology levels can be determined using the "default" opening penalty and the "default" gap penalty, and a scoring matrix such as PAM 250 (a standard scoring matrix; see Dayhoff et al., in: Atlas of Protein Sequence and Structure, Vol. 5, Supp. 3 (1978)).

Alternatively, the level of polypeptide homology may be determined using the FASTDB algorithm described by Brutlag et al. Comp. App. Biosci. 6:237–245, 1990. In such analyses the parameters may be selected as follows: Matrix= PAM 0, k-tuple=2, Mismatch Penaltyl, Joining Penalty=20:, Randomization Group Length=0, Cutoff Score=1, Window Size=Sequence Length, Gap Penalty=5, Gap Size Penalty= 0.05, Window Size=500 or the length of the homologous sequence, whichever is shorter. If the homologous amino acid sequence is shorter than the amino acid sequence encoded by the extended cDNA, 5' EST, or consensus contigated 5' EST as a result of an N terminal and/or C terminal deletion the results may be manually corrected as follows. First, the number of amino acid residues of the amino acid sequence encoded by the extended cDNA, 5' EST, or consensus contigated 5' EST which are not matched or aligned with the homologous sequence is determined. Then, the percentage of the length of the sequence encoded by the extended cDNA, 5' EST, or consensus contigated 5' EST which the non-matched or non-aligned amino acids represent is calculated. This percentage is subtracted from the homology level. For example wherein the amino acid sequence encoded by the extended cDNA, 5' EST, or consensus contigated 5' EST is 100 amino acids in length and the length of the homologous sequence is 80 amino acids and wherein the amino acid sequence encoded by the extended cDNA or 5' EST is truncated at the N terminal end with respect to the homologous sequence, the homology level is calculated as follows. In the preceding scenario there are 20 non-matched, non-aligned amino acids in the sequence encoded by the extended cDNA, 5' EST, or consensus contigated 5' EST. This represents 20% of the length of the amino acid sequence encoded by the extended cDNA, 5' EST, or consensus contigated 5' EST. If the remaining amino acids are 1005 identical between the two sequences, the homology level would be 100%−20%=80% homology. No adjustments are made if the non-matched or non-aligned sequences are internal or under any other conditions.

In addition to the above described,methods, other protocols are available to obtain extended cDNAs using 5' ESTs or consensus contigated 5' ESTs as outlined in the following paragraphs.

Extended cDNAs may be prepared by obtaining mRNA from the tissue, cell, or organism of interest using mRNA preparation procedures utilizing polyA selection procedures or other techniques known to those skilled in the art. A first primer capable of hybridizing to the polyA tail of the mRNA is hybridized to the mRNA and a reverse transcription reaction is performed to generate a first cDNA strand.

The first cDNA strand is hybridized to a second primer containing at least 10 consecutive nucleotides of the sequences of SEQ ID NOs 24–4100 and 8178–36681. Preferably, the primer comprises at least 10, 12, 15, 17, 18, 20, 23, 25, or 28 consecutive nucleotides from the sequences of SEQ ID NOs 24–4100 and 8178–36681. In some embodiments, the primer comprises more than 30 nucleotides from the sequences of SEQ ID NOs 24–4100 and 8178–36681. If it is desired to obtain extended cDNAs containing the full protein coding sequence, including the authentic translation initiation site, the second primer used contains sequences located upstream of the translation initiation site. The second primer is extended to generate a second cDNA strand complementary to the first cDNA strand. Alternatively, RT-PCR may be performed as described above using primers from both ends of the cDNA to be obtained.

Extended cDNAs containing 5' fragments of the mRNA may be prepared by hybridizing an mRNA comprising the sequences of SEQ ID NOs: 24–4100 and 8178–36681 with a primer comprising a complementary to a fragment of an EST-related nucleic acid hybridizing the primer to the mRNAs, and reverse transcribing the hybridized primer to make a first cDNA strand from the mRNAs. Preferably, the primer comprises at least 10, 12, 15, 17, 18, 20, 23, 25, or 28 consecutive nucleotides of the sequences complementary to SEQ ID NOs 24–4100 and 8178–36681.

Thereafter, a second cDNA strand complementary to the first cDNA strand is synthesized. The second cDNA strand may be made by hybridizing a primer complementary to sequences in the first cDNA strand to the first cDNA strand and extending the primer to generate the second cDNA strand.

The double stranded extended cDNAs made using the methods described above are isolated and cloned. The extended cDNAs may be cloned into vectors such as plasmids or viral vectors capable of replicating in an appropriate host cell. For example, the host cell may be a bacterial, mammalian, avian, or insect cell.

Techniques for isolating mRNA, reverse transcribing a primer hybridized to mRNA to generate a first cDNA strand, extending a primer to make a second cDNA strand complementary to the first cDNA strand, isolating the double stranded cDNA and cloning the double stranded cDNA are well known to those skilled in the art and are described in *Current Protocols in Molecular Biology*, John Wiley & Sons, Inc. 1997 and Sambrook et al., Molecular Cloning: A Laboratory Manual, Second Edition, Cold Spring Harbor Laboratory Press, 1989, the entire disclosures of which are incorporated herein by reference.

Alternatively, other procedures may be used for obtaining full-length cDNAs or extended cDNAs. In one approach, full-length or extended cDNAs are prepared from mRNA and cloned into double stranded phagemids as follows. The cDNA library in the double stranded phagemids is then rendered single stranded by treatment with an endonuclease, such as the Gene II product of the phage F1 and an exonuclease (Chang et al., *Gene* 127:95–8, 1993). A biotinylated oligonucleotide comprising the sequence of a fragment of an EST-related nucleic acid is hybridized to the single stranded phagemids. Preferably, the fragment comprises at least 10, 12, 15, 17, 18, 20, 23, 25, or 28 consecutive nucleotides of the sequences of SEQ ID NOs: 24–4100 and 8178–36681.

Hybrids between the biotinylated oligonucleotide and phagemids are isolated by incubating the hybrids with streptavidin coated paramagnetic beads and retrieving the beads with a magnet (Fry et al., *Biotechniques*, 13: 124–131, 1992). Thereafter, the resulting phagemids are released from the beads and converted into double stranded DNA using a primer specific for the 5' EST or consensus contigated 5' EST sequence used to design the biotinylated oligonucleotide. Alternatively, protocols such as the Gene Trapper kit (Gibco BRL) may be used. The resulting double stranded DNA is transformed into bacteria. Extended cDNAs or full length cDNAs containing the 5' EST or consensus contigated 5' EST sequence are identified by colony PCR or colony hybridization.

Using any of the above described methods in section III, a plurality of extended cDNAs containing full-length protein coding sequences or portions of the protein coding sequences may be provided as cDNA libraries for subsequent evaluation of the encoded proteins or use in diagnostic assays as described below.

EXAMPLE 19

Full Length cDNAs

The procedures described in Example 17 and 18 were used to obtain 376 extended cDNAs or full length cDNAs derived from 5' ESTs in a variety of tissues. The following list provides a few examples of thus obtained cDNAs.

Using this procedure, the full length cDNA of SEQ ID NO:1 (internal identification number 58-34-2-E7-FL2) was obtained. This cDNA encodes the signal peptide MWW-FQQGLSFLPSALVIWTSA (SEQ ID NO:2) having a von Heijne score of 5.5.

Using this approach, the full length cDNA of SEQ ID NO:3 (internal identification number 48-19-3-G1-FL1) was obtained. This cDNA encodes the signal peptide MKKV-LLLITAILAVAVG (SEQ ID NO: 4) having a von Heijne score of 8.2.

The full length cDNA of SEQ ID NO:5 (internal identification number 58-35-2-F10-FL2) was also obtained using this procedure. This cDNA encodes a signal peptide LWLL-FFLVTAIHA (SEQ ID NO:6) having a von Heijne score of 10.7.

Furthermore, the polypeptides encoded by the extended or full-length cDNAs may be screened for the presence of known structural or functional motifs or for the presence of signatures, small amino acid sequences which are well conserved amongst the members of a protein family. The results obtained for the polypeptides encoded by a few full-length cDNAs derived from 5' ESTs that were screened for the presence of known protein signatures and motifs using the Proscan software from the GCG package and the Prosite 15.0 database are provided below.

The protein of SEQ ID NO: 8 encoded by the full-length cDNA SEQ ID NO: 7 (internal designation 78-8-3-E6-CL1_1C) and expressed in adult prostate belong to the phosphatidylethanolamine-binding protein from which it exhibits the characteristic PROSITE signature from positions 90 to 112. Proteins from this widespread family, from nematodes to fly, yeast, rodent and primate species, bind hydrophobic ligands such as phospholipids and nucleotides. They are mostly expressed in brain and in testis and are thought to play a role in cell growth and/or maturation, in regulation of the sperm maturation, motility and in membrane remodeling. They may act either through signal transduction or through oxidoreduction reactions (for a review see Schoentgen and Jollès, FEBS Letters, 369 :22–26 (1995)). Taken together, these data suggest that the protein of SEQ ID NO: 8 may play a role in cell growth, maturation and in membrane remodeling and/or may be related to male fertility. Thus, these protein may be useful in diagnosing and/or treating cancer, neurodegenerative diseases, and/or disorders related to male fertility and sterility.

The protein of SEQ ID NO:10 encoded by the full-length cDNA SEQ ID NO:9 (internal designation 108-013-5-O-H9-FLC) shows homologies with a family of lysophospholipases conserved among eukaryotes (yeast, rabbit, rodents and human). In addition, some members of this family exhibit a calcium-independent phospholipase A2 activity (Portilla et al, J. Am. Soc. Nephro., 9:1178–1186 (1998)). All members of this family exhibit the active site consensus GXSXG motif of carboxylesterases that is also found in the protein of SEQ ID NO:10 (position 54 to 58). In addition, this protein may be a membrane protein with one transmembrane domain as predicted by the software TopPred H (Claros and von Heijne, CABIOS applic. Notes, 10:685–686 (1994)). Taken together, these data suggest that the protein of SEQ ID NO:10 may play a role in fatty acid metabolism, probably as a phospholipase. Thus, this protein or part therein, may be useful in diagnosing and/or treating several disorders including, but not limited to, cancer, diabetes, and neurodegenerative disorders such as Parkinson's and Alzheimer's diseases. It may also be useful in modulating inflammatory responses to infectious agents and/or to suppress graft rejection.

The protein of SEQ ID NO: 12 encoded by the full-length cDNA SEQ ID NO: 11 (internal designation 108-004-5-0D10-FLC) shows remote homology to a subfamily of beta4-galactosyltransferases widely conserved in animals (human, rodents, cow and chicken). Such enzymes, usually type II membrane proteins located in the endoplasmic reticulum or in the Golgi apparatus, catalyzes the biosynthesis of glycoproteins, glycolipid glycans and lactose. Their characteristic features defined as those of subfamily A in Breton et al, J. Biochem., 123:1000–1009 (1998) are pretty well conserved in the protein of SEQ ID NO: 12, especially the region I containing the DVD motif (positions 163–165) thought to be involved either in UDP binding or in the catalytic process itself. In addition, the protein of SEQ ID NO: 12 has the typical structure of a type II protein. Indeed, it contains a short 28-amino-acid-long N-terminal tail, a transmembrane segment from positions 29 to 49 and a large 278-amino-acid-long C-terminal tail as predicted by the software TopPred II (Claros and von Heijne, CABIOS applic. Notes, 10:685–686 (1994)). Taken together, these data suggest that the protein of SEQ ID NO: 12 may play a role in the biosynthesis of polysaccharides, and of the carbohydrate moieties of glycoproteins and glycolipids and/or in cell-cell recognition. Thus, this protein may be useful in diagnosing and/or treating several types of disorders including, but not limited to, cancer, atherosclerosis, cardiovascular disorders, autoimmune disorders and rheumatic diseases including rheumatoid arthritis.

The protein of SEQ ID NO: 14 encoded by the full-length cDNA SEQ ID NO: 13 (internal designation 108-009-5-0-A2-FLC) shows extensive homology to the bZIP family of transcription factors, and especially to the human luman protein (Lu et al., Mol. Cell. Biol., 17:5117–5126 (1997))). The match include the whole bZIP domain composed of a basic DNA-binding domain and of a leucine zipper allowing protein dimerization. The basic domain is conserved in the protein of SEQ ID NO: 14 as shown by the characteristic PROSITE signature (positions 224–237) except for a conservative substitution of a glutamic acid with an aspartic acid in position 233. The typical PROSITE signature for leucine zipper is also present (positions 259 to 280). Taken together, these data suggest that the protein of SEQ ID NO: 14 may bind to DNA, hence regulating gene expression as a transcription factor. Thus, this protein may be useful in diagnosing and/or treating several types of disorders including, but not limited to, cancer.

Bacterial clones containing plasmids containing the full length cDNAs described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the EST insertion. The PCR product which corresponds to the 5' EST can then be manipulated using standard cloning techniques familiar to those skilled in the art.

IV. Expression of Proteins

EST-related nucleic acids, fragments of EST-related nucleic acids, positional segments of EST-related nucleic acids, and fragments of positional segments of EST-related nucleic acids may be used to express the polypeptides which they encode. In particular, they may be used to express EST-related polypeptides, fragments of EST-related polypeptides, positional segments of EST-related polypeptides, or fragments of positional segments of EST-related polypeptides. In some embodiments, the EST-related nucleic acids, positional segments of EST-related nucleic acids, and fragments of positional segments of EST-related nucleic acids may be used to express the full polypeptide (i.e. the signal peptide and the mature polypeptide) of a secreted protein, the mature protein (i.e. the polypeptide generated after cleavage of the signal peptide), or the signal peptide of a secreted protein. If desired, nucleic acids encoding the signal peptide may be used to facilitate secretion of the expressed protein. It will be appreciated that a plurality of EST-related nucleic acids, fragments of EST-related nucleic acids, positional segments of EST-related nucleic acids, or fragments of positional segments of EST-related nucleic acids may be simultaneously cloned into expression vectors to create an expression library for analysis of the encoded proteins as described below.

EXAMPLE 20

Expression of the Proteins Encoded by the Genes Corresponding to the 5' ESTs or Consensus Contigated 5' ESTs To express their encoded proteins the EST-related nucleic acids, fragments of EST-related nucleic acids, positional segments of EST-related nucleic acids, or fragments of positional segments of EST-related nucleic acids are cloned into a suitable expression vector. In some instances, nucleic acids encoding EST-related polypeptides, fragments of EST-related polypeptides, positional segments of EST-related polypeptides or fragments of positional segments of EST-related polypeptides may be cloned into a suitable expression vector.

In some embodiments, the nucleic acids inserted into the expression vector may comprise the coding sequence of a sequence selected from the group consisting of 24–4100. In other embodiments, the nucleic acids inserted into the expression vector may comprise may comprise the full coding sequence (i.e. the nucleotides encoding the signal peptide and the mature polypeptide) of one of SEQ ID NOs: 3721–3811. In some embodiments, the nucleic acid inserted into the expression vector may comprise the nucleotides of one of the sequences of SEQ ID NOs: 3721–3811 which encode the mature polypeptide (i.e. the nucleotides encoding the polypeptide generated after cleavage of the signal peptide). In further embodiments, the nucleic acids inserted into the expression vector may comprise the nucleotides of 24–652 and 3721–3811 which encode the signal peptide to facilitate secretion of the expressed protein. The nucleic acids inserted into the expression vectors may also contain sequences upstream of the sequences encoding the signal peptide, such as sequences which regulate expression levels or sequences which confer tissue specific expression.

The nucleic acid inserted into the,expression vector may encode a polypeptide comprising the one of the sequences of SEQ ID NOs: 4101–8177. In some embodiments, the nucleic acid inserted into the expression vector may encode the full polypeptide sequence (i.e. the signal peptide and the mature polypeptide) included in one of SEQ ID NOs: 7798–7888. In other embodiments, the nucleic acid inserted into the expression vector may encode the mature polypeptide. (i.e. the polypeptide generated after cleavage of the signal peptide) included in one of the sequences of SEQ ID NOs: 798–7888. In further embodiments, the nucleic acids inserted into the expression vector may encode the signal peptide included in one of the sequences of 4101–4729 and 7798–7888.

The nucleic acid encoding the protein or polypeptide to be expressed is operably linked to a promoter in an expression vector using conventional cloning technology. The expression vector may be any of the mammalian, yeast, insect or bacterial expression systems known in the art. Commercially available vectors and expression systems are available from a variety of suppliers including Genetics Institute (Cambridge, Ma.), Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism in which the expression vector is introduced, as explained by Hatfield, et al., U.S. Pat. No. 5,082,767, incorporated herein by this reference.

The following is provided as one exemplary method to express the proteins encoded by the nucleic acids described above. In some instances the nucleic acid encoding the protein or polypeptide to be expressed includes a methionine initiation codon and a polyA signal. If the nucleic acid encoding the polypeptide to be expressed lacks a methionine to serve as the initiation site, an initiating methionine can be introduced next to the first codon of the nucleic acid using conventional techniques. Similarly, if the nucleic acid encoding the protein or polypeptide to be expressed lacks a polyA signal, this sequence can be added to the construct by, for example, splicing out the polyA signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex thymidine kinase promoter and the selectable neomycin gene. The nucleic acid encoding the polypeptide to be expressed is obtained by PCR from the bacterial vector using oligonucleotide primers complementary to the nucleic acid encoding the protein or polypeptide to be expressed and containing restriction endonuclease sequences for PstI incorporated into the 5' primer and BglII at the 5' end of 3' primer, taking care to ensure that the nucleic acid encoding the protein or polypeptide to be expressed is correctly positioned with respect to the poly A signal. The purified fragment obtained from the resulting PCR reaction is digested with PstI, blunt ended with an exonuclease, digested with BglII, purified and ligated to pXT1, now containing a poly A signal and digested with BglII.

The ligated product is transfected into mouse NIH3T3 cells using Lipofectin (Life Technologies, Inc., Grand Island, N.Y.) under conditions outlined in the product specification. Positive transfectants are selected after growing the transfected cells in 600 µg/ml G418 (Sigma, St. Louis, Mo.).

Alternatively, the nucleic acid encoding the protein or polypeptide to be expressed may be cloned into pED6dpc2 as described above. The resulting pED6dpc2 constructs may be transfected into a suitable host cell, such as COS 1 cells. Methotrexate resistant cells are selected and expanded. The expressed protein or polypeptide may be isolated, purified, or enriched as described above.

To confirm expression of the desired protein or polypeptide, the proteins or polypeptides produced by cells containing a vector with a nucleic acid insert encoding the protein or polypeptide are compared to those lacking such an insert. The expressed proteins are detected using techniques familiar to those skilled in the art such as Coomassie blue or silver staining or using antibodies against the protein or polypeptide encoded by the nucleic acid insert. Antibodies capable of specifically recognizing the protein of interest may be generated using synthetic 15-mer peptides having a sequence encoded by the appropriate nucleic acid. The synthetic peptides are injected into mice to generate antibody to the polypeptide encoded by the nucleic acid.

If the proteins or polypeptides encoded by the nucleic acid inserts are secreted, medium prepared from the host cells or organisms containing an expression vector which contains a nucleic acid insert encoding the desired protein or polypeptide is compared to medium prepared from the control cells or organism. The presence of a band in medium from the cells containing the nucleic acid insert which is absent from preparations from the control cells indicates that the protein or polypeptide encoded by the nucleic acid insert is being expressed and secreted. Generally, the band corresponding to the protein encoded by the nucleic acid insert will have a mobility near that expected based on the number of amino acids in the open reading frame of the nucleic acid insert. However, the band may have a mobility different than that expected as a result of modifications such as glycosylation, ubiquitination, or enzymatic cleavage.

Alternatively, if the protein expressed from the above expression vectors does not contain sequences directing its secretion, the proteins expressed from host cells containing an expression vector with an insert encoding a secreted protein or portion thereof can be compared to the proteins expressed in control host cells containing the expression vector without an insert. The presence of a band in samples from cells containing the expression vector with an insert which is absent in samples from cells containing the expression vector without an insert indicates that the desired protein or portion thereof is being expressed. Generally, the band will have the mobility expected for the secreted protein or portion thereof However, the band may have a mobility different than that expected as a result of modifications such as glycosylation, ubiquitination, or enzymatic cleavage.

The expressed protein or polypeptide may be purified, isolated or enriched using a variety of methods. In some methods, the protein or polypeptide may be secreted into the culture medium via a native signal peptide or a heterologous signal peptide operably linked thereto. In some methods, the protein or polypeptide may be linked to a heterologous polypeptide which facilitates its isolation, purification, or enrichment such as a nickel binding polypeptide. The protein or polypeptide may also be obtained by gel electrophoresis, ion exchange chromatography, size chromatography, hplc, salt precipitation, immunoprecipitation, a combination of any of the preceding methods, or any of the isolation, purification, or enrichment techniques familiar to those skilled in the art.

The protein encoded by the nucleic acid insert may also be purified using standard immunochromatography techniques using immunoaffinity chromatography with antibodies directed against the encoded protein or polypeptide as described in more detail below. If antibody production is not possible, the nucleic acid insert encoding the desired protein or polypeptide may be incorporated into expression vectors designed for use in purification schemes employing chimeric polypeptides. In such strategies, the coding sequence of the nucleic acid insert is ligated in frame with the gene encoding the other half of the chimera The other half of the chimera may be β-globin or a nickel binding polypeptide. A chromatography matrix having antibody to β-globin or nickel attached thereto is then used to purify the chimeric protein. Protease cleavage sites may be engineered between the β-globin gene or the nickel binding polypeptide and the extended cDNA or portion thereof. Thus, the two polypeptides of the chimera may be separated from one another by protease digestion.

One useful expression vector for generating β-globin chimerics is pSG5 (Stratagene), which encodes rabbit β-globin. Intron 11 of the rabbit β-globin gene facilitates splicing of the expressed transcript, and the polyadenylation signal incorporated into the construct increases the level of expression. These techniques as described are well known to those skilled in the art of molecular biology. Standard methods are published in methods texts such as Davis et al., (*Basic Methods in Molecular Biology*, L. G. Davis, M. D. Dibner, and J. F. Battey, ed., Elsevier Press, NY, 1986) and many of the methods are available from Stratagene, Life Technologies, Inc., or Promega. Polypeptide may additionally be produced from the construct using in vitro translation systems such as the In vitro Express™ Translation Kit (Stratagene).

Following expression and purification of the proteins or polypeptides encoded by the nucleic acid inserts, the purified proteins may be tested for the ability to bind to the surface of various cell types as described in Example 21 below. It will be appreciated that a plurality of proteins expressed from these nucleic acid inserts may be included in a panel of proteins to be simultaneously evaluated for the activities specifically described below, as well as other biological roles for which assays for determining activity are available.

EXAMPLE 21

Analysis of Secreted Proteins to Determine Whether They Bind to the Cell Surface The EST-related nucleic acids, fragments of EST-related nucleic acids, positional segments of EST-related nucleic acids, fragments of positional segments of EST-related nucleic acids, nucleic acids encoding the EST-related polypeptides, nucleic acids encoding fragments of the EST-related polypeptides, nucleic acids encoding positional segments of EST-related polypeptides, or nucleic acids encoding fragments of positional segments of EST-related polypeptides are cloned into expression vectors such as those described in Example 20. The encoded proteins or polypeptides are purified, isolated, or enriched as described above. Following purification, isolation, or enrichment, the proteins or polypeptides are labeled using techniques known to those skilled in the art. The labeled proteins or polypeptides are incubated with cells or cell lines derived from a variety of organs or tissues to allow the proteins to bind to any receptor present on the cell surface. Following the incubation, the cells are washed to remove non-specifically bound proteins or polypeptides. The specifically bound labeled proteins or polypeptides are detected by autoradiography. Alternatively, unlabeled proteins or polypeptides may be incubated with the cells and detected with antibodies having a detectable label, such as a fluorescent molecule, attached thereto.

Specificity of cell surface binding may be analyzed by conducting a competition analysis in which various amounts of unlabeled protein or polypeptide are incubated along with the labeled protein or polypeptide. The amount of labeled protein or polypeptide bound to the cell surface decreases as the amount of competitive unlabeled protein or polypeptide increases. As a control, various amounts of an unlabeled protein or polypeptide unrelated to the labeled protein or polypeptide is included in some binding reactions. The amount of labeled protein or polypeptide bound to the cell surface does not decrease in binding reactions containing increasing amounts of unrelated unlabeled protein, indicating that the protein or polypeptide encoded by the nucleic acid binds specifically to the cell surface.

As discussed above, human proteins have been shown to have a number of important physiological effects and, consequently, represent a valuable therapeutic resource. The human proteins or polypeptides made as described above may be evaluated to determine their physiological activities as described below.

EXAMPLE 22

Assaying the Expressed Proteins or Polypeptides for Cytokine, Cell Proliferation or Cell Differentiation Activity As discussed above, some human proteins act as cytokines or may affect cellular proliferation or differentiation. Many protein factors discovered to date, including all known cytokines, have exhibited activity in one or more factor dependent cell proliferation assays, and hence the assays serve as a convenient confirmation of cytokine activity. The activity of a protein or polypeptide of the present invention is evidenced by any one of a number of routine factor dependent cell proliferation assays for cell lines including, without limitation, 32D, DA2, DAIG, T10, B9, B9/11, BaF3, MC9/G, M⁺ (preB M⁺), 2E8, RB5, DA1, 123, T1165, HT2, CTLL2, TF-1, Mo7c and CMK. The proteins or polypeptides prepared as described above may be evaluated for their ability to regulate T cell or thymocyte proliferation in assays such as those described above or in the following references, which are incorporated herein by reference: *Current Protocols in Immunology*, Ed. by J. E. Coligan et al., Greene Publishing Associates and Wiley-Interscience; Takai et al. *J. Immunol*. 137:3494–3500, 1986., Bertagnolli et al. *J. Immunol*. 145:1706–1712, 1990., Bertagnolli et al., *Cellular Immunology* 133:327–341, 1991. Bertagnolli, et al. *J. Immunol*. 149:3778–3783, 1992; Bowman et al., *J. Immunol*. 152:1756–1761, 1994.

In addition, numerous assays for cytokine production and/or the proliferation of spleen cells, lymph node cells and thymocytes are known. These include the techniques disclosed in *Current Protocols in Immunology*. J. E. Coligan et al. Eds., 1:3.12.1–3.12.14, John Wiley and Sons, Toronto. 1994; and Schreiber, R. D. In *Current Protocols in Immunology.*, supra 1: 6.8.1–6.8.8.

The proteins or polypeptides prepared as described above may also be assayed for the ability to regulate the proliferation and differentiation of hematopoietic or lymphopoietic cells. Many assays for such activity are familiar to those skilled in the art, including the assays in the following references, which are incorporated herein by reference: Bottomly et al., In *Current Protocols in Immunology.*, supra. 1: 6.3.1–6.3.12; deVries et al., *J. Exp. Med.* 173:1205–1211, 1991; Moreau et al., *Nature* 36:690–692, 1988; Greenberger et al., *Proc. Natl Acad. Sci. U.S.A.* 80:2931–2938, 1983; Nordan, R., In *Current Protocols in Immunology.*, supra. 1: 6.6.1–6.6.5; Smith et al., *Proc. Natl. Acad. Sci. U.S.A.* 83:1857–1861, 1986; Bennett et al in *Current Protocols in Immunology* supra 1: 6.15.1; Ciarletta et al In *Current Protocols in Immunology*, supra 1: 6.13.1.

The proteins or polypeptides prepared as described above may also be assayed for their ability to regulate T-cell responses to antigens. Many assays for such activity are familiar to those skilled in the art, including the assays described in the following references, which are incorporated herein by reference: Chapter 3 (In vitro Assays for Mouse Lymphocyte Function), Chapter 6 (Cytokines and Their Cellular Receptors) and Chapter 7, (Immunologic Studies in Humans) in *Current Protocols in Immunology* supra; Weinberger et al., *Proc. Natl. Acad. Sci. USA* 77:6091–6095, 1980; Weinberger et al., *Eur. J. Immun.* 11:405–411, 1981; Takai et al., *J. Immunol.* 137:3494–3500, 1986; Takai et al., *J. Immunol.* 140:508–512, 1988.

Those proteins or polypeptides which exhibit cytokine, cell proliferation, or cell differentiation activity may then be formulated as pharmaceuticals and used to treat clinical conditions in which induction of cell proliferation or differentiation is beneficial. Alternatively, as described in more detail below, nucleic acids encoding these proteins or polypeptides or nucleic acids regulating the expression of these proteins or polypeptides may be introduced into appropriate host cells to increase or decrease the expression of the proteins or polypeptides as desired.

EXAMPLE 23

Assaying the Expressed Proteins or Polypeptides for Activity as Immune System Regulators The proteins or polypeptides prepared as described above may also be evaluated for their effects as immune regulators. For example, the proteins or polypeptides may be evaluated for their activity to influence thymocyte or splenocyte cytotoxicity. Numerous assays for such activity are familiar to those skilled in the art including the assays described in the following references, which are incorporated herein by reference: Chapter 3 (In vitro Assays for Mouse Lymphocyte Function 3.1–3.19) and Chapter 7 (Immunologic studies in Humans) in *Current Protocols in Immunology*, J. E. Coligan et al. Eds, Greene Publishing Associates and Wiley-Interscience; Herrmann et al., *Proc. Natl. Acad. Sci. USA* 78:2488–2492, 1981; Herrmann et al., *J. Immunol.* 128:1968–1974,1982; Handa et al., *J. Immunol.* 135:1564–1572, 1985; Takai et al., *J. Immunol.* 137:3494–3500, 1986; Takai et al., *J. Immunol.* 140:508–512, 1988; Bowman et al., *J. Virology* 61:1992–1998; Bertagnolli et al. *Cell. Immunol.* 133:327–341, 1991; Brown et al., *J. Immunol.* 153:3079–3092, 1994.

The proteins or polypeptides prepared as described above may also be evaluated for their effects on T-cell dependent immunoglobulin responses and isotype switching. Numerous assays for such activity are familiar to those skilled in the art, including the assays disclosed in the following references, which are incorporated herein by reference: Maliszewski, *J. Immunol.* 144:3028–3033, 1990; Mond et al. in *Current Protocols in Immunology*, 1: 3.8.1–3.8.16, supra.

The proteins or polypeptides prepared as described above may also be evaluated for their effect on immune effector cells, including their effect on Th1 cells and cytotoxic lymphocytes. Numerous assays for such activity are familiar to those skilled in the art, including the assays disclosed in the following references, which are incorporated herein by reference: Chapter 3 (In vitro Assays for Mouse Lymphocyte Function 3.1–3.19) and Chapter 7 (Immunologic Studies in Humans) in *Current Protocols in Immunology*, supra; Takai et al., *J. Immunol.* 137:3494–3500, 1986; Takai et al.; *J. Immunol.* 140:508–512, 1988; Bertagnolli et al., *J. Immunol.* 149:3778–3783, 1992.

The proteins or polypeptides prepared as described above may also be evaluated for their effect on dendritic cell mediated activation of naive T-cells. Numerous assays for such activity are familiar to those skilled in the art, including the assays disclosed in the following references, which are incorporated herein by reference: Guery et al., *J. Immunol.* 134:536–544, 1995; Inaba et al., *J. Exp. Med.* 173:549–559, 1991; Macatonia et al., *J. Immunol.* 154:5071–5079,1995; Porgador et al *J. Exp. Med* 182:255–260, 1995; Nair et al., *J. Virol.* 67:4062–4069, 1993; Huang et al., *Science* 264:961–965, 1994; Macatonia et al *J. Exp. Med* 169:1255–1264, 1989; Bhardwaj et al., *Journal of Clinical Investigation* 94:797–807, 1994; and Inaba et al., *J. Exp. Med* 172:631–640, 1990.

The proteins or polypeptides prepared as described above may also be evaluated for their influence on the lifetime of lymphocytes. Numerous assays for such activity are familiar to those skilled in the art, including the assays disclosed in the following references, which are incorporated herein by reference: Darzynkiewicz et al., *Cytometry* 13:795–808, 1992; Gorczyca et al., *Leukemia* 7:659–670, 1993; Gorczyca et al., *Cancer Res.* 53:1945–1951, 1993; Itoh et al., *Cell* 66:233–243, 1991; Zacharchuk, *J. Immunol.* 145:4037–4045, 1990; Zamai et al., *Cytometry* 14:891–897, 1993; Gorczyca et al., *Int. J. Oncol.* 1:639–648, 1992.

The proteins or polypeptides prepared as described above may also be evaluated for their influence on early steps of T-cell commitment and development. Numerous assays for such activity are familiar to those skilled in the art, including without limitation the assays disclosed in the following references, which are incorporated herein by references: Antica et al., *Blood* 84:111–117, 1994; Fine et al., *Cell. Immunol.* 155:111–122, 1994; Galy et al., *Blood* 85:2770–2778, 1995; Toki et al., *Proc. Nat. Acad Sci. USA* 88:7548–7551, 1991.

Those proteins or polypeptides which exhibit activity as immune system regulators activity may then be formulated as pharmaceuticals and used to treat clinical conditions in which regulation of immune activity is beneficial. For example, the protein or polypeptide may be useful in the treatment of various immune deficiencies and disorders (including severe combined immunodeficiency), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fingal infections, or may result from autoimmune disorders. More specifically, infectious diseases caused by viral, bacterial, fungal or other infection may be treatable using the protein or polypeptide including infections by HIV, hepatitis viruses, herpesviruses, mycobacteria, Leishmania spp., plamodium, and various fungal infections such as candidiasis. Of course, in this regard, a protein or polypeptide may also be useful where a boost to the immune system generally may be desirable, i.e., in the treatment of cancer.

Alternatively, the proteins or polypeptides prepared as described above may be used in treatment of autoimmune disorders including, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitis, myasthenia gravis, graft-versus-host disease and autoimmune inflammatory eye disease. Such a protein or polypeptide may also to be useful in the treatment of allergic reactions and conditions, such as asthma (particularly allergic asthma) or other respiratory problems. Other conditions, in which immune suppression is desired (including, for example, organ transplantation), may also be treatable using the protein or polypeptide.

Using the proteins or polypeptides of the invention it may also be possible to regulate immune responses either up or down. Down regulation may involve inhibiting or blocking an immune response already in progress or may involve preventing the induction of an immune response. The functions of activated T-cells may be inhibited by suppressing T cell responses or by inducing specific tolerance in T cells, or both. Immunosuppression of T cell responses is generally an active non-antigen-specific process which requires continuous exposure of the T cells to the suppressive agent. Tolerance, which involves inducing non-responsiveness or energy in T cells, is distinguishable from immunosuppression in that it is generally antigen-specific and persists after the end of exposure to the tolerizing agent. Operationally, tolerance can be demonstrated by the lack of a T cell response upon reexposure to specific antigen in the absence of the tolerizing agent.

Down regulating or preventing one or more antigen functions (including without limitation B lymphocyte antigen functions, such as, for example, B7 costimulation), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a molecule which inhibits or blocks interaction of a B7 lymphocyte antigen with its natural ligand(s) on immune cells (such as a soluble, monomeric form of a peptide having B7-2 activity alone or in conjunction with a monomeric form of a peptide having an activity of another B lymphocyte antigen (e.g., B7-1, B7-3) or blocking antibody), prior to transplantation, can lead to the binding of the molecule to the natural ligand(s) on the immune cells without transmitting the corresponding costimulatory signal. Blocking B lymphocyte antigen function in this matter prevents cytokine synthesis by immune cells, such as T cells, and thus acts as an immunosuppressant. Moreover, the lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular blocking reagents in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA41g fusion proteins in vivo as described in Lenschow et al., *Science* 257:789–792 (1992) and Turka et al., *Proc. Natl. Acad. Sci USA*, 89:11102–11105 (1992). In addition, murine models of GVHD (see Paul ed., *Fundamental Immunology*, Raven Press, New York, 1989, pp. 846847) can be used to determine the effect of blocking B lymphocyte antigen function in vivo on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block costimulation of T cells by disrupting receptor/ligand interactions of B lymphocyte antigens can be used to inhibit T cell activation and prevent production of autoantibodies or T cell-derived cytokines which potentially involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/pr/pr mice or NZB hybrid mice, murine autoimmuno collagen arthritis, diabetes mellitus in OD mice and BB rats, and murine experimental myasthenia gravis (see Paul ed., Fundamental Immunology, Raven Press, New York, 1989, pp. 840–856).

Upregulation of an antigen function (preferably a B lymphocyte antigen function), as a means of up regulating immune responses, may also be useful in therapy. Upregulation of immune responses may involve either enhancing an existing immune response or eliciting an initial immune response as shown by the following examples. For instance, enhancing an immune response through stimulating B lymphocyte antigen function may be useful in cases of viral infection. In addition, systemic viral diseases such as influenza, the common cold, and encephalitis might be alleviated by the administration of stimulatory form of B lymphocyte antigens systemically.

Alternatively, antiviral immune responses may be enhanced in an infected patient by removing T cells from the patient, costimulating the T cells in vitro with viral antigen-pulsed APCs either expressing the proteins or polypeptides described above or together with a stimulatory form of the protein or polypeptide and reintroducing the in vitro primed T cells into the patient. The infected cells would now be capable of delivering a costimulatory signal to T cells in vivo, thereby activating the T cells.

In another application, upregulation or enhancement of antigen function (preferably B lymphocyte antigen function) may be useful in the induction of tumor immunity. Tumor cells (e.g., sarcoma, melanoma, lymphoma, leukemia, neuroblastoma, carcinoma) transfected with one of the above-described nucleic acids encoding a protein or polypeptide can be administered to a subject to overcome tumor-specific tolerance in the subject. If desired, the tumor cell can be transfected to express a combination of peptides.

For example, tumor cells obtained from a patient can be transfected ex vivo with an expression vector directing the expression of a peptide having B7-2-like activity alone, or in conjunction with a peptide having B7-1-like activity and/or B7-3-like activity. The transfected tumor cells are returned to the patient to result in expression of the peptides on the surface of the transfected cell. Alternatively, gene therapy techniques can be used to target a tumor cell for transfection in vivo.

The presence of the protein or polypeptide encoded by the nucleic acids described above having the activity of a B lymphocyte antigen(s) on the surface of the tumor cell provides the necessary costimulation signal to T cells to induce a T cell mediated immune response against the transfected tumor cells. In addition, tumor cells which lack or which fail to reexpress sufficient amounts of MHC class I or MHC class II molecules can be transfected with nucleic acids encoding all or a portion of (e.g., a cytoplasmic-domain truncated portion) of an MHC class I$\alpha$ chain and $\beta_2$ microglobulin or an MHC class II$\alpha$ chain and an MHC class II$\alpha$ chain to thereby express MHC class I or MHC class II proteins on the cell surface, respectively. Expression of the appropriate MHC class I or class II molecules in conjunction with a peptide having the activity of a B lymphocyte antigen (e.g., B7-1, B7-2, B7-3) induces a T cell mediated immune response against the transfected tumor cell. Optionally, a nucleic acid encoding an antisense construct which blocks expression of an MHC class II associated protein, such as the invariant chain, can also be cotransfected with a DNA encoding a protein or polypeptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject. Alternatively, as described in more detail below, nucleic acids encoding these immune system regulator proteins or polypeptides or nucleic acids regulating the expression of such proteins or polypeptides may be introduced into appropriate host cells to increase or decrease the expression of the proteins as desired.

EXAMPLE 24

Assaying the Expressed Proteins or Polypeptides for Hematogoiesis Regulating Activity The proteins or polypeptides encoded by the nucleic acids described above may also be evaluated for their hematopoiesis regulating activity. For example, the effect of the proteins or polypeptides on embryonic stem cell differentiation may be evaluated. Numerous assays for such activity are familiar to those skilled in the art, including the assays disclosed in the following references, which are incorporated herein by reference: Johansson et al. *Cell. Biol.* 15:141–151, 1995; Keller et al., *Mol. Cell. Biol.* 13:473–486, 1993; McClanahan et al., *Blood* 81:2903–2915, 1993.

The proteins or polypeptides encoded by the nucleic acids described above may also be evaluated for their influence on the lifetime of stem cells and stem cell differentiation. Numerous assays for such activity are familiar to those skilled in the art, including the assays disclosed in the following references, which are incorporated herein by reference: Freshney, M. G. Methylcellulose Colony Forming Assays, in *Culture of Hematopoietic Cells*. R. I. Freshney, et al. Eds. pp. 265–268, Wiley-Liss, Inc., New York, N.Y. 1994; Hirayama et al., *Proc. Natl. Acad. Sci. USA* 89:5907–5911, 1992; McNiece, I. K. and Briddell, R. A. Primitive Hematopoietic Colony Forming Cells with High Proliferative Potential, in *Culture of Hematopoietic Cells*. R. I. Freshney, et al. eds. Vol pp. 23–39, Wiley-Liss, Inc., New York, N.Y. 1994; Neben et al., *Experimental Hematology* 22:353–359,1994; Ploemacher, R. E. Cobblestone Area Forming Cell Assay, In *Culture of Hematopoietic Cells*. R. I. Freshney, et al. Eds. pp. 1–21, Wiley-Liss, Inc., New York, N.Y. 1994; Spooncer, E., Dexter, M. and Allen, T. Long Term Bone Marrow Cultures in the Presence of Stromal Cells, in *Culture of Hematopoietic Cells*. R. I. Freshney, et al. Eds. pp. 163–179, Wiley-Liss, Inc., New York, N.Y. 1994; and Sutherland, H. J. Long Term Culture Initiating Cell Assay, in *Culture of Hematopoietic Cells*. R. I. Freshney, et al. Eds. pp. 139–162, Wiley-Liss, Inc., New York, N.Y. 1994.

Those proteins or polypeptides which exhibit hematopoiesis regulatory activity may then be formulated as pharmaceuticals and used to treat clinical conditions in which regulation of hematopoeisis is beneficial. For example, a protein or polypeptide of the present invention may be useful in regulation of hematopoiesis and, consequently, in the treatment of myeloid or lymphoid cell deficiencies. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantion, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy. Alternatively, as described in more detail below, nucleic acids encoding these proteins or polypeptides or nucleic acids regulating the expression of these proteins or polypeptides may be introduced into appropriate host cells to increase or decrease the expression of the proteins as desired.

EXAMPLE 25

Assaying the Expressed Proteins or Polypeptides for Regulation of Tissue Growth

The proteins or polypeptides encoded by the nucleic acids described above may also be evaluated for their effect on tissue growth. Numerous assays for such activity are familiar to those skilled in the art, including the assays disclosed in International Patent Publication No. WO95/16035, International Patent Publication No. WO95/05846 and International Patent Publication No. WO91/07491, which are incorporated herein by reference.

Assays for wound healing activity include, without limitation, those described in: Winter, *Epidermal Wound Healing*, pps. 71–112 (Maibach, H I and Rovee, D T, eds.), Year Book Medical Publishers, Inc., Chicago, as modified by Eaglstein and Mertz, J. Invest. Dermatol 71:382–84 (1978) which are incorporated herein by reference.

Those proteins or polypeptides which are involved in the regulation of tissue growth may then be formulated as pharmaceuticals and used to treat clinical conditions in which regulation of tissue growth is beneficial. For example, a protein or polypeptide may have utility in compositions used for bone, cartilage, tendon, ligament and/or nerve tissue growth or regeneration, as well as for wound healing and tissue repair and replacement, and in the treatment of burns, incisions and ulcers.

A protein or polypeptide encoded by the nucleic acids described above which induces cartilage and/or bone growth in circumstances where bone is not normally formed, has application in the healing of bone fractures and cartilage damage or defects in humans and other animals. Such a preparation employing a protein or polypeptide of the invention may have prophylactic use in closed as well as open fracture reduction and also in the improved fixation of artificial joints. De novo bone synthesis induced by an osteogenic agent contributes to the repair of congenital, trauma induced, or oncologic resection induced craniofacial defects, and also is useful in cosmetic plastic surgery.

A protein or polypeptide of this invention may also be used in the treatment of periodontal disease, and in other tooth repair processes. Such agents may provide an environment to attract bone-forming cells, stimulate growth of bone-forming cells or induce differentiation of progenitors of bone-forming cells. A protein of the invention may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes.

Another category of tissue regeneration activity that may be attributable to the proteins or polypeptides encoded by the nucleic acids described above is tendon/ligament formation. A protein or polypeptide encoded by the nucleic acids described above, which induces tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a protein or polypeptide of the present invention contributes to the repair of tendon or ligaments defects of congenital, traumatic or other origin and is also useful in cosmetic plastic surgery for attachment or repair of tendons or ligaments. The proteins or polypeptides of the present invention may provide an environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The proteins or polypeptides of the invention may also be useful in the treatment of tendinitis, carpal tunnel syndrome and other tendon or ligament defects. The therapeutic compositions may also include an appropriate matrix and/or sequestering agent as a carrier as is well known in the art.

The proteins or polypeptides of the present invention may also be useful for proliferation of neural cells and for regeneration of nerve and brain tissue, i.e., for the treatment of central and peripheral nervous system diseases and neuropathies, as well as mechanical and traumatic disorders, which involve degeneration, death or trauma to neural cells or nerve tissue. More specifically, a protein or polypeptide may be used in the treatment of diseases of the peripheral nervous system, such as peripheral nerve injuries, peripheral neuropathy and localized neuropatuies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a protein or polypeptide of the invention.

Proteins or polypeptides of the invention may also be useful to promote better or faster closure of non-healing wounds, including without limitation pressure ulcers, ulcers associated with vascular insufficiency, surgical and traumatic wounds, and the like.

It is expected that a protein or polypeptide of the present invention may also exhibit activity for generation or regeneration of other tissues, such as organs (including, for example, pancreas, liver, intestine, kidney, skin, endothelium) muscle (smooth, skeletal or cardiac) and vascular (including vascular endothelium) tissue, or for promoting the growth of cells comprising such tissues. Part of the desired effects may be by inhibition or modulation of fibrotic scaring to allow normal tissue to generate. A protein or polypeptide of the invention may also exhibit angiogenic activity.

A protein or polypeptide of the present invention may also be useful for gut protection or regeneration and treatment of lung or liver fibrosis, reperfusion injury in various tissues, and conditions resulting from systemic cytokine damage.

A protein or polypeptide of the present invention may also be useful for promoting or inhibiting differentiation of tissues described above from precursor tissues or cells; or for inhibiting the growth of tissues described above.

Alternatively, as described in more detail below, nucleic acids encoding tissue growth regulating activity proteins or polypeptides or nucleic acids regulating the expression of such proteins or polypeptides may be introduced into appropriate host cells to increase or decrease the expression of the proteins as desired.

EXAMPLE 26

Assaying the Expressed Proteins or Polypeptides for Regulation of Reproductive Hormones The proteins or polypeptides of the present invention may also be evaluated for their ability to regulate reproductive hormones, such as follicle stimulating hormone. Numerous assays for such activity are familiar to those skilled in the art, including the assays disclosed in the following references, which are incorporated herein by reference: Vale et al., *Endocrinol.* 91:562–572,1972; Ling et al., *Nature* 321:779–782, 1986; Vale et al., *Nature* 321:776–779, 1986; Mason et al., *Nature* 318:659–663, 1985; Forage et al., *Proc. Natl. Acad. Sci. USA* 83:3091–3095, 1986. Chapter 6.12 in *Current Protocols in Immunology*, J. E. Coligan et al. Eds. Greene Publishing Associates and Wiley-Interscience; Taub et al. *J. Clin. Invest.* 95:1370–1376, 1995; Lind et al. *APMIS* 103:140–146, 1995; Muller et al. *Eur. J. Immunol.* 25:1744–1748; Gruber et al. *J. Immunol.* 152:5860–5867, 1994; Johnston et al., *J. Immunol.* 153:1762–1768, 1994.

Those proteins or polypeptides which exhibit activity as reproductive hormones or regulators of cell movement may then be formulated as pharmaceuticals and used to treat clinical conditions in which regulation of reproductive hormones are beneficial. For example, a protein or polypeptide may exhibit activin- or inhibin-related activities. Inhibins are characterized by their ability to inhibit the release of follicle stimulating hormone (FSH), while activins are characterized by their ability to stimulate the release of FSH. Thus, a protein or polypeptide of the present invention, alone or in heterodimers with a member of the inhibin a family, may be useful as a contraceptive based on the ability of inhibins to decrease fertility in female mammals and decrease spermatogenesis in male mammals. Administration of sufficient amounts of other inhibins can induce infertility in these mammals. Alternatively, the protein or polypeptide of the invention, as a homodimer or as a heterodimer with other protein subunits of the inhibin-B group, may be useful as a fertility inducing therapeutic, based upon the ability of activin molecules in stimulating FSH release from cells of the anterior pituitary. See, for example, U.S. Pat. No. 4,798,885, the disclosure of which is incorporated herein by reference. A protein or polypeptide of the invention may also be useful for advancement of the onset of fertility in sexually immature mammals, so as to increase the lifetime reproductive performance of domestic animals such as cows, sheep and pigs.

Alternatively, as described in more detail below, nucleic acids encoding reproductive hormone regulating activity proteins or polypeptides or nucleic acids regulating the expression of such proteins or polypeptides may be introduced into appropriate host cells to increase or decrease the expression of the proteins or polypeptides as desired.

EXAMPLE 27

Assaying the Expressed Proteins or Polypeptides For Chemotactic/Chemokinetic Activity The proteins or polypeptides of the present invention may also be evaluated for chemotactic/chemokinetic activity. For example, a protein or polypeptide of the present invention may have chemotactic or chemokinetic activity (e.g., act as a chemokine) for mammalian cells, including, for example, monocytes, fibroblasts, neutrophils, T-cells, mast cells, eosinophils, epithelial and/or endothelial cells. Chemotactic and chemokinetic proteins or polypeptides can be used to mobilize or attract a desired cell population to a desired site of action. Chemotactic or chemokinetic proteins or polypeptides provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or polypeptide has chemotactic activity for a particular cell population if it can stimulate, directly or indirectly, the directed orientation or movement of such cell population. Preferably, the protein or polypeptide has the ability to directly stimulate directed movement of cells. Whether a particular protein or polypeptide has chemotactic activity for a population of cells can be readily determined by employing such protein or polypeptide in any known assay for cell chemotaxis.

The activity of a protein or polypeptide of the invention may, among other means, be measured by the following methods:

Assays for chemotactic activity (which will identify proteins or polypeptides that induce or prevent chemotaxis) consist of assays that measure the ability of a protein or polypeptide to induce the migration of cells across a membrane as well as the ability of a protein or polypeptide to induce the adhesion of one cell population to another cell population. Suitable assays for movement and adhesion include, without limitation, those described in: *Current Protocols in Immunology*, Ed by J. E. Coligan, A. M. Kruisbeek, D. H. Margulies, E. M. Shevach, W. Strober, Pub. Greene Publishing Associates and Wiley-Interscience, Chapter 6.12: 6.12.1–6.12.28; Taub et al. *J. Clin. Invest.* 95:1370–1376, 1995; Lind et al. *APMIS* 103:140–146, 1995; Mueller et al., *Eur. J. Immunol.* 25:1744–1748; Gruber et al. *J. Immunol.* 152:5860–5867, 1994; Johnston et al. *J. Immunol.*, 153:1762–1768, 1994.

EXAMPLE 28

Assaying the Expressed Proteins or Polypeptides for Regulation of Blood Clotting The proteins or polypeptides of the present invention may also be evaluated for their effects on blood clotting. Numerous assays for such activity are familiar to those skilled in the art, including the assays disclosed in the following references, which are incorporated herein by reference: Linet et al., *J. Clin. Pharmacol.* 26:131–140, 1986; Burdick et al, *Thrombosis Res.* 45:413–419, 1987; Humphrey et al., *Fibrinolysis* 5:71–79 (1991); Schaub, *Prostaglandins* 35:467–474, 1988.

Those proteins or polypeptides which are involved in the regulation of blood clotting may then be formulated as pharmaceuticals and used to treat clinical conditions in which regulation of blood clotting is beneficial. For example, a protein or polypeptide of the invention may also exhibit hemostatic or thrombolytic activity. As a result, such a protein or polypeptide is expected to be useful in treatment of various coagulations disorders (including hereditary disorders, such as hemophilias) or to enhance coagulation and other hemostatic events in treating wounds resulting from trauma, surgery or other causes. A protein or polypeptide of the invention may also be useful for dissolving or inhibiting formation of thromboses and for treatment and prevention of conditions resulting therefrom (such as infarction of cardiac and central nervous system vessels (e.g., stroke)). Alternatively, as described in more detail below, nucleic acids encoding blood clotting activity proteins or polypeptides or nucleic acids regulating the expression of such proteins or polypeptides may be introduced into appropriate host cells to increase or decrease the expression of the proteins or polypeptides as desired.

EXAMPLE 29

Assaying the Expressed Proteins or Polypeptides for Involvement in Receptor/Ligand Interactions The proteins or polypeptides of the present invention may also be evaluated for their involvement in receptor/ligand interactions. Numerous assays for such involvement are familiar to those skilled in the art, including the assays disclosed in the following references, which are incorporated herein by reference: Chapter 7. 7.28.1–7.28.22) in *Current Protocols in Immunology*, J. E. Coligan et al. Eds. Greene Publishing Associates and Wiley-Interscience; Takai et al., *Proc. Natl. Acad. Sci. USA* 84:6864–6868, 1987; Bierer et al., *J. Exp. Med.* 168:1145–1156, 1988; Rosenstein et al., *J. Exp. Med.* 169:149–160, 1989; Stoltenborg et al., *J. Immunol. Methods* 175:59–68, 1994; Stitt et al., *Cell* 80:661–670, 1995; Gyuris et al., *Cell* 75:791–803, 1993.

For example, the proteins or polypeptides of the present invention may also demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selecting, integrins and their ligands) and receptor/ligand pairs involved in antigen presentation, antigen recognition and development of cellular and humoral immune responses). Receptors and ligands are also useful for screening of potential peptide or small molecule inhibitors of the relevant receptor/ligand interaction. A protein or polypeptide of the present invention (including, without limitation, fragments of receptors and ligands) may be useful as inhibitors of receptor/ligand interactions. Alternatively, as described in more detail below, nucleic acids encoding proteins or polypeptides involved in receptor/ligand interactions or nucleic acids regulating the expression of such proteins or polypeptides may be introduced into appropriate host cells to increase or decrease the expression of the proteins or polypeptides as desired.

EXAMPLE 30

Assaying the Proteins or Polypeptides for Anti-inflammatory Activity

The proteins or polypeptides of the present invention may also be evaluated for anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Proteins or polypeptides exhibiting such activities can be used to treat inflammatory conditions including chronic or acute conditions, including without limitation inflammation associated with infection (such as septic shock, sepsis or systemic inflammatory response syndrome), ischemia-reperfusioninury, endotoxin lethality, arthritis, complement-mediated hyperacute rejection, nephritis, cytokine- or chemokine-induced lung injury, inflammatory bowel disease, Crohn's disease or resulting from over production of cytokines such as TNF or IL-1. Proteins or polypeptides of the invention may also be useful to treat anaphylaxis and hypersensitivity to an antigenic substance or material. Alternatively, as described in more detail below, nucleic acids encoding anti-inflammatory activity proteins or polypeptides or nucleic acids regulating the expression of such proteins or polypeptides may be introduced into appropriate host cells to increase or decrease the expression of the proteins or polypeptides as desired.

EXAMPLE 31

Assaying the Expressed Proteins or Polypeptides for Tumor Inhibition Activity

The proteins or polypeptides of the present invention may also be evaluated for tumor inhibition activity. In addition to the activities described above for immunological treatment or prevention of tumors, a protein or polypeptide of the invention may exhibit other anti-tumor activities. A protein or polypeptide may inhibit tumor growth directly or indirectly (such as, for example, via ADCC). A protein or polypeptide may exhibit its tumor inhibitory activity by acting on tumor tissue or tumor precursor tissue, by inhibiting formation of tissues necessary to support tumor growth (such as, for example, by inhibiting angiogenesis), by causing production of other factors, agents or cell types which inhibit tumor growth, or by suppressing, eliminating or inhibiting factors, agents or cell types which promote tumor growth. Alternatively, as described in more detail below, nucleic acids encoding proteins or polypeptides with tumor inhibition activity or nucleic acids regulating the expression of such proteins or polypeptides may be introduced into appropriate host cells to increase or decrease the expression of the proteins or polypeptides as desired.

A protein or polypeptide of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, cofactors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity, in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein. Alternatively, as described in more detail below, nucleic acids encoding proteins or polypeptides involved in any of the above mentioned activities or nucleic acids regulating the expression of such proteins may be introduced into appropriate host cells to increase or decrease the expression of the proteins or polypeptides as desired.

EXAMPLE 32

Identification of Proteins or Polypeptides Which Interact With Proteins or Polypeptides of the Present Invention Proteins or polypeptides which interact with the proteins or polypeptides of the present invention, such as receptor proteins, may be identified using two hybrid systems such as the Matchmaker Two Hybrid System 2 (Catalog No. K1604-1, Clontech). As described in the manual accompanying the kit which is incorporated herein by reference, nucleic acids encoding the proteins or polypeptides of the present invention, are inserted into an expression vector such that they are in frame with DNA encoding the DNA binding domain of the yeast transcriptional activator GAL4 . cDNAs in a cDNA library which encode proteins or polypeptides which might interact with the proteins or polypeptides of the present invention are inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain plasmids encoding proteins or polypeptides which interact with the proteins or polypeptides of the present invention.

Alternatively, the system described in Lustig et al., *Methods in Enzymology* 283: 83–99 (1997), the disclosure of which is incorporated herein by reference, may be used for identifying molecules which interact with the proteins or polypeptides of the present invention. In such systems, in vitro transcription reactions are performed on a pool of vectors containing nucleic acid inserts which encode the proteins or polypeptides of the present invention. The nucleic acid inserts are cloned downstream of a promoter which drives in vitro transcription. The resulting pools of mRNAs are introduced into *Xenopus laevis* oocytes. The oocytes are then assayed for a desired activity.

Alternatively, the pooled in vitro transcription products produced as described above may be translated in vitro. The pooled in vitro translation products can be assayed for a desired activity or for interaction with a known protein or polypeptide.

Proteins, polypeptides or other molecules interacting with proteins or polypeptides of the present invention can be found by a variety of additional techniques. In one method, affinity columns containing the protein or polypeptide of the present invention can be constructed. In some versions, of this method the affinity column contains chimeric proteins in which the protein or polypeptide of the present invention is fused to glutathione S-transferase. A mixture of cellular proteins or pool of expressed proteins as described above and is applied to the affinity column. Molecules interacting with the protein or polypeptide attached to the column can then be isolated and analyzed on 2-D electrophoresis gel as described in Ramunsen et al. *Electrophoresis*, 18, 588–598 (1997), the disclosure of which is incorporated herein by reference. Alternatively, the molecules retained on the affinity column can be purified by electrophoresis based methods and sequenced. The same method can be used to isolate antibodies, to screen phage display products, or to screen phage display human antibodies.

Molecules interacting with the proteins or polypeptides of the present invention can also be screened by using an Optical Biosensor as described in Edwards & Leatherbarrow, *Analytical Biochemistry*, 246, 1–6 (1997), the disclosure of which is incorporated herein by reference. The main advantage of the method is that it allows the determination of the association rate between the protein or polypeptide and other interacting molecules. Thus, it is possible to specifically select interacting molecules with a high or low association rate. Typically a target molecule is linked to the sensor surface (through a carboxymethl dextran matrix) and a sample of test molecules is placed in contact with the target molecules. The binding of a test molecule to the target molecule causes a change in the refractive index and/or thickness. This change is detected by the Biosensor provided it occurs in the evanescent field (which extend a few hundred nanometers from the sensor surface). In these screening assays, the target molecule can be one of the proteins or polypeptides of the present invention and the test sample can be a collection of proteins, polypeptides or other molecules extracted from tissues or cells, a pool of expressed proteins, combinatorial peptide and/or chemical libraries, or phage displayed peptides. The tissues or cells from which the test molecules are extracted can originate from any species.

In other methods, a target protein or polypeptide is immobilized and the test population is a collection of unique proteins or polypeptides of the present invention.

To study the interaction of the proteins or polypeptides of the present invention with drugs, the microdialysis coupled to HPLC method described by Wang et al., *Chromatographia*, 44, 205–208(1997) or the affinity capillary electrophoresis method described by Busch et al., *J. Chromatogr.* 777:311–328 (1997), the disclosures of which are incorporated herein by reference can be used.

The system described in U.S. Pat. No. 5,654,150, the disclosure of which is incorporated herein by reference, may also be used to identify molecules which interact with the proteins or polypeptides of the present invention. In this system, pools of nucleic acids encoding the proteins or polypeptides of the present invention are transcribed and translated in vitro and the reaction products are assayed for interaction with a known polypeptide or antibody.

It will be appreciated by those skilled in the art that the proteins or polypeptides of the present invention may be assayed for numerous activities in addition to those specifically enumerated above. For example, the expressed proteins or polypeptides may be evaluated for applications involving control and regulation of inflammation, tumor proliferation or metastasis, infection, or other clinical conditions. In addition, the proteins or polypeptides may be useful as nutritional agents or cosmetic agents.

The proteins or polypeptides of the present invention may be used to generate antibodies capable of specifically binding to the proteins or polypeptides of the present invention. The antibodies may be monoclonal antibodies or polyclonal antibodies. As used herein, "antibody" refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', F(ab)$_2$, and F(ab')$_2$ fragments.

As used herein, an "antigenic determinant" is the portion of an antigen molecule, that determines the specificity of the antigen-antibody reaction. An "epitope" refers to an antigenic determinant of a polypeptide. An epitope can comprise as few as 3 amino acids in a spatial conformation which is unique to the epitope. Generally an epitope consists of at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by H. Mario Geysen et al. 1984. Proc. Natl. Acad. Sci. U.S.A. 81:3998–4002; PCT Publication No. WO 84/03564; and PCT Publication No. WO 84/03506.

In some embodiments, the antibodies may be capable of specifically binding to a protein or polypeptide encoded by EST-related nucleic acids, fragments of EST-related nucleic acids, positional segments of EST-related nucleic acids or fragments of positional segments of EST-related nucleic acids. In some embodiments, the antibody may be capable of binding an antigenic determinant or an epitope in a protein or polypeptide encoded by EST-related nucleic acids, fragments of EST-related nucleic acids, positional segments of EST-related nucleic acids or fragments of positional segments of EST-related nucleic acids.

In other embodiments, the antibodies may be capable of specifically binding to an EST-related polypeptide, fragment of an EST-related polypeptide, positional segment of an EST-related polypeptide or fragment of a positional segment of an EST-related polypeptide. In some embodiments, the antibody may be capable of binding an antigenic determinant or an epitope in an EST-related polypeptide, fragment of an EST-related polypeptide, positional segment of an EST-related polypeptide or fragment of a positional segment of an EST-related polypeptide.

In the case of secreted proteins, the antibodies may be capable of binding a full-length protein encoded by a nucleic acid, of the present invention, a mature protein (i.e. the protein generated by cleavage of the signal peptide) encoded by a nucleic acid of the present invention, or a signal peptide encoded by a nucleic acid of the present invention.

EXAMPLE 33

Production of an Antibody to a Human Polypeptide or Protein

The above described EST-related nucleic acids, fragments of EST-related nucleic acids, positional segments of EST-related nucleic acids or fragments of positional segments of EST-related nucleic acids or nucleic acids encoding EST-related polypeptides, fragments of EST-related polypeptides, positional segments of EST-related polypeptides or fragments of positional segments of EST-related polypeptides are operably linked to promoters and introduced into cells as described above.

In the case of secreted proteins, nucleic acids encoding the full protein (i.e. the mature protein and the signal peptide), nucleic acids encoding the mature protein (i.e. the protein generated by cleavage of the signal peptide), or nucleic acids encoding the signal peptide are operably linked to promoters and introduced into cells as described above. The encoded proteins or polypeptides are then substantially purified or isolated as described above. The concentration of protein in the final preparation is adjusted, for example, by concentration on an Amicon filter device, to the level of a few pug/ml.

Monoclonal or polyclonal antibody to the protein or polypeptide can then be prepared as follows:

1. Monoclonal Antibody Production by Hybridoma Fusion

Monoclonal antibody to epitopes of any of the proteins or polypeptides identified and isolated as described can be prepared from murine hybridomas according to the classical method of Kohler, and Milstein, Nature 256:495 (1975) or derivative methods thereof Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as Elisa, as originally described by Engvall, Meth. Enzymol. 70:419 (1980), the disclosure of which is incorporated herein by reference and derivative methods thereof. Selected positive clones can be expanded and their monoclonal antibody product harvested for use. Detailed procedures for monoclonal antibody production are described in Davis, L. et al. in Basic Methods in Molecular Biology Elsevier, New York. Section 21-2, the disclosure of which is incorporated herein by reference.

2. Polyclonal Antibody Production by Immunization

Polyclonal antiserum containing antibodies to heterogenous epitopes of a single protein or polypeptide can be prepared by immunizing suitable animals with the expressed protein or peptides derived therefrom, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals response vary depending on site of inoculations and doses, with both inadequate or excessive doses of antigen resulting in low titer antisera. Small doses (ng level) of antigen administered at multiple intradermal sites appears to be most reliable. An effective immunization protocol for rabbits can be found in Vaitukaitis. et al. *J. Clin. Endocrinol. Metab.* 33:988–991 (1971), the disclosure of which is incorporated herein by reference.

Booster injections can be given at regular intervals, and antiserum harvested when antibody titer thereof, as determined semifuantitatively, for example, by double immunodiffusion in agar against known concentrations of the antigen, begins to fall. See, for example, Ouchterlony, et al., Chap. 19 in: *Handbook of Experimental Immunology* D. Wier (ed) Blackwell (1973), the disclosure of which is incorporated herein by reference. Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: *Manual of Clinical Immunology*, 2d Ed. (Rose and Friedman, Eds.) Amer. Soc. For Microbiol., Washington, D.C. (1980), the disclosure of which is incorporated herein by reference.

Antibody preparations prepared according to either of the above protocols are useful in a variety of contexts. In particular, the antibodies may be used in immunoaffinity chromatography techniques such as those described below to facilitate large scale isolation, purification, or enrichment of the proteins or polypeptides encoded by EST-related nucleic acids, positional segments of EST-related nucleic acids or fragments of positional segments of EST-related nucleic acids or for the isolation, purification or enrichment of EST-related polypeptides, fragments of EST-related polypeptides, positional segments of EST-related polypeptides or fragments of positional segments of EST-related polypeptides.

In the case of secreted proteins, the antibodies may be used for the isolation, purification, or enrichment of the full protein (i.e. the mature protein and the signal peptide), the mature protein (i.e. the protein generated by cleavage of the signal peptide), or the signal peptide are operably linked to promoters and introduced into cells as described above.

Additionally, the antibodies may be used in immunoaffinity chromatography techniques such as those described below to isolate, purify, or enrich polypeptides which have been linked to the proteins or polypeptides encoded by EST-related nucleic acids, positional segments of EST-related nucleic acids or fragments of positional segments of EST-related nucleic acids or to isolate, purify, or enrich EST-related polypeptides, fragments of EST-related polypeptides, positional segments of EST-related polypeptides or fragments of positional segments of EST-related polypeptides.

The antibodies may also be used to determine the cellular localization of polypeptides encoded by the proteins or polypeptides encoded by EST-related nucleic acids, positional segments of EST-related nucleic acids or fragments of positional segments of EST-related nucleic acids or the cellular localization of EST-related polypeptides, fragments of EST-related polypeptides, positional segments of EST-related polypeptides or fragments of positional segments of EST-related polypeptides.

In addition, the antibodies may also be used to determine the cellular localization of polypeptides which have been linked to the proteins or polypeptides encoded by EST-related nucleic acids, positional segments of EST-related nucleic acids or fragments of positional segments of EST-related nucleic acids or polypeptides which have been linked EST-related polypeptides, fragments of EST-related polypeptides, positional segments of EST-related polypeptides or fragments of positional segments of EST-related polypeptides.

The antibodies may also be used in quantitative immunoassays which determine concentrations of antigen-bearing substances in biological samples; they may also used semiquantitatively or qualitatively to identify the presence of antigen in a biological sample or to identify the type of tissue present in a biological sample. The antibodies may also be used in therapeutic compositions for killing cells expressing the protein or reducing the levels of the protein in the body.

V. Use of 5' ESTs and Consensus Contigated 5' ESTs or Sequences Obtainable Therefrom or Portions Thereof as Reagents The EST-related nucleic acids, positional segments of EST-related nucleic acids or fragments of positional segments of EST-related nucleic acids may be used as reagents in isolation procedures, diagnostic assays, and forensic procedures. For example, sequences from the EST-related nucleic acids, positional segments of EST-related nucleic acids or fragments of positional segments of EST-related nucleic acids, may be detectably labeled and used as probes to isolate other sequences capable of hybridizing to them. In addition, the he EST-related nucleic acids, positional segments of EST-related nucleic acids or fragments of positional segments of EST-related nucleic acids may be used to design PCR primers to be used in isolation, diagnostic, or forensic procedures.

1. Use of EST-related Nucleic Acids, Positional Segments of EST-related Nucleic Acids or Fragments of Positional Segments of EST-related Nucleic Acids in Isolation, Diagnostic and Forensic Procedures

EXAMPLE 34

Preparation of PCR Primers and Amplification of DNA

The EST-related nucleic acids, positional segments of EST-related nucleic acids or fragments of positional segments of EST-related nucleic acids may be used to prepare PCR primers for a variety of applications, including isolation procedures for cloning nucleic acids capable of hybridizing to such sequences, diagnostic techniques and forensic techniques. In some embodiments, the PCR primers at least 10, 15, 18, 20, 23, 25, 28, 30, 40, or 50 nucleotides in length. In some embodiments, the PCR primers may be more than 30 bases in length. It is preferred that the primer pairs have approximately the same G/C ratio, so that melting temperatures are approximately the same. A variety of PCR techniques are familiar to those skilled in the art. For a review of PCR technology, see Molecular Cloning to Genetic Engineering White, B. A. Ed. in *Methods in Molecular Biology* 67: Humana Press, Totowa 1997, the disclosure of which is incorporated herein by reference. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites.

EXAMPLE 35

Use of the EST-related Nucleic Acids, Positional Segments of EST-related Nucleic Acids or Fragments of Positional Segments of EST-related Nucleic Acids as Probes Probes derived from EST-related nucleic acids, positional segments of EST-related nucleic acids or fragments of positional segments of EST-related nucleic acids may be labeled with detectable labels familiar to those skilled in the art, including radioisotopes and non-radioactive labels, to provide a detectable probe. The detectable probe may be single stranded or double stranded and may be made using techniques known in the art, including in vitro transcription, nick translation, or kinase reactions. A nucleic acid sample containing a sequence capable of hybridizing to the labeled probe is contacted with the labeled probe. If the nucleic acid in the sample is double stranded, it may be denatured prior to contacting the probe. In some applications, the nucleic acid sample may be immobilized on a surface such as a nitrocellulose or nylon membrane. The nucleic acid sample may comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe may be cloned into vectors such as expression vectors, sequencing vectors, or in vitro transcription vectors to facilitate the characterization and expression of the hybridizing nucleic acids in the sample. For example, such techniques may be used to isolate and clone sequences in a genomic library or cDNA library which are capable of hybridizing to the detectable probe as described in Example 18 above.

PCR primers made as described in Example 34 above may be used in forensic analyses, such as the DNA fingerprinting techniques described in Examples 36–40 below. Such analyses may utilize detectable probes or primers based on the sequences of the EST-related nucleic acids, positional segments of EST-related nucleic acids or fragments of positional segments of EST-related nucleic acids.

EXAMPLE 36

Forensic Matching by DNA Sequencing

In one exemplary method, DNA samples are isolated from forensic specimens of, for example, hair, semen, blood or skin cells by conventional methods. A panel of PCR primers based on a number of the EST-related nucleic acids, positional segments of EST-related nucleic acids or fragments of positional segments of EST-related nucleic acids is then utilized in accordance with Example 34 to amplify DNA of approximately 100–200 bases in length from the forensic specimen. Corresponding sequences are obtained from a test subject. Each of these identification DNAs is then sequenced using standard techniques, and a simple database comparison determines the differences, if any, between the sequences from the subject and those from the sample. Statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 50 statistically identical sequences of 100 bases in length are used to prove identity between the suspect and the sample.

EXAMPLE 37

Positive Identification by DNA Sequencing

The technique outlined in the previous example may also be used on a larger scale to provide a unique fingerprint-type identification of any individual. In this technique, primers are prepared from a large number of EST-related nucleic acids, positional segments of EST-related nucleic acids or fragments of positional segments of EST-related nucleic acids. Preferably, 20 to 50 different primers are used. These primers are used to obtain a corresponding number of PCR-generated DNA segments from the individual in question in accordance with Example 34. Each of these DNA segments is sequenced, using the methods set forth in Example 36. The database of sequences generated through this procedure uniquely identifies the individual from whom the sequences were obtained. The same panel of primers may then be used at any later time to absolutely correlate tissue or other biological specimen with that individual.

EXAMPLE 38

Southern Blot Forensic Identification

The procedure of Example 37 is repeated to obtain a panel of at least 10 amplified sequences from an individual and a specimen. Preferably, the panel contains at least 50 amplified sequences. More preferably, the panel contains 100 amplified sequences. In some embodiments, the panel contains 200 amplified sequences. This PCR-generated DNA is then digested with one or a combination of, preferably, four base specific restriction enzymes. Such enzymes are commercially available and known to those of skill in the art. After digestion, the resultant gene fragments are size separated in multiple duplicate wells on an agarose gel and transferred to nitrocellulose using Southern blotting techniques well known to those with skill in the art. For a review of Southern blotting see Davis et al. (Basic Methods in Molecular Biology, 1986, Elsevier Press. pp 62–65), the disclosure of which is incorporated herein by reference.

A panel of probes based on the sequences of the EST-related nucleic acids, positional segments of EST-related nucleic acids or fragments of positional segments of EST-related nucleic acids are radioactively or calorimetrically labeled using methods known in the art, such as nick translation or end labeling, and hybridized to the Southern blot using techniques known in the art (Davis et al., supra). Preferably, the probe is at least 10, 12, 15, 18, 20, 25, 28, 30, 35, 40, 50, 75, 100, 150, 200, 300, 400 or 500 nucleotides in length. Preferably, the probes are at least 10, 12, 15, 18, 20, 25, 28, 30, 35, 40, 50, 75, 100, 150, 200, 300, 400 or 500 nucleotides in length. In some embodiments, the probes are oligonucleotides which are 40 nucleotides in length or less.

Preferably, at least 5 to 10 of these labeled probes are used, and more preferably at least about 20 or 30 are used to provide a unique pattern. The resultant bands appearing from the hybridization of a large sample of EST-related nucleic acids, positional segments of EST-related nucleic acids or fragments of positional segments of EST-related nucleic acids will be a unique identifier. Since the restriction enzyme cleavage will be different for every individual, the band pattern on the Southern blot will also be unique. Increasing the number of probes will provide a statistically higher level of confidence in the identification since there will be an increased number of sets of bands used for identification.

EXAMPLE 39

Dot Blot Identification Procedure

Another technique for identifying individuals using the EST-related nucleic acids, positional segments of EST-related nucleic acids or fragments of positional segments of EST-related nucleic acids disclosed herein utilizes a dot blot hybridization technique.

Genomic DNA is isolated from nuclei of subject to be identified. Probes are prepared that correspond to at least 10, preferably 50 sequences from the EST-related nucleic acids, positional segments of EST-related nucleic acids or fragments of positional segments of EST-related nucleic acids. The probes are used to hybridize to the genomic DNA through conditions known to those in the art. The oligonucleotides are end labeled with 2 using polynucleotide kinase Pharmacia). Dot Blots are created by spotting the genomic DNA onto nitrocellulose or the like using a vacuum dot blot manifold (BioRad, Richmond Calif.). The nitrocellulose filter containing the genomic sequences is baked or UV linked to the filter, prehybridized and hybridized with labeled probe using techniques known in the art (Davis et al., supra). The $^{32}$P labeled DNA fragments are sequentially hybridized with successively stringent conditions to detect minimal differences between the 30 bp sequence and the DNA. Tetramethyl ammonium chloride is useful for identifying clones containing small numbers of nucleotide mismatches (Wood et al., *Proc. Natl. Acad. Sci. USA* 82(6):1585–1588 (1985)) which is hereby incorporated by reference. A unique pattern of dots distinguishes one individual from another individual.

EST-related nucleic acids, positional segments of EST-related nucleic acids or fragments of positional segments of EST-related nucleic acids can be used as probes in the following alternative fingerprinting technique. In some embodiments, the probes are oligonucleotides which are 40 nucleotides in length or less.

Preferably, a plurality of probes having sequences from different EST-related nucleic acids, positional segments of EST-related nucleic acids or fragments of positional segments of EST-related nucleic acids are used in the alternative fingerprinting technique. Example 40 below provides a representative alternative fingerprinting procedure in which the probes are derived from EST-related nucleic acids, positional segments of EST-related nucleic acids or fragments of positional segments of EST-related nucleic acids.

EXAMPLE 40

Alternative "Fingerprint" Identification Technique

Oligonucleotides are prepared from a large number, e.g. 50, 100, or 200, EST-related nucleic acids, positional segments of EST-related nucleic acids or fragments of positional segments of EST-related nucleic acids using commercially available oligonucleotide services such as Genset, Paris, France. Preferably, the oligonucleotides are at least 10, 15, 18, 20, 23, 25, 28, or 30 nucleotides in length. However, in some embodiments, the oligonucleotides may be more than 30 nucleotides in length.

Cell samples from the test subject are processed for DNA using techniques well known to those with skill in the art. The nucleic acid is digested with restriction enzymes such as EcoRI and XbaI. Following digestion, samples are applied to wells for electrophoresis. The procedure, as known in the art, may be modified to accommodate polyacrylamide electrophoresis, however in this example, samples containing 5 ug of DNA are loaded into wells and separated on 0.8% agarose gels. The gels are transferred onto nitrocellulose using standard Southern blotting techniques.

10 ng of each of the oligonucleotides are pooled and end-labeled with $P^{32}$. The nitrocellulose is prehybridized with blocking solution and hybridized with the labeled probes. Following hybridization and washing, the nitrocellulose filter is exposed to X-Omat AR X-ray film. The resulting hybridization pattern will be unique for each individual.

It is additionally contemplated within this example that the number of probe sequences used can be varied for additional accuracy or clarity.

In addition to their applications in forensics and identification, EST-related nucleic acids, positional segments of EST-related nucleic acids or fragments of positional segments of EST-related nucleic acids may be mapped to their chromosomal locations. Example 41 below describes radiation hybrid (RH) mapping of human chromosomal regions using EST-related nucleic acids, positional segments of EST-related nucleic acids or fragments of positional segments of EST-related nucleic acids. Example 42 below describes a representative procedure for mapping EST-related nucleic acids, positional segments of EST-related nucleic acids or fragments of positional segments of EST-related nucleic acids to their locations on human chromosomes. Example 43 below describes mapping of EST-related nucleic acids, positional segments of EST-related nucleic acids or fragments of positional segments of EST-related nucleic acids on metaphase chromosomes by Fluorescence In Situ Hybridization (FISH).

2. Use of EST-related Nucleic Acids, Positional Segments of EST-related Nucleic Acids or Fragments of Positional Segments of EST-related Nucleic acids in Chromosome Ma ping

EXAMPLE 41

Radiation Hybrid Mapping of EST-related Nucleic Acids, Positional Segments of EST-related Nucleic Acids or Fragments of Positional Segments of EST-related Nucleic Acids to the Human Genome Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different portions of the human genome. This technique is described by Benham et al. (*Genomics* 4:509–517, 1989) and Cox et al., (*Science* 250:245–250, 1990), the entire contents of which are hereby incorporated by reference. The random and independent nature of the subclones permits efficient mapping of any human genome marker. Human DNA isolated from a panel of 80–100 cell lines provides a mapping reagent for ordering EST-related nucleic acids, positional segments of EST-related nucleic acids or fragments of positional segments of EST-related nucleic acids. In this approach, the frequency of breakage between markers is used to measure distance, allowing construction of fine resolution maps as has been done using conventional ESTs (Schuler et al., *Science* 274:540–546, 1996, hereby incorporated by reference).

RH mapping has been used to generate a high-resolution whole genome radiation hybrid map of human chromosome 17q22-q25.3 across the genes for growth hormone (GH) and thynidine kinase (TK) (Foster et al., *Genomics* 33:185–192, 1996), the region art surrounding the Gorlin syndrome gene (Obermayr et al, *Eur. J. Hum. Genet.* 4:242–245, 1996), 60 loci covering the entire short arm of chromosome 12 (Raeymaekers et al., *Genomics* 29:170–178, 1995), the region of human chromosome 22 containing the neurofibromatosis type 2 locus (Frazer et al, *Genomics* 14:574584, 1992) and 13 loci on the long arm of chromosome 5 (Warrington et al., *Genomics* 11:701–708, 1991).

EXAMPLE 42

Mapping of EST-related Nucleic Acids, Positional Segments of EST-related Nucleic Acids or Fragments of Positional Segments of EST-related Nucleic Acids to Human Chromosomes Using PCR Techniques EST-related nucleic acids, positional segments of EST-related nucleic acids or fragments of positional segments of EST-related nucleic acids may be assigned to human chromosomes using PCR based methodologies. In such approaches, oligonucleotide primer pairs are designed from EST-related nucleic acids, positional segments of EST-related nucleic acids or fragments of positional segments of EST-related nucleic acids to minimize the chance of amplifying through an intron. Preferably, the oligonucleotide primers are 18–23 bp in length and are designed for PCR amplification. The creation of PCR primers from known sequences is well known to those with skill in the art. For a review of PCR technology see Erlich. in PCR Technology; Principles and Applications for DNA Amplification. 1992. W.H. Freeman and Co., New York, the disclosure of which is incorporated herein by reference.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 $\mu$Cu of a 32P-labeled deoxycytidine triphosphate. The PCR is performed in a microplate thermocycler (Techne) under the following conditions: 30 cycles of 94° C., 1.4 min; 55° C., 2 min; and 72° C., 2 min; with a final extension at 72° C. for 10 min. The amplified products are analyzed on a 6% polyacrylamide sequencing gel and visualized by autoradiography. If the length of the resulting PCR product is identical to the distance between the ends of the primer sequences in the 5' EST from which the primers are derived, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given 5' EST. DNA is isolated from the somatic hybrids and used as starting templates for PCR reactions using the primer pairs from the EST-related nucleic acids, positional segments of EST-related nucleic acids or fragments of positional segments of EST-related nucleic acids. Only those somatic cell hybrids with chromosomes containing the human gene corresponding to the EST-related nucleic acids, positional segments of EST-related nucleic acids or fragments of positional segments of EST-related nucleic acids will yield an amplified fragment. The 5' ESTs are assigned to a chromosome by analysis of the segregation pattern of PCR products from the somatic hybrid DNA templates. The single human chromosome present in all cell hybrids that give rise to an amplified fragment is the chromosome containing that EST-related nucleic acids, positional segments of EST-related nucleic acids or fragments of positional segments of EST-related nucleic acids. For a review of techniques and analysis of results from somatic cell gene mapping experiments. (See Ledbetter et al., Genomics 6:475–481 (1990), the disclosure of which is incorporated herein by reference.)

Alternatively, the EST-related nucleic acids, positional segments of EST-related nucleic acids or fragments of positional segments of EST-related nucleic acids may be mapped to individual chromosomes using FISH as described in Example 43 below.

EXAMPLE 43

Mapping of EST-related Nucleic Acids, Positional Segments of EST-related Nucleic Acids or Fragments of Positional Segments of EST-related Nucleic Acids to Chromosomes Using Fluorescence In Situ Hybridization Fluorescence in situ hybridization allows the EST-related nucleic acids, positional segments of EST-related nucleic acids or fragments of positional segments of EST-related nucleic acids to be mapped to a particular location on a given chromosome. The chromosomes to be used for fluorescence in situ hybridization techniques may be obtained from a variety of sources including cell cultures, tissues, or whole blood.

In a preferred embodiment, chromosomal localization of EST-related nucleic acids, positional segments of EST-related nucleic acids or fragments of positional segments of EST-related nucleic acids are obtained by FISH as described by Cherif et al. (*Proc. Natl. Acad. Sci. U.S.A.*, 87:6639–6643, 1990), the disclosure of which is incorporated herein by reference. Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 $\mu$M) is added for 17 h, followed by addition of 5-bromodeoxyuridine (5-BrdU, 0.1 mM) for 6 h. Colcemid (1 $\mu$g/ml) is added for the last 15 min before harvesting the cells. Cells are collected, washed in RPMI, incubated with a hypotonic solution of KCl (75 mM) at 37° C. for 15 min and fixed in three changes of methanol:acetic acid (3:1). The cell suspension is dropped onto a glass slide and air dried. The EST-related nucleic acids, positional segments of EST-related nucleic acids or fragments of positional segments of EST-related nucleic acids is labeled with biotin-16 dUTP by nick translation according to the manufacturer's instructions (Bethesda Research Laboratories, Bethesda, Md.), purified using a Sephadex G-50 column (Pharmacia, Upsala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70° C. for 5–10 min.

Slides kept at −20° C. are treated for 1 h at 37° C. with RNase A (100 μg/ml), rinsed three times in 2×SSC and dehydrated in an ethanol series. Chromosome preparations are denatured in 70% formamide, 2×SSC for 2 min at 70° C., then dehydrated at 4° C. The slides are treated with proteinase K (10 μg/100 ml in 20 mM Tris-HCl, 2 mM CaCl$_2$) at 37° C. for 8 min and dehydrated. The hybridization mixture containing the probe is placed on the slide, covered with a coverslip, sealed with rubber cement and incubated overnight in a humid chamber at 37° C. After hybridization and post-hybridization washes, the biotinylated probe is detected by avidin-FITC and amplified with additional layers of biotinylated goat anti-avidin and avidin-FITC. For chromosomal localization, fuorescent R-bands are obtained as previously described (Cherif et al., supra.). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular EST-related nucleic acids, positional segments of EST-related nucleic acids or fragments of positional segments of EST-related nucleic acids may be localized to a particular cytogenetic R-band on a given chromosome.

Once the EST-related nucleic acids, positional segments of EST-related nucleic acids or fragments of positional segments of EST-related nucleic acids have been assigned to particular chromosomes using the techniques described in Examples 41–43 above, they may be utilized to construct a high resolution map of the chromosomes on which they are located or to identify the chromosomes in a sample.

EXAMPLE 44

Use of EST-related Nucleic Acids Positional Segments of EST-related Nucleic Acids or Fragments of Positional Segments of EST-related Nucleic Acids to Construct or Expand Chromosome Maps Chromosome mapping involves assigning a given unique sequence to a particular chromosome as described above. Once the unique sequence has been mapped to a given chromosome, it is ordered relative to other unique sequences located on the same chromosome. One approach to chromosome mapping utilizes a series of yeast artificial chromosomes (YACs) bearing several thousand long inserts derived from the chromosomes of the organism from which the EST-related nucleic acids, positional segments of EST-related nucleic acids or fragments of positional segments of EST-related nucleic acids are obtained. This approach is described in Ramaiah Nagaraja et al., *Genome Research* 7:210–222, March 1997, the disclosure of which is incorporated herein by reference. Briefly, in this approach each chromosome is broken into overlapping pieces which are inserted into the YAC vector. The YAC inserts are screened using PCR or other methods to determine whether they include the EST-related nucleic acids, posifional segments of EST-related nucleic acids or fragments of positional segments of EST-related nucleic acids whose position is to be determined. Once an insert has been found which includes the 5' EST, the insert can be analyzed by PCR or other methods to determine whether the insert also contains other sequences known to be on the chromosome or in the region from which the EST-related nucleic acids, positional segments of EST-related nucleic acids or fragments of positional segments of EST-related nucleic acids was derived. This process can be repeated for each insert in the YAC library to determine the location of each of the EST-related nucleic acids, positional segments of EST-related nucleic acids or fragments of positional segments of EST-related nucleic acids relative to one another and to other known chromosomal markers. In this way, a high resolution map of the distribution of numerous unique markers along each of the organisms chromosomes may be obtained.

As described in Example 45 below EST-related nucleic acids, positional segments of EST-related nucleic acids or fragments of positional segments of EST-related nucleic acids may also be used to identify genes associated with a particular phenotype, such as hereditary disease or drug response.

3. Use of EST-related Nucleic Acids, Positional Segments of EST-related Nucleic Acids or Fragments of Positional Segments of EST-related Nucleic Acids Gene Identification

EXAMPLE 45

Identification of Genes Associated With Hereditary Diseases or Drug Response

This example illustrates an approach useful for the association of EST-related nucleic acids, positional segments of EST-related nucleic acids or fragments of positional segments of EST-related nucleic acids with particular phenotypic characteristics. In this example, a particular EST-related nucleic acids, positional segments of EST-related nucleic acids or fragments of positional segments of EST-related nucleic acids is used as a test probe to associate that EST-related nucleic acids, positional segments of EST-related nucleic acids or fragments of positional segments of EST-related nucleic acids with a particular phenotypic characteristic.

EST-related nucleic acids, positional segments of EST-related nucleic acids or fragments of positional segments of EST-related nucleic acids are mapped to a particular location on a human chromosome using techniques such as those described in Examples 41 and 42 or other techniques known in the art. A search of Mendelian Inheritance in Man (V. McKusick, *Mendelian Inheritance in Man* (available on line through Johns Hopkins University Welch Medical Library) reveals the region of the human chromosome which contains the EST-related nucleic acids, positional segments of EST-related nucleic acids or fragments of positional segments of EST-related nucleic acids to be a very gene rich region containing several known genes and several diseases or phenotypes for which genes have not been identified. The gene corresponding to this EST-related nucleic acids, positional segments of EST-related nucleic acids or fragments of positional segments of EST-related nucleic acids thus becomes an immediate candidate for each of these genetic diseases.

Cells from patients with these diseases or phenotypes are isolated and expanded in culture. PCR primers from the EST-related nucleic acids, positional segments of EST-related nucleic acids or fragments of positional segments of EST-related nucleic acids are used to screen genomic DNA, mRNA or cDNA obtained from the patients. EST-related nucleic acids, positional segments of EST-related nucleic acids or fragments of positional segments of EST-related nucleic acids that are not amplified in the patients can be positively associated with a particular disease by further analysis. Alternatively, the PCR analysis may yield fragments of different lengths when the samples are derived from an individual having the phenotype associated with the disease than when the sample is derived from a healthy individual, indicating that the gene containing the EST-related nucleic acids, positional segments of EST-related nucleic acids or fragments of positional segments of EST-related nucleic acids may be responsible for the genetic disease.

VI. Use of EST-related Nucleic Acids, Positional Segments of EST-related Nucleic Acids or Fragments of Positional Segments of EST-related Nucleic Acids to Construct Vectors The present EST-related nucleic acids, positional segments of EST-related nucleic acids or fragments of positional segments of EST-related nucleic acids may also be used to construct secretion vectors capable of directing the secretion of the proteins encoded by genes therein. Such secretion vectors may facilitate the purification or enrichment of the proteins encoded by genes inserted therein by reducing the number of background proteins from which the desired protein must be purified or enriched. Exemplary secretion vectors are described in Example 46 below.

1. Construction of Secretion Vectors

EXAMPLE 46

Construction of Secretion Vectors

The secretion vectors of the present invention include a promoter capable of directing gene expression in the host cell, tissue, or organism of interest. Such promoters include the *Rous Sarcoma* Virus promoter, the SV40 promoter, the human cytomegalovirus promoter, and other promoters familiar to those skilled in the art.

A signal sequence from one of the EST-related nucleic acids, positional segments of EST-related nucleic acids or fragments of positional segments of EST-related nucleic acids is operably linked to the promoter such that the mRNA transcribed from the promoter will direct the translation of the signal peptide. Preferably, the signal sequence is from one of the nucleic acids of SEQ ID NOs.:24–4100. The host cell, tissue, or organism may be any cell, tissue, or organism which recognizes the signal peptide encoded by the signal sequence in the EST-related nucleic acids, positional segments of EST-related nucleic acids or fragments of positional segments of EST-related nucleic acids. Suitable hosts include mammalian cells, tissues or organisms, avian cells, tissues, or organisms, insect cells, tissues or organisms, or yeast.

In addition, the secretion vector contains cloning sites for inserting genes encoding the proteins which are to be secreted. The cloning sites facilitate the cloning of the insert gene in frame with the signal sequence such that a fusion protein in which the signal peptide is fused to the protein encoded by the inserted gene is expressed from the mRNA transcribed from the promoter. The signal peptide directs the extracellular secretion of the fusion protein.

The secretion vector may be DNA or RNA and may integrate into the chromosome of the host, be stably maintained as an extrachromosomal replicon in the host, be an artificial chromosome, or be transiently present in the host. Preferably, the secretion vector is maintained in multiple copies in each host cell. As used herein, multiple copies means at least 2, 5, 10, 20, 25, 50 or more than 50 copies per cell. In some embodiments, the multiple copies are maintained extrachromosomally. In other embodiments, the multiple copies result from amplification of a chromosomal sequence.

Many nucleic acid backbones suitable for use as secretion vectors are known to those skilled in the art, including retroviral vectors, SV40 vectors, Bovine Papilloma Virus vectors, yeast integrating plasmids, yeast episomal plasmids, yeast artificial chromosomes, human artificial chromosomes, P element vectors, baculovirus vectors, or bacterial plasmids capable of being transiently introduced into the host.

The secretion vector may also contain a polyA signal such that the polyA signal is located downstream of the gene inserted into the secretion vector.

After the gene encoding the protein for which secretion is desired is inserted into the secretion vector, the secretion vector is introduced into the host cell, tissue, or organism using calcium phosphate precipitation, DEAE-Dextrar, electroporation, liposome-mediated transfection, viral particles or as naked DNA. The protein encoded by the inserted gene is then purified or enriched from the supernatant using conventional techniques such as ammonium sulfate precipitation, immunoprecipitation, immunoaffinity-chromatography, size exclusion chromatography, ion exchange chromatography, and HPLC. Alternatively, the secreted protein may be in a sufficiently enriched or pure state in the supernatant or growth media of the host to permit it to be used for its intended purpose without further enrichment.

The signal sequences may also be inserted into vectors designed for gene therapy. In such vectors, the signal sequence is operably linked to a promoter such that mRNA transcribed from the promoter encodes the signal peptide. A cloning site is located downstream of the signal sequence such that a gene encoding a protein whose secretion is desired may readily be inserted into the vector and fused to the signal sequence. The vector is introduced into an appropriate host cell. The protein expressed from the promoter is secreted extracellularly, thereby producing a therapeutic effect.

EXAMPLE 47

Fusion Vectors

The EST-related nucleic acids, positional segments of EST-related nucleic acids or fragments of positional segments of EST-related nucleic acids may be used to construct fusion vectors for the expression of chimeric polypeptides. The chimeric polypeptides comprise a first polypeptide portion and a second polypeptide portion. In the fusion vectors of the present invention, nucleic acids encoding the first polypeptide portion and the second polypeptide portion are joined in frame with one another so as to generate a nucleic acid encoding the chimeric polypeptide. The nucleic acid encoding the chimeric polypeptide is operably linked to a promoter which directs the expression of an mRNA encoding the chimeric polypeptide. The promoter may be in any of the expression vectors described herein including those described in Examples 20 and 46.

Preferably, the fusion vector is maintained in multiple copies in each host cell. In some embodiments, the multiple copies are maintained extrachromosomally. In other embodiments, the multiple copies result from amplification of a chromosomal sequence.

The first polypeptide portion may comprise any of the polypeptides encoded by the EST-related nucleic acids, positional segments of EST-related nucleic acids or fragments a of positional segments of EST-related nucleic acids. In some embodiments, the first polypeptide portion may be one of the EST-related polypeptides, fragments of EST-related polypeptides, positional segments of EST related polypeptides, or fragments of positional segments of EST-related polypeptides.

The second polypeptide portion may comprise any polypeptide of interest. In some embodiments, the second polypeptide portion may comprise a polypeptide having a detectable enzymatic activity such as green fluorescent protein or β galactosidase. Chimeric polypeptides in which the second polypeptide portion comprises a detectable polypeptide maybe used to determine the intracellular localization of the first polypeptide portion. In such procedures, the fusion vector encoding the chimeric polypeptide is introduced into a host cell under conditions which facilitate the expression of the chimeric polypeptide. Where appropriate, the cells are treated with a detection reagent which is visible under the microscope following a catalytic reaction with the detectable polypeptide and the cellular location of the detection reagent is determined. For example, if the polypeptide having a detectable enzymatic activity is β galactosidase, the cells may be treated with Xgal. Alternatively, where the detectable polypeptide is directly detectable without the addition of a detection reagent, the intracellular location of the chimeric polypeptide is determined by performing microscopy under conditions in which the dectable polypeptide is visible. For example, if the detectable polypeptide is green fluorescent protein or a modified version thereof, microscopy is performed by exposing the host cells to light having an appropriate wavelength to cause the green fluorescent protein or modified version thereof to fluoresce.

Alternatively, the second polypeptide portion may comprise a polypeptide whose isolation, purification, or enrichment is desired. In such embodiments, the isolation, purification, or enrichment of the second polypeptide portion may be achieved by performing the immunoaffinity chromatography procedures described below using an immunoaffinity column having an antibody directed against the first polypeptide portion coupled thereto.

The proteins encoded by the EST-related nucleic acids, positional segments of EST-related nucleic acids or fragments of positional segments of EST-related nucleic acids or the EST-related polypeptides, fragments of EST-related polypeptides, positional segments of EST-related polypeptides, or fragments of positional segments of EST-related polypeptides may also be used to generate antibodies as explained in Examples 20 and 33 in order to identify the tissue type or cell species from which a sample is derived as described in Example 48.

EXAMPLE 48

Identification of Tissue Types or Cell Species by Means of Labeled Tissue Specific Antibodies Identification of specific tissues is accomplished by the visualization of tissue specific antigens by means of antibody preparations according to Examples 20 and 33 which are conjugated, directly or indirectly to a detectable marker. Selected labeled antibody species bind to their specific antigen binding partner in tissue sections, cell suspensions, or in extracts of soluble proteins from a tissue sample to provide a pattern for qualitative or semiualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation.

Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

1. Immunohistochemical Techniques

Purified, high-titer antibodies, prepared as described above, are conjugated to a detectable marker, as described, for example, by Fudenberg, H., Chap. 26 in: *Basic Clinical Immunology*, $3^{rd}$ Ed. Lange, Los Altos, Calif. (1980) or Rose, et al., Chap. 12 in: *Methods in Immunodiagnosis*, 2d Ed. John Wiley and Sons, New York (1980), the disclosures of which are incorporated herein by reference.

A fluorescent marker, either fluorescein or rhodailne, is preferred, but antibodies can also be labeled with an enzyme that supports a color producing reaction with a substrate, such as horseradish peroxidase. Markers can be added to tissue-bound antibody in a second step, as described below. Alternatively, the specific antitissue antibodies can be labeled with ferritin or other electron dense particles, and localization of the ferritin coupled antigen-antibody complexes achieved by means of an electron microscope. In yet another approach, the antibodies are radiolabeled, with, for example 1251 and detected by overlaying the antibody treated preparation with photographic emulsion.

Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required.

Tissue sections and cell suspensions are prepared for immunohistochemical examination according to common histological techniques. Multiple cryostat sections (about 4 μm, unfixed) of the unknown tissue and known control, are mounted and each slide covered with different dilutions of the antibody preparation. Sections of known and unknown tissues should also be treated with preparations to provide a positive control, a negative control, for example, preimmune sera, and a control for non-specific staining, for example, buffer.

Treated sections are incubated in a humid chamber for 30 min at room temperature, rinsed, then washed in buffer for 30–45 min. Excess fluid is blotted away, and the marker developed.

If the tissue specific antibody was not labeled in the first incubation, it can be labeled at this time in a second antibody-antibody reaction, for example, by adding fluorescein- or enzyme-conjugated antibody against the immunoglobulin class of the antiserum-producing species, for example, fluorescein labeled antibody to mouse IgG. Such labeled sera are commercially available.

The antigen found in the tissues by the above procedure can be quantified by measuring the intensity of color or fluorescence on the tissue section, and calibrating that signal using appropriate standards.

2. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection.

A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifugation, and the soluble protein-containing fraction concentrated if necessary and reserved for analysis.

A sample of the soluble protein solution is resolved into individual protein species by conventional SDS polyacrylamide electrophoresis as described, for example, by Davis, L. et al., Section 19-2 in: *Basic Methods in Molecular Biology* (P. Leder, ed), Elsevier, New York (1986), the disclosure of which is incorporated herein by reference, using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 µl, and containing from about 1 to 100 µg protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis, L. et al., supra Section 19-3. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described in Examples 20 and 33. In this procedure, as in procedure A above, appropriate positive and negative sample and reagent controls are run.

In either procedure described above a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody.

EXAMPLE 49

Immunohistochemical Localization of Polypeptides

The antibodies prepared as described in Examples 20 and 33 above may be utilized to determine the cellular location of a polypeptide. The polypeptide may be any of the polypeptides encoded by EST-related nucleic acids, positional segments of EST-related nucleic acids or fragments of positional segments of EST-related nucleic acids or the polypeptide may be one of the EST-related polypeptides, fragments of EST-related polypeptides, positional segments of EST-related polypeptides, or fragments of positional segments of EST-related polypeptides. In some embodiments, the polypeptide may be a chimeric polypeptide such as those encoded by the fusion vectors of Example 47.

Cells expressing the polypeptide to be localized are applied to a microscope slide and fixed using any of the procedures typically employed in immunohistochemical localization techniques, including the methods described in *Current Protocols in Molecular Biology*, John Wiley and Sons, Inc. 1997. Following a washing step, the cells are contacted with the antibody. In some embodiments, the antibody is conjugated to a detectable marker as described above to facilitate detection. Alternatively, in some embodiments, after the cells have been contacted with an antibody to the polypeptide to be localized, a secondary antibody which has been conjugated to a detectable marker is placed in contact with the antibody against the polypeptide to be localized.

Thereafter, microscopy is performed under conditions suitable for visualizing the cellular location of the polypeptide.

The visualization of tissue specific antigen binding at levels above those seen in control tissues to one or more tissue specific antibodies, directed against the polypeptides encoded by EST-related nucleic acids, positional segments of EST-related nucleic acids or fragments of positional segments of EST-related nucleic acids or antibodies against the EST-related polypeptides, fragments of EST-related polypeptides, positional segments of EST-related polypeptides, or fragments of positional segments of EST-related polypeptides, can identify tissues of unknown origin, for example, forensic samples, or differentiated tumor tissue that has metastasized to foreign bodily sites.

The antibodies of Example 20 and 33 may also be used in the immunoaffinity chromatography techniques described below to isolate, purify or enrich the polypeptides encoded by the EST-related nucleic acids, positional segments of EST-related nucleic acids or fragments of positional segments of EST-related nucleic acids or to isolate, purify or enrich EST-related polypeptides, fragments of EST-related polypeptides, positional segments of EST-related polypeptides, or fragments of positional segments of EST-related polypeptides. The immunoaffinity chromatography techniques described below may also be used to isolate, purify or enrich polypeptides which have been linked to the polypeptides encoded by the EST-related nucleic acids, positional segments of EST-related nucleic acids or fragments of positional segments of EST-related nucleic acids or to isolate, purify or enrich polypeptides which have been linked to EST-related polypeptides, fragments of EST-related polypeptides, positional segments of EST-related polypeptides, or fragments of positional segments of EST-related polypeptides.

EXAMPLE 50

Immunoaffinity Chromatography

Antibodies prepared as described above are coupled to a support. Preferably, the antibodies are monoclonal antibodies, but,polyclonal antibodies may also be used. The support may be any of those typically employed in immunoaffinity chromatography, including Sepharose CLAB (Pharmacia, Piscataway, N.J.), Sepharose CL-2B (Pharmacia, Piscataway, N.J.), Affi-gel 10 (Biorad, Richmond, Calif.), or glass beads.

The antibodies may be coupled to the support using any of the coupling reagents typically used in immunoaffinity chromatography, including cyanogen bromide. After coupling the antibody to the support, the support is contacted with a sample which contains a target polypeptide whose isolation, purification or enrichment is desired. The target polypeptide may be a polypeptide encoded by the EST-related nucleic acids, positional segments of EST-related nucleic acids or fragments of positional segments of EST-related nucleic acids or the target polypeptide may be one of the EST-related polypeptides, fragments of EST-related polypeptides, positional segments of EST-related polypeptides, or fragments of positional segments of EST-related polypeptides. The target polypeptides may also be polypeptides which have been linked to the polypeptides encoded by the EST-related nucleic acids, positional segments of EST-related nucleic acids or fragments of positional segments of EST-related nucleic acids or the target polypeptides may be polypeptides which have been linked to EST-related polypeptides, fragments of EST-related polypeptides, positional segments of EST-related polypeptides, or fragments of positional segments of EST-related polypeptides using the fusion vectors described above.

Preferably, the sample is placed in contact with the support for a sufficient amount of time and under appropriate conditions to allow at least 50% of the target polypeptide to specifically bind to the antibody coupled to the support.

Thereafter, the support is washed with an appropriate wash solution to remove polypeptides which have non-specifically adhered to the support. The wash solution may be any of those typically employed in immunoaffinity chromatography, including PBS, Tris-lithium chloride buffer (0.1M lysine base and 0.5M lithium chloride, pH 8.0), Tris-hydrochloride buffer (0.05M Tris-hydrochloride, pH 8.0), or Tris/Triton/NaCl buffer (50 mM Tris.cl, pH 8.0 or 9.0, 0. 1% Triton X-100, and 0.5MNaCl).

After washing, the specifically bound target polypeptide is eluted from the support using the high pH or low pH elution solutions typically employed in immunoaffinity chromatography. In particular, the elution solutions may contain an eluant such as triethanolamine, diethylamine, calcium chloride, sodium thiocyanate, potasssium bromide, acetic acid, or glycine. In some embodiments, the elution solution may also contain a detergent such as Triton X-100 or octyl-β-D-glucoside.

The EST-related nucleic acids, positional segments of EST-related nucleic acids or fragments of positional segments of EST-related nucleic acids may also be used to clone sequences located upstream of the 5' ESTs which are capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion. Example 51 describes a method for cloning sequences upstream of the EST-related nucleic acids, positional segments of EST-related nucleic acids or fragments of positional segments of EST-related nucleic acids.

2. Identification of Upstream Sequences With Promoting or Regulatory Activities

EXAMPLE 51

Use of EST-related Nucleic Acids, Positional Segments of EST-related Nucleic Acids or Fragments of Positional Segments of EST-related Nucleic Acids to Clone Upstream Sequences From Genomic DNA Sequences derived from EST-related nucleic acids, positional segments of EST-related nucleic acids or fragments of positional segments of EST-related nucleic acids may be used to isolate the promoters of the corresponding genes using chromosome walking techniques. In one chromosome walking technique, which utilizes the GenomeWalker™ kit available from Clontech, five complete genomic DNA samples are each digested with a different restriction enzyme which has a 6 base recognition site and leaves a blunt end.

Following digestion, oligonucleotide adapters are ligated to each end of the resulting genomic DNA fragments.

For each of the five genomic DNA libraries, a first PCR reaction is performed according to the manufacturer's instructions (which are incorporated herein by reference) using an outer adapter primer provided in the kit and an outer gene specific primer. The gene specific primer should be selected to, be specific for 5' EST of interest and should have a melting temperature, length, and location in the EST-related nucleic acids, positional segments of EST-related nucleic acids or fragments of positional segments of EST-related nucleic acids which is consistent with its use in PCR reactions. Each first PCR reaction contains 5ng of genomic DNA, 5 µl of 10×Tth reaction buffer, 0.2 mM of each DNTP, 0.2 µM each of outer adapter primer and outer gene specific primer, 1.1 mM of $Mg(OAc)_2$, and 1 µl of the Tth polymerase 50×mix in a total volume of 50 µl. The reaction cycle for the first PCR reaction is as follows: 1 min at 94° C./2 sec at 94° C., 3 min at 72° C. (7 cycles)/2 sec at 94° C., 3 min at 67° C. (32 cycles)/5 min at 67° C.

The product of the first PCR reaction is diluted and used as a template for a second PCR reaction according to the manufacturer's instructions using a pair of nested primers which are located internally on the amplicon resulting from the first PCR reaction. For example, 5 µl of the reaction product of the first PCR reaction mixture may be diluted 180 times. Reactions are made in a 50 µl volume having a composition identical to that of the first PCR reaction except the nested primers are used. The first nested primer is specific for the adapter, and is provided with the GenomeWalker™ kit. The second nested primer is specific for the particular EST-related nucleic acids, positional segments of EST-related nucleic acids or fragments of positional segments of EST-related nucleic acids for which the promoter is to be cloned and should have a melting temperature, length, and location in the EST-related nucleic acids, positional segments of EST-related nucleic acids or fragments of positional segments of EST-related nucleic acids which is consistent with its use in PCR reactions. The reaction parameters of the second PCR reaction are as follows: 1 min at 94° C./2 sec at 94° C., 3 min at 72° C. (6 cycles)/2 sec at 94° C., 3 min at 67° C. (25 cycles)/5 min at −67° C. The product of the second PCR reaction is purified, cloned, and sequenced using standard techniques.

Alternatively, two or more human genomic DNA libraries can be constructed by using two or more restriction enzymes. The digested genomic DNA is cloned into vectors which can be converted into single stranded, circular, or linear DNA. A biotinylated oligonucleotide comprising at least 15 nucleotides from the EST-related nucleic acids, positional segments of EST-related nucleic acids or fragments of positional segments of EST-related nucleic acids sequence is hybridized to the single stranded DNA. Hybrids between the biotinylated oligonucleotide and the single stranded DNA containing the EST-related nucleic acids, positional segments of EST-related nucleic acids or fragments of positional segments of EST-related nucleic acids are isolated as described above. Thereafter, the single stranded DNA containing the EST-related nucleic acids, positional segments of EST-related nucleic acids or fragments of positional segments of EST-related nucleic acids is released from the beads and converted into double stranded DNA using a primer specific for the EST-related nucleic acids, positional segments of EST-related nucleic acids or fragments of positional segments of EST-related nucleic acids or a primer corresponding to a sequence included in the cloning vector. The resulting double stranded DNA is transformed into bacteria. cDNAs containing the EST-related nucleic acids, positional segments of EST-related nucleic acids or fragments of positional segments of EST-related nucleic acids are identified by colony PCR or colony hybridization.

Once the upstream genomic sequences have been cloned and sequenced as described above, prospective promoters and transcription start sites within the upstream sequences may be identified by comparing the sequences upstream of the EST-related nucleic acids, positional segments of EST-related nucleic acids or fragments of positional segments of EST-related nucleic acids with databases containing known transcription start sites, transcription factor binding sites, or promoter sequences.

In addition, promoters in the upstream sequences may be identified using promoter reporter vectors as described in Example 53.

EXAMPLE 53

Identification of Promoters in Cloned Upstream Sequences

The genomic sequences upstream of the EST-related nucleic acids, positional segments of EST-related nucleic acids or fragments of positional segments of EST-related nucleic acids are cloned into a suitable promoter reporter vector, such as the pSEAP-Basic, pSEAP-Enhancer, pβgal-Basic, pβgal-Enhancer, or pEGFP-1 Promoter Reporter vectors available from Clontech. Briefly, each of these promoter reporter vectors include multiple cloning sites positioned upstream of a reporter gene encoding a readily assayable protein such as secreted alkaline phosphatase, β galactosidase, or green fluorescent protein. The sequences upstream of the EST-related nucleic acids, positional segments of EST-related nucleic acids or fragments of positional segments of EST-related nucleic acids are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for augmenting transcription levels from weak promoter sequences. A significant level of expression above that observed with the vector lacking an insert indicates that a promoter sequence is present in the inserted upstream sequence.

Appropriate host cells for the promoter reporter vectors may be chosen based on the results of the above described determination of expression patterns of the EST-related nucleic acids, positional segments of EST-related nucleic acids or fragments of positional segments of EST-related nucleic acids. For example, if the expression pattern analysis indicates that the mRNA corresponding to a particular EST-related nucleic acids, positional segments of EST-related nucleic acids or fragments of positional segments of EST-related nucleic acids is expressed in fibroblasts, the promoter reporter vector may be introduced into a human fibroblast cell line.

Promoter sequences within the upstream genomic DNA may be further defined by constructing nested deletions in the upstream DNA using conventional techniques such as Exonuclease III digestion. The resulting deletion fragments can be inserted into the promoter reporter vector to determine whether the deletion has reduced or obliterated promoter activity. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into the cloning sites in the promoter reporter vectors.

EXAMPLE 54

Cloning and Identification of Promoters

Using the method described in Example 51 above with 5' ESTs, sequences upstream of several genes were obtained. Using the primer pairs GGG AAG ATG GAG ATA GTA TTG CCT G (SEQ ED NO:15) and CTG CCA TGT ACA TGA TAG AGA GAT TC (SEQ ID NO:16), the promoter having the internal designation P13H2 (SEQ ID NO:17) was obtained.

Using the primer pairs GTA CCA GGGG ACT GTG ACC ATT GC (SEQ ID NO:18) and CTG TGA CCA TTG CTC CCA AGA GAG (SEQ ID NO:19), the promoter having the internal designation P15B4 (SEQ ID NO:20) was obtained.

Using the primer pairs CTG GGA TGG AAG GCA CGG TA (SEQ ID NO:21) and GAG ACC ACA CAG CTA GAC AA (SEQ ID NO:22), the promoter having the internal designation P29B6 (SEQ ID NO:23) was obtained.

Figure 4:
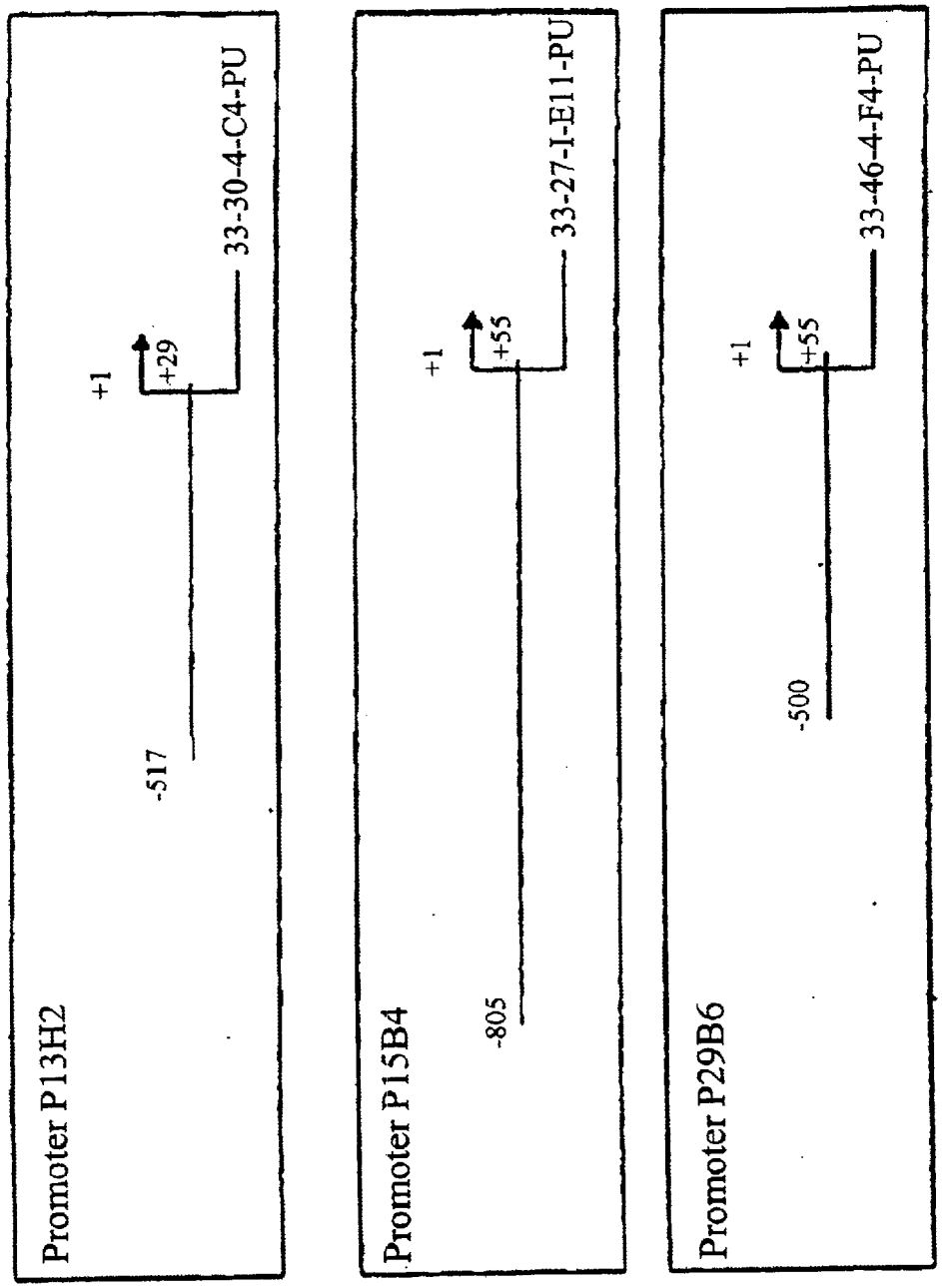
FIG. 4 provides a schematic description of the promoters isolated and the way they are assembled with the corresponding 5' tags.

FIG. 4 provides a schematic description of the promoters isolated and the way they are assembled with the corresponding 5' tags. The upstream sequences were screened for the presence of motifs resembling transcription factor binding sites or known transcription start sites using the computer program MatInspector release 2.0, August 1996.

FIG. 5 describes the transcription factor binding sites present in each of these promoters. The columns labeled matrice provides the name of the MatInspector matrix used. The column labeled position provides the 5' position of the promoter site. Numeration of the sequence starts from the transcription site as determined by matching the genomic sequence with the 5' EST sequence. The column labeled "orientation" indicates the DNA strand on which the site is found, with the + strand being the coding strand as determined by matching the genomic sequence with the sequence of the 5' EST. The column labeled "score" provides the MatInspector score found for this site. The column labeled "length" provides the length of the site in nucleotides. The column labeled "sequence" provides the sequence of the site found.

Bacterial clones containing plasmids containing the promoter sequences described above described above are presently stored in the inventor's laboratories under the internal identification numbers provided above. The inserts may be recovered from the deposited materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifigation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the inserted EST-related nucleic acids, positional segments of EST-related nucleic acids or fragments of positional segments of EST-related nucleic acids. The PCR product which corresponds to the EST-related nucleic acids, positional segments of EST-related nucleic acids or fragments of positional segments of EST-related nucleic acids can then be manipulated using standard cloning techniques familiar to those skilled in the art.

The promoters and other regulatory sequences located upstream of the EST-related nucleic acids, positional segments of EST-related nucleic acids or fragments of positional segments of EST-related nucleic acids may be used to design expression vectors capable of directing the expression of an inserted gene in a desired spatial, temporal, developmental, or quantitative manner. A promoter capable of directing the desired spatial, temporal, developmental, and quantitative patterns may be selected using the results of the expression analysis described above. For example, if a promoter which confers a high level of expression in muscle is desired, the promoter sequence upstream of EST-related nucleic acids, positional segments of EST-related nucleic acids or fragments of positional segments of EST-related nucleic acids derived from an mRNA which are expressed at a high level in muscle, as determined by the methods above, may be used in the expression vector.

Preferably, the desired promoter is placed near multiple restriction sites to facilitate the cloning of the desired insert downstream of the promoter, such that the promoter is able to drive expression of the inserted gene. The promoter may be inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted into the expression vector.

Following the identification of promoter sequences using the procedures of Examples 51–54, proteins which interact with the promoter may be identified as described in Example 55 below.

EXAMPLE 55

Identification of Proteins Which Interact With Promoter Sequences, Upstream Regulatory Sequences, or mRNA Sequences within the promoter region which are likely to bind transcription factors may be identified by homology to known transcription factor binding sites or through conventional mutagenesis or deletion analyses of reporter plasmids containing the promoter sequence. For example, deletions may be made in a reporter plasmid containing the promoter sequence of interest operably linked to an assayable reporter gene. The reporter plasmids carrying various deletions within the promoter region are transfected into an appropriate host cell and the effects of the deletions on expression levels is assessed. Transcription factor binding sites within the regions in which deletions reduce expression levels may be further localized using site directed mutagenesis, linker scanning analysis, or other techniques familiar to those skilled in the art.

Nucleic acids encoding proteins which interact with sequences in the promoter may be identified using one-hybrid systems such as those described in the manual accompanying the Matchmaker One-Hybrid System kit available from Clontech (Catalog No. K1603-1), the disclosure of which is incorporated herein by reference. Briefly, the Matchmaker One-hybrid system is used as follows. The target sequence for which it is desired to identify binding proteins is cloned upstream of a selectable reporter gene and integrated into the yeast genome. Preferably, multiple copies of the target sequences are inserted into the reporter plasmid in tandem. A library comprised of fusions between cDNAs to be evaluated for the ability to bind to the promoter and the activation domain of a yeast transcription factor, such as GAL4, is transformed into the yeast strain containing the integrated reporter sequence. The yeast are plated on selective media to select cells expressing the selectable marker linked to the promoter sequence. The colonies which grow on the selective media contain genes encoding proteins which bind the target sequence. The inserts in the genes encoding the fusion proteins are further characterized by sequencing. In addition, the inserts may be inserted into expression vectors or in vitro transcription vectors. Binding of the polypeptides encoded by the inserts to the promoter DNA may be confirmed by techniques familiar to those skilled in the art, such as gel shift analysis or DNAse protection analysis.

VII. Use of EST-related Nucleic Acids, Positional Segments of EST-related Nucleic Acids or Fragments of Positional Segments of EST-related Nucleic Acids In Gene Therapy The present invention also comprises the use of EST-related nucleic acids, positional segments of EST-related nucleic acids or fragments of positional segments of EST-related nucleic acids in gene therapy strategies, including antisense and triple helix strategies as described in Examples 56 and 57 below. In antisense approaches, nucleic acid sequences complementary to an mRNA are hybridized to the mRNA intracellularly, thereby blocking the expression of the protein encoded by the mRNA. The antisense sequences may prevent gene expression through a variety of mechanisms. For example, the antisense sequences may inhibit the ability of ribosomes to translate the mRNA. Alternatively, the antisense sequences may block transport of the mRNA from the nucleus to the cytoplasm, thereby limiting the amount of mRNA available for translation. Another mechanism through which antisense sequences may inhibit gene expression is by interfering with mRNA splicing. In yet another strategy, the anti sense nucleic acid may be incorporated in a ribozyme capable of specifically cleaving the target mRNA.

EXAMPLE 56

Preparation and Use of Antisense Oligonucleotides

The antisense nucleic acid molecules to be used in gene therapy may be either DNA or RNA sequences. They may comprise a sequence complementary to the sequence of the EST-related nucleic acids, positional segments of EST-related nucleic acids or fragments of positional segments of EST-related nucleic acids. The antisense nucleic acids should have a length and melting temperature sufficient to permit formation of an intracellular duplex with sufficient stability to inhibit the expression of the mRNA in the duplex. Strategies for designing antisense nucleic acids suitable for use in gene therapy are disclosed in Green et al., *Ann. Rev. Biochem.* 55:569–597 (1986) and Izant and Weintraub, *Cell* 36:1007–1015 (1984), which are hereby incorporated by reference.

In some strategies, antisense molecules are obtained from a nucleotide sequence encoding a protein by reversing the orientation of the coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of the antisense nucleic acids in vivo by operably linking DNA containing the antisense sequence to a promoter in an expression vector.

Alternatively, oligonucleotides which are complementary to the strand normally transcribed in the cell may be synthesized in vitro. Thus, the antisense nucleic acids are A complementary to the corresponding mRNA and are capable of hybridizing to the mRNA to create a duplex. In some embodiments, the antisense sequences may contain modified sugar phosphate backbones to increase stability and make them less sensitive to RNase activity. Examples of modifications suitable for use in antisense strategies are described by Rossi et al., *Pharmacol. Ther.* 50(2):245–254, (1991) which is hereby incorporated by reference.

Various types of antisense oligonucleotides complementary to the sequence of the EST-related nucleic acids, positional segments of EST-related nucleic acids or fragments of positional segments of EST-related nucleic acids may be used. In one preferred embodiment, stable and semi-stable antisense oligonucleotides described in International Application No. PCT WO94/23026, hereby incorporated by reference, are used. In these molecules, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides against herpes simplex virus types 1 and 2 described in International Application No. WO 95/04141, hereby incorporated by reference, are used.

In yet another preferred embodiment, the covalently cross-linked antisense oligonucleotides described in International Application No. WO 96/31523, hereby incorporated by reference, are used. These double- or single-stranded oligonucleotides comprise one or more, respectively, inter- or intra-oligonucleotide covalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, incorporated by reference, may also be used. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, hereby incorporated by reference are used. These ligated oligonucleotide "dumbbells" contain the binding site for a transcription factor and inhibit expression of the gene under control of the transcription factor by sequestering the factor.

Use of the closed antisense oligonucleotides disclosed in International Application No. WO 92/19732, hereby incorporated by reference, is also contemplated. Because these molecules have no free ends, they are more resistant to degradation by exonucleases than are conventional oligonucleotides. These oligonucleotides may be multifunctional, interacting with several regions which are not adjacent to the target mRNA.

The appropriate level of antisense nucleic acids required to inhibit gene expression may be determined using in vitro expression analysis. The antisense molecule may be introduced into the cells by diffusion, injection, infection or transfection using procedures known in the art. For example, the antisense nucleic acids can be introduced into the body as a bare or naked oligonucleotide, oligonucleotide encapsulated in lipid, oligonucleotide sequence encapsidated by viral protein, or as an oligonucleotide operably linked to a promoter contained in an expression vector. The expression vector may be any of a variety of expression vectors known in the art, including retroviral or viral vectors, vectors capable of extrachromosomal replication, or integrating vectors. The vectors may be DNA or RNA.

The antisense molecules are introduced onto cell samples at a number of different concentrations preferably between $1 \times 10^{-10}$M to $1 \times 10^{-4}$M. Once the minimum concentration that can adequately control gene expression is identified, the optimized dose is translated into a dosage suitable for use in vivo. For example, an inhibiting concentration in culture of $1 \times 10^{-7}$ translates into a dose of approximately 0.6 mg/kg bodyweight. Levels of oligonucleotide approaching 100 mg/kg bodyweight or higher may be possible after testing the toxicity of the oligonucleotide in laboratory animals. It is additionally contemplated that cells from the vertebrate are removed, treated with the antisense oligonucleotide, and reintroduced into the vertebrate.

It is further contemplated that the antisense oligonucleotide sequence is incorporated into a ribozyme sequence to enable the antisense to specifically bind and cleave its target mRNA. For technical applications of ribozyme and antisense oligonucleotides see Rossi et al., supra.

In a preferred application of this invention, the polypeptide encoded by the gene is first identified, so that the effectiveness of antisense inhibition on translation can be monitored using techniques that include but are not limited to antibody-mediated tests such as RIAs and ELISA, functional assays, or radiolabeling.

The EST-related nucleic acids, positional segments of EST-related nucleic acids or fragments of positional segments of EST-related nucleic acids may also be used in gene therapy approaches based on intracellular triple helix formation. Triple helix oligonucleotides are used to inhibit transcription from a genome. They are particularly useful for studying alterations in cell activity as it is associated with a particular gene. The EST-related nucleic acids, positional segments of EST-related nucleic acids or fragments of positional segments of EST-related nucleic acids of the present invention or, more preferably, a portion of those sequences, can be used to inhibit gene expression in individuals having diseases associated with expression of a particular gene. Similarly, the EST-related nucleic acids, positional segments of EST-related nucleic acids or fragments of positional segments of EST-related nucleic acids can be used to study the effect of inhibiting transcription of a particular gene within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from the EST-related nucleic acids, positional segments of EST-related nucleic acids or fragments of positional segments of EST-related nucleic acids are contemplated within the scope of this invention.

EXAMPLE 57

Preparation and Use of Triple Helix Probes

The sequences of the EST-related nucleic acids, positional segments of EST-related nucleic acids or fragments of positional segments of EST-related nucleic acids are scanned to identify 10-mer to 20-mer homopyrimidine or homopurine stretches which could be used in triple-helix based strategies for inhibiting gene expression. Following identification of candidate homopyrmidine or homopurine stretches, their efficiency in inhibiting gene expression is assessed by introducing varying amounts of oligonucleotides containing the candidate sequences into tissue culture cells which normally express the target gene. The oligonucleotides may be prepared on an oligonucleotide synthesizer or they may be purchased commercially from a company specializing in custom oligonucleotide synthesis, such as GENSET, Paris, France.

The oligonucleotides may be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced gene expression using techniques such as Northern blotting, RNase protection assays, or PCR based strategies to monitor the transcription levels of the target gene in cells which have been treated with the oligonucleotide. The cell functions to be monitored are predicted based upon the homologies of the target genes corresponding to the EST-related nucleic acids, positional segments of EST-related nucleic acids or fragments of positional segments of EST-related nucleic acids from which the oligonucleotide were derived with known gene sequences that have been associated with a particular function. The cell functions can also be predicted based on the presence of abnormal physiologies within cells derived from individuals with a particular inherited disease, particularly when the EST-related nucleic acids, positional segments of EST-related nucleic acids or fragments of positional segments of EST-related nucleic acids are associated with the disease using techniques described herein.

The oligonucleotides which are effective in inhibiting gene expression in tissue culture cells may then be introduced in vivo using the techniques described above and in Example 56 at a dosage calculated based on the in vitro results, as described in Example 56.

In some embodiments, the natural (beta) anomers of the oligonucleotide units can be replaced with alpha anomers to render the oligonucleotide more resistant to nucleases. Further, an intercalating agent such as ethidirum bromide, or the like, can be attached to the 3' end of the alpha oligonucleotide to stabilize the triple helix. For information on the generation of oligonucleotides suitable for triple helix formation see Griffin et al. (*Science* 245:967–971 (1989), which is hereby incorporated by this reference).

EXAMPLE 58

Use of EST-related Nucleic acids, Positional Segments of EST-related Nucleic Acids or Fragments of Positional Segments of EST-related Nucleic Acids to Express an Encoded Protein in a Host Organism The EST-related nucleic acids, positional segments of EST-related nucleic acids or fragments of positional segments of EST-related nucleic acids may also be used to express an encoded protein or polypeptide in a host organism to produce a beneficial effect. In addition, nucleic acids encoding the EST-related polypeptides, positional segments of EST-related polypeptides or fragments of positional segments of EST-related polypeptides may be used to express the encoded protein or polypeptide in a host organism to produce a beneficial effect.

In such procedures, the encoded protein or polypeptide may be transiently expressed in the host organism or stably expressed in the host organism. The encoded protein or polypeptide may have any of the activities described above. The encoded protein or polypeptide may be a protein of polypeptide which the host organism lacks or, alternatively, the encoded protein may augment the existing levels of the protein in the host organism.

In some embodiments in which the protein or polypeptide is secreted, nucleic acids encoding the full length protein (i.e. the signal peptide and the mature protein), or nucleic acids encoding only the mature protein (i.e. the protein generated when the signal peptide is cleaved off) is introduced into the host organism.

The nucleic acids encoding the proteins or polypeptides may be introduced into the host organism using a variety of techniques known to those of skill in the art. For example, the extended cDNA may be injected into the host organism as naked DNA such that the encoded protein is expressed in the host organism, thereby producing a beneficial effect.

Alternatively, the nucleic acids encoding the protein or polypeptide may be cloned into an expression vector downstream of a promoter which is active in the host organism. The expression vector may be any of the expression vectors designed for use in gene therapy, including viral or retroviral vectors. The expression vector may be directly introduced into the host organism such that the encoded protein is expressed in the host organism to produce a beneficial effect. In another approach, the expression vector may be introduced into cells in vitro. Cells containing the expression vector are thereafter selected and introduced into the host organism, where they express the encoded protein or polypeptide to produce a beneficial effect.

EXAMPLE 59

Use of Signal Peptides to Import Proteins Into Cells

The short core hydrophobic region (h) of signal peptides encoded by the sequences of SEQ ID NOs: 24–652 and 3721–3811 may also be used as a carrier to import a peptide or a protein of interest, so-called cargo, into tissue culture cells (Lin et al., *J. Biol. Chem.*, 270: 14225–14258 (1995); Du et al., *J. Peptide Res.*, 51: 235–243 (1998); Rojas et al., *Nature Biotech.*, 16: 370–375 (1998)).

When cell permeable peptides of limited size (approximately up to 25 amino acids) are to be translocated across cell membrane, chemical synthesis may be used in order to add the h region to either the C-terminus or the N-terminus to the cargo peptide of interest Alternatively, when longer peptides or proteins are to be imported into cells, nucleic acids can be genetically engineered, using techniques familiar to those skilled in the art, in order to link the extended cDNA sequence encoding the h region to the 5' or the 3' end of a DNA sequence coding for a cargo polypeptide. Such genetically engineered nucleic acids are then translated either in vitro or in vivo after transfection into appropriate cells, using conventional techniques to produce the resulting cell permeable polypeptide. Suitable hosts cells are then simply incubated with the cell permeable polypeptide which is then translocated across the membrane.

This method may be applied to study diverse intracellular functions and cellular processes. For instance, it has been used to probe functionally relevant domains of intracellular proteins and to examine protein-protein interactions involved in signal transduction pathways (Lin et al., supra; Lin et al., *J. Biol. Chem.*, 271: 5305–5308 (1996); Rojas et al., *J. Biol. Chem.*, 271: 27456–27461 (1996); Liu et al., *Proc. Natl. Acad. Sci. USA*, 93: 11819–11824 (1996); Rojas et al., *Bioch. Biophys. Res. Commun.*, 234: 675–680 (1997)).

Such techniques may be used in cellular therapy to import proteins producing therapeutic effects. For instance, cells isolated from a patient may be treated with imported therapeutic proteins and then re-introduced into the host organism.

Alternatively, the h region of signal peptides of the present invention could be used in combination with a nuclear localization'signal to deliver nucleic acids into cell nucleus. Such oligonucleotides may be antisense oligonucleotides or oligonucleotides designed to form triple helixes, as described above, in order to inhibit processing and maturation of a target cellular RNA.

EXAMPLE 60

Computer Embodiments

As used herein the term "nucleic acid codes of SEQ ID NOs: 24–4100 and 8178–36681" encompasses the nucleotide sequences of SEQ ID NOs: 24–4100 and 8178–36681, fragments of SEQ ID NOs: 24–4100 and 8178–36681, nucleotide sequences homologous to SEQ ID NOs: 24–4100 and 8178–36681 or homologous to fragments of SEQ ID NOs: 24–4100 and 8178–36681, and sequences complementary to all of the preceding sequences. The fragments include portions of SEQ ID NOs: 24–4100 and 8178–36681 comprising at least 10, 15, 20, 25, 30, 35, 40, 50, 75, 100, 150, 200, 300, 400, or 500 consecutive nucleotides of SEQ ID NOs: 24–4100 and 8178–36681. Preferably, the fragments are novel fragments. Homologous sequences and fragments of SEQ ID NOs: 24–4100 and 8178–36681 refer to a sequence having at least 99%, 98%, 97%, 96%, 95%, 90%, 85%, 80%, or 75% homology to these sequences. Homology may be determined using any of the computer programs and parameters described in Example 18, including BLAST2N with the default parameters or with any modified parameters. Homologous sequences also include RNA sequences in which uridines replace the thymines in the nucleic acid codes of SEQ ID NOs: 24–4100 and 8178–36681. The homologous sequences may be obtained using any of the procedures described herein or may result from the correction of a sequencing error as described above. It will be appreciated that the nucleic acid codes of SEQ ID NOs: 24–4100 and 8178–36681 can be represented in the traditional single character format (See the inside back cover of Starrier, Lubert. *Biochemistry*, 3$^{rd}$ edition. W. H Freeman & Co., New York.) or in any other format which records the identity of the nucleotides in a sequence.

As used herein the term "polypeptide codes of SEQ ID NOs: 4101–8177" encompasses the polypeptide sequence of SEQ ID NOs: 4101–8177 which are encoded by the 5' EST s of SEQ ID NOs: 24–4100 and 8178–36681, polypeptide sequences homologous to the polypeptides of SEQ ID NOs: 4101–8177, or fragments of any of the preceding sequences. Homologous polypeptide sequences refer to a polypeptide sequence having at least 99%, 98%, 97%, 96%, 95%, 90%, 85%, 80%, 75% homology to one of the polypeptide sequences of SEQ ID NOs: 4101–8177. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 5, 10, 15, 20, 25, 30, 35, 40, 50, 75, 100, or 150 consecutive amino acids of the polypeptides of SEQ ID NOs: 4101–8177. Preferably, the fragments are novel fragments. It will be appreciated that the polypeptide codes of the SEQ ID NOs: 4101–8177 can be represented in the traditional single character format or three letter format (See the inside back cover of Starrier, Lubert. *Biochemistry*, 3$^{rd}$ edition. W. H Freeman & Co., New York.) or in any other format which relates the identity of the polypeptides in a sequence.

It will be appreciated by those skilled in the art that the nucleic acid codes of SEQ ID NOs: 24–4100 and 8178–36681 and polypeptide codes of SEQ ID NOs: 4101–8177 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of SEQ ID NOs: 24–4100 and 8178–36681, one or more of the polypeptide codes of SEQ ID NOs: 4101–8177. Another aspect of the present invention is a computer readable medium having recorded thereon at least 2, 5, 10, 15, 20, 25, 30, or 50 nucleic acid codes of SEQ ID NOs: 24–4100 and 8178–36681. Another aspect of the present invention is a computer readable medium having recorded thereon at least 2, 5, 10, 15, 20, 25, 30, or 50 polypeptide codes of SEQ ID NOs: 4101–8177.

Computer readable media include magnetically readable media, optically readable media, electronically readable media and magnetic/optical media. For example, the computer readable media may be a hard disc, a floppy disc, a magnetic tape, CD-ROM, DVD, RAM, or ROM as well as other types of other media known to those skilled in the art.

Embodiments of the present invention include systems, particularly computer systems which contain the sequence information described herein. As used herein, "a computer system" refers to the hardware components, software components, and data storage components used to analyze the nucleotide sequences of the nucleic acid codes of SEQ ID NOs: 24–4100 and 8178–36681, or the amino acid sequences of the polypeptide codes of SEQ ID NOs: 4101–8177. The computer system preferably includes the computer readable media described above, and a processor for accessing and manipulating the sequence data.

Preferably, the computer is a general purpose system that comprises a central processing unit (CPU), one or more data storage components for storing data, and one or more data retrieving devices for retrieving the data stored on the data storage components. A skilled artisan can readily appreciate that any one of the currently available computer systems are suitable.

In one particular embodiment, the computer system includes a processor connected to a bus which is connected to a main memory (preferably implemented as RAM) and one or more data storage devices, such as a hard drive and/or other computer readable media having data recorded thereon. In some embodiments, the computer system further includes one or more data retrieving devices for reading the data stored on the data storage components. The data retrieving device may represent, for example, a floppy disk drive, a compact disk drive, a magnetic tape drive, etc. In some embodiments, the data storage component is a removable computer readable medium such as a floppy disk, a compact disk, a magnetic tape, etc. containing control logic and/or data recorded thereon. The computer system may advantageously include or be programmed by appropriate software for reading the control logic and/or the data from the data storage component once inserted in the data retrieving device. Software for accessing and processing the nucleotide sequences of the nucleic acid codes of SEQ D NOs: 24–4100 and 8178–36681, or the amino acid sequences of the polypeptide codes of SEQ ID NOs: 4101–8177 (such as search tools, compare tools, and modeling tools etc.) may reside in main memory during execution.

In some embodiments, the computer system may further comprise a sequence comparer for comparing the above-described nucleic acid codes of SEQ ID NOs: 24–4100 and 8178–36681 or polypeptide codes of SEQ ID NOs: 4101–8177 stored on a computer readable medium to reference nucleotide or polypeptide sequences stored on a computer readable medium. A "sequence comparer" refers to one or more programs which are implemented on the computer system to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of SEQ ID NOs: 24–4100 and 8178–36681, or the amino acid sequences of the polypeptide codes of SEQ ID NOs: 4101–8177 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

Accordingly, one aspect of the present invention is a computer system comprising a processor, a data storage device having stored thereon a nucleic acid code of SEQ ID NOs: 24–4100 and 8178–36681 or a polypeptide code of SEQ ID NOs: 4101–8177, a data storage device having retrievably stored thereon reference nucleotide sequences or polypeptide sequences to be compared to the nucleic acid code of SEQ ID NOs: 24–4100 and 8178–36681 or polypeptide code of SEQ ID NOs: 4101–8177 and a sequence comparer for conducting the comparison. The sequence comparer may indicate a homology level between the sequences compared or identify structural motifs in the above described nucleic acid code of SEQ ID NOs: 24–4100 and 8178–36681 and polypeptide codes of SEQ ID NOs: 4101 8177 or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of SEQ ID NOs: 24–4100 and 8178–36681 or polypeptide codes of SEQ ID NOs: 4101–8177.

Another aspect of the present invention is a method for determining the level of homology between a nucleic acid code of SEQ ID NOs: 24–4100 and 8178–36681 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of SEQ ID NOs: 24–4100 and 8178–36681 through use of the computer program and determining homology between the nucleic acid codes and reference nucleotide sequences.

Alternatively, the computer program may be a computer program which compares the nucleotide sequences of the nucleic acid codes of the present invention, to reference nucleotide sequences in order to determine whether the nucleic acid code of SEQ ID NOs: 24–4100 and 8178–36681 differs from a reference nucleic acid sequence at one or more positions. Optionally such a program records the length and identity of inserted, deleted or substituted nucleotides with respect to the sequence of either the reference polynucleotide or the nucleic acid code of SEQ ID NOs: 24–4100 and 8178–36681. In one embodiment, the computer program may be a program which determines whether the nucleotide sequences of the nucleic acid codes of SEQ ID NOs: 24–4100 and 8178–36681 contain a single nucleotide polymorphism (SNP) with respect to a reference nucleotide sequence. This single nucleotide polymorphism may comprise a single base substitution, insertion, or deletion.

Another aspect of the present invention is a method for determining the level of homology between a polypeptide code of SEQ ID NOs: 4101–8177 and a reference polypeptide sequence, comprising the steps of reading the polypeptide code of SEQ ID NOs: 4101–8177 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID NOs: 24–4100 and 8178–36681 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above. The method may also be performed by reading at least 2, 5, 10, 15, 20, 25, 30, or 50 of the nucleic acid codes of SEQ ID NOs: 24–4100 and 8178–36681 and the reference nucleotide sequences through the use of the computer program and identifying differences between the nucleic acid codes and the reference nucleotide sequences with the computer program.

In other embodiments the computer based system may further comprise an identifier for identifying features within the nucleotide sequences of the nucleic acid codes of SEQ ID NOs: 24–4100 and 8178–36681 or the amino acid sequences of the polypeptide codes of SEQ ID NOs: 4101–8177.

An "identifier" refers to one or more programs which identifies certain features within the above-described nucleotide sequences of the nucleic acid codes of SEQ ID NOs: 24–4100 and 8178–36681 or the amino acid sequences of the polypeptide codes of SEQ ID NOs: 4101–8177. In one embodiment, the identifier may comprise a program which identifies an open reading frame in the cDNAs codes of SEQ ID NOs: 24–4100 and 8178–36681.

In another embodiment, the identifier may comprise a molecular modeling program which determines the 3-dimensional structure of the polypeptides codes of SEQ ID NOs: 4101–8177. In some embodiments, the molecular modeling program identifies target sequences that are most compatible with profiles representing the structural environments of the residues in known three-dimensional protein structures. (See, e.g., Eisenberg et al., U.S. Pat. No. 5,436, 850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID NOs: 4101–8177. (See e.g., Srinivasan, et al., U.S. Pat. No. 5,557,535 issued Sep. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszodi et al., Proteins: Structure, Function, and Genetics, Supplement 1:38–42 (1997)).

The results of the molecular modeling analysis may then be used in rational drug design techniques to identify agents which modulate the activity of the polypeptide codes of SEQ ID NOs: 4101–8177.

Accordingly, another aspect of the present invention is a method of identifying a feature within the nucleic acid codes of SEQ ID NOs: 24–4100 and 8178–36681 or the polypeptide codes of SEQ ID NOs: 4101–8177 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of SEQ ID NOs: 24–4100 and 8178–36681 or the polypeptide codes of SEQ ID NOs: 4101–8177 through the use of the computer program and identifying features within the nucleic acid codes or polypeptide codes with the computer program.

The nucleic acid codes of SEQ ED NOs: 24–4100 and 8178–36681 or the polypeptide codes of SEQ ID NOs: 4101–8177 may be stored and manipulated in a variety of data processor programs in a variety of formats. For example, the nucleic acid codes of SEQ ID NOs: 24–4100 and 8178–36681 or the polypeptide codes of SEQ ID NOs: 4101–8177 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of SEQ ID NOs: 24–4100 and 8178–36681 or the polypeptide codes of SEQ ID NOs: 4101–8177. The following list is intended not to limit the invention but to provide guidance to programs and databases which are useful with the nucleic acid codes of SEQ ID NOs: 24–4100 and 8178–36681 or the polypeptide codes of SEQ ID NOs: 4101–8177. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990)), FASTA (Pearson and Lipman, *Proc. Natl. Acad Sci. USA*, 85: 2444 (1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBUSwissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

EXAMPLE 61

Methods of Making Nucleic Acids

The present invention also comprises methods of making the EST-related nucleic acids, fragments of EST-related nucleic acids, positional segments of the EST-related nucleic acids, or fragments of positional segments of the EST-related nucleic acids. The methods comprise sequentially linking together nucleotides to produce the nucleic acids having the preceding sequences. A variety of methods of synthesizing nucleic acids are known to those skilled in the art.

In many of these methods, synthesis is conducted on a solid support. These included the 3' phosphoramidite methods in which the 3' terminal base of the desired oligonucleotide is immobilized on an insoluble carrier. The nucleotide base to be added is blocked at the 5' hydroxyl and activated at the 3' hydroxyl so as to cause coupling with the immobilized nucleotide base. Deblocking of the new immobilized nucleotide compound and repetition of the cycle will produce the desired polynucleotide. Alternatively, polynucleotides may be prepared as described in U.S. Pat. No. 5,049,656, the disclosure of which is incorporated herein by reference. In some embodiments, several polynucleotides prepared as described above are ligated together to generate longer polynucleotides having a desired sequence.

EXAMPLE 62

Methods of Making Polypeptides

The present invention also comprises methods of making the polynucleotides encoded by EST-related nucleic acids, fragments of EST-related nucleic acids, positional segments of the EST-related nucleic acids, or fragments of positional segments of the EST-related nucleic acids and methods of making the EST-related polypeptides, fragments of EST-related polypeptides, positional segments of EST-related polypeptides, or fragments of EST-related polypeptides. The methods comprise sequentially linking together amino acids to produce the nucleic polypeptides having the preceding sequences. In some embodiments, the polypeptides made by these methods are 150 amino acid or less in length. In other embodiments, the polypeptides made by these methods are 120 amino acids or less in length.

A variety of methods of making polypeptides are known to those skilled in the art, including methods in which the carboxyl terminal amino acid is bound to polyvinyl benzene or another suitable resin. The amino acid to be added possesses blocking groups on its amino moiety and any side chain reactive groups so that only its carboxyl moiety can react. The carboxyl group is activated with carbodiimide or another activating agent and allowed to couple to the immobilized amino acid. After removal of the blocking group, the cycle is repeated to generate a polypeptide having the desired sequence. Alternatively, the methods described in U.S. Pat. No. 5,049,656, the disclosure of which is incorporated herein by reference, may be used.

As discussed above, the EST-related nucleic acids, fragments of the EST-related nucleic acids, positional segments of the EST-related nucleic acids, or fragments of positional segments of the EST-related nucleic acids can be used for various purposes. The polynucleotides can be used to express recombinant protein for analysis, characterization or therapeutic use; production of secreted polypeptides or chimeric polypeptides, antibody production, as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotide encodes a protein or polypeptide which binds or potentially binds to another protein or polypeptide (such as, for example, in a receptor-ligand interaction), the polynucleotide can also be used in interaction trap assays (such as, for example, that described in Gyuris et al., Cell 75:791–803 (1993), the disclosure of which is hereby incorporated by reference) to identify polynucleotides encoding the other protein or polypeptide with which binding occurs or to identify inhibitors of the binding interaction.

The proteins or polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein or polypeptide binds or potentially binds to another protein or polypeptide (such as, for example, in a receptor-ligand interaction), the protein can be used to identify the other protein with which binding occurs or to identify inhibitors of the binding interaction. Proteins or polypeptides involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning; A Laboratory Manual", 2d ed., Cold Spring Harbor Laboratory Press, Sambrook, J., E. F. Fritsch and T. Maniatis eds., 1989, and "Methods in Enzymology, Guide to Molecular Cloning Techniques", Academic Press, Berger, S. L. and A. R. Kimmel eds., 1987.

Polynucleotides and proteins or polypeptides of the present invention can also be used as nutritional sources or supplements. Such uses include without limitation use as a protein or amino acid supplement, use as a carbon source, use as a nitrogen source and use as a source of carbohydrate. In such cases the protein or polynucleotide of the invention can be added to the feed of a particular organism or can be administered as a separate solid or liquid preparation, such as in the form of powder, pills, solutions, suspensions or capsules. In the case of microorganisms, the protein or polynucleotide of the invention can be added to the medium in or on which the microorganism is cultured.

Although this invention has been described in terms of certain preferred embodiments, other embodiments which will be apparent to those of ordinary skill in the art in view of the disclosure herein are also within the scope of this invention. Accordingly, the scope of the invention is intended to be defined only by reference to the appended claims. All documents cited herein are incorporated herein by reference in their entirety.

TABLE I

| Internal Reference Of Cluster | SEQ ID NOs: of Variants in Cluster | Internal Reference Of Cluster | SEQ ID NOs: of Variants in Cluster |
| --- | --- | --- | --- |
| C1 | 653 3812 12821 | C45 | 730 11345 11346 11347 11348 14957 14965 14968 |
| C2 | 10507 10508 | | |
| C3 | 10792 10793 | C46 | 729 731 732 733 |
| C4 | 654 10937 | C47 | 3824 11410 |
| C5 | 11001 11002 11003 11004 11005 11006 | C48 | 11447 11448 11449 |
| | | C49 | 77 738 739 740 11464 11465 |
| C6 | 11845 11846 | C50 | 741 11483 |
| C7 | 12348 12349 | C51 | 3825 11490 |
| C8 | 12891 12892 | C52 | 742 3826 |
| C9 | 661 662 13557 13558 | C53 | 746 11556 |
| C10 | 663 14027 14028 14029 | C54 | 747 748 749 3827 |
| C11 | 14156 14157 | C55 | 751 752 753 754 755 11604 11605 11606 14932 |
| C12 | 14442 14443 | | |
| C13 | 670 14836 | C56 | 3730 8311 |
| C14 | 671 672 | C57 | 759 760 761 762 763 11703 |
| C15 | 3721 14896 14897 | C58 | 764 11740 |
| C16 | 675 10274 | C59 | 11744 11745 |
| C17 | 3814 10305 | C60 | 8323 11754 |
| C18 | 677 10348 | C61 | 766 11771 |
| C19 | 678 14946 | C62 | 3829 3830 8329 8330 8331 8332 11829 11830 |
| C20 | 3816 3817 | | |
| C21 | 682 10516 | C63 | 769 8337 8338 11844 |
| C22 | 684 685 686 10544 | C64 | 771 11868 |
| C23 | 691 3818 | C65 | 3831 8343 |

TABLE I-continued

| Internal Reference Of Cluster | SEQ ID NOs: of Variants in Cluster | Internal Reference Of Cluster | SEQ ID NOs: of Variants in Cluster |
| --- | --- | --- | --- |
| C24 | 692 10673 10674 10675 10676 | C66 | 773 774 775 776 |
| | | C67 | 777 11935 |
| C25 | 10801 10802 | C68 | 779 11958 |
| C26 | 10813 10814 | C69 | 78 3833 |
| C27 | 10851 10852 | C70 | 3834 3835 12026 12027 14940 14950 |
| C28 | 10870 10871 | | |
| C29 | 10910 10911 | C71 | 783 12039 |
| C30 | 3820 10930 | C72 | 12045 12046 12047 14963 14981 |
| C31 | 699 700 701 702 703 | | |
| C32 | 31 32 | C73 | 3836 12054 14967 |
| C33 | 33 34 35 36 37 38 3724 8243 10975 10976 | C74 | 79 8363 |
| | | C75 | 80 81 |
| C34 | 40 41 42 43 44 3725 | C76 | 8372 8373 |
| C35 | 46 47 | C77 | 12183 12184 |
| C36 | 48 49 | C78 | 790 791 |
| C37 | 11057 11058 | C79 | 3733 8396 |
| C38 | 50 51 52 53 54 55 56 57 58 59 60 61 62 63 64 65 66 67 68 69 70 71 72 73 74 75 3726 3727 3728 8249 8250 8251 | C80 | 12462 12463 |
| | | C81 | 797 12528 |
| | | C82 | 798 799 3837 3838 12541 12542 |
| | | C83 | 803 804 |
| C39 | 11099 11100 | C84 | 807 808 809 810 |
| C40 | 706 707 708 709 710 711 712 713 714 715 716 | C85 | 12683 12684 |
| | | C86 | 3840 12720 |
| C41 | 721 3821 8266 11192 11193 | C87 | 88 817 |
| C42 | 722 723 724 725 8274 11243 11244 11245 | C88 | 818 12813 |
| | | C89 | 3841 3842 |
| C43 | 3822 11303 11304 | C90 | 3844 12912 12913 |
| C44 | 728 11309 | C91 | 823 824 |
| C92 | 3845 13001 | C142 | 14825 14826 |
| C93 | 826 3846 3847 13011 | C143 | 3739 14827 |
| C94 | 827 828 829 | C144 | 14828 14829 |
| C95 | 834 13119 | C145 | 14831 14832 |
| C96 | 91 92 836 | C146 | 947 14835 |
| C97 | 3848 3849 | C147 | 104 8652 |
| C98 | 13220 13221 | C148 | 948 14840 |
| C99 | 844 13327 | C149 | 949 14846 14847 14848 14849 |
| C100 | 850 851 | | |
| C101 | 13481 13482 | C150 | 950 951 |
| C102 | 852 853 | C151 | 956 14859 14860 |
| C103 | 8517 13641 | C152 | 958 3861 3862 3863 14865 |
| C104 | 864 865 13768 | C153 | 3740 3864 3865 8656 8657 8658 8659 8660 14874 14875 14876 14877 14878 14879 14939 |
| C105 | 13791 13792 13793 | | |
| C106 | 3734 8671 13854 14984 | | |
| C107 | 96 8543 | | |
| C108 | 868 869 | C154 | 969 970 14880 |
| C109 | 874 875 | C155 | 3866 14888 14889 |
| C110 | 3735 8556 | C156 | 3741 8661 14900 14901 14902 14903 14904 14905 14906 |
| C111 | 877 13974 | | |
| C112 | 880 881 882 14003 | | |
| C113 | 14061 14062 | C157 | 978 14909 |
| C114 | 891 14201 | C158 | 980 3871 14913 |
| C115 | 14221 14222 | C159 | 14918 14919 |
| C116 | 895 896 | C160 | 14921 14922 |
| C117 | 897 14402 | C161 | 3872 3873 14924 |
| C118 | 14426 14427 | C162 | 107 108 |
| C119 | 14451 14452 | C163 | 985 10223 10224 |
| C120 | 901 902 14477 | C164 | 10225 10226 10227 10228 |
| C121 | 904 905 | C165 | 10231 10232 10233 10234 |
| C122 | 14532 14533 | C166 | 986 10237 |
| C123 | 14555 14556 | C167 | 990 8179 8180 8181 8182 8183 8184 14945 14954 |
| C124 | 14589 14590 | | |
| C125 | 906 907 14599 14600 14601 | C168 | 991 8185 10245 10246 10247 10248 14928 14944 |
| C126 | 908 909 | | |
| C127 | 910 14657 | C169 | 992 993 |
| C128 | 3736 8663 14732 14733 14734 | C170 | 994 3876 10249 |
| | | C171 | 995 10250 |
| C129 | 3853 14777 14778 14779 | C172 | 1001 1002 1003 3877 3878 |

TABLE I-continued

| Internal Reference Of Cluster | SEQ ID NOs: of Variants in Cluster |
|---|---|
| C130 | 915 916 14780 14781 |
| C131 | 3737 14783 |
| C132 | 3738 8650 14786 14787 |
| C133 | 919 920 921 |
| C134 | 924 925 |
| C135 | 102 926 |
| C136 | 3854 14795 14796 |
| C137 | 927 3856 3857 |
| C138 | 928 929 14797 14798 14799 14800 14801 |
| C139 | 931 932 933 14802 14803 |
| C140 | 936 937 938 14808 14809 14947 |
| C141 | 14816 14817 |
| C180 | 110 10310 |
| C181 | 10316 10317 |
| C182 | 1027 1028 1029 10321 |
| C183 | 1031 10324 10325 |
| C184 | 10334 10335 |
| C185 | 112 10343 |
| C186 | 1035 1036 |
| C187 | 10350 10351 |
| C188 | 3742 8194 10355 |
| C189 | 1040 1041 1042 1043 1044 3888 3889 10356 10357 10358 |
| C190 | 114 115 |
| C191 | 1046 1047 1048 1049 1050 1051 1052 3890 3891 3892 10360 14936 14937 14938 14942 |
| C192 | 1053 1054 10362 |
| C193 | 116 3743 8195 8665 8666 8667 8668 8669 10363 10364 14952 14970 |
| C194 | 3894 10371 |
| C195 | 10372 10373 |
| C196 | 10375 10376 10377 10378 10379 10380 |
| C197 | 10384 10385 |
| C198 | 10390 10391 |
| C199 | 1064 10392 |
| C200 | 3895 10394 |
| C201 | 117 1065 1066 10395 10396 10397 |
| C202 | 10401 10402 10403 10404 |
| C203 | 1068 8198 |
| C204 | 1070 1071 |
| C205 | 1072 10405 |
| C206 | 1077 1078 10417 10418 10419 |
| C207 | 1081 3898 10430 |
| C208 | 10433 10434 |
| C209 | 10442 10443 10444 |
| C210 | 8201 8202 10453 |
| C211 | 122 1089 1090 1091 1092 1093 10454 |
| C212 | 1099 8203 |
| C213 | 1104 8204 |
| C214 | 10483 10484 10485 |
| C215 | 10502 10503 |
| C216 | 10504 10505 |
| C217 | 124 125 3744 10509 |
| C218 | 1119 10514 |
| C219 | 1121 11525 10526 |
| C220 | 3900 10543 |
| C221 | 10548 10549 10550 10551 |
| C272 | 3914 3915 |
| C273 | 1211 10820 |
| C274 | 1212 1213 |
| | 10255 10256 10257 10258 10259 14964 |
| C173 | 10262 10263 |
| C174 | 3880 10272 10273 |
| C175 | 1008 1009 |
| C176 | 10284 10285 10286 |
| C177 | 1010 1011 1012 1013 1014 1015 1016 1017 1018 1019 3882 3883 3884 3885 8191 10290 10291 10292 10293 10294 10295 10296 14929 14943 |
| C178 | 1022 8192 |
| C179 | 10308 10309 10552 |
| C222 | 10558 10559 10560 10561 10562 10563 |
| C223 | 3901 10570 |
| C224 | 10583 10584 10585 10586 10587 10588 10589 |
| C225 | 1136 3902 8213 10590 10591 |
| C226 | 1137 10593 |
| C227 | 1138 10595 |
| C228 | 8214 8215 |
| C229 | 1139 1140 |
| C230 | 8217 8218 |
| C231 | 3903 10601 |
| C232 | 1142 10604 10605 |
| C233 | 3904 10606 |
| C234 | 10612 10613 |
| C235 | 1145 3905 10616 |
| C236 | 3906 10617 14979 |
| C237 | 1156 1157 |
| C238 | 129 10647 10648 |
| C239 | 1166 1167 |
| C240 | 10654 10655 |
| C241 | 1169 1170 |
| C242 | 10667 10668 |
| C243 | 10688 10689 |
| C244 | 10690 10691 |
| C245 | 10699 10700 |
| C246 | 1176 14975 |
| C247 | 131 1177 8227 |
| C248 | 1178 1179 10701 10702 |
| C249 | 1181 8228 |
| C250 | 1182 10710 |
| C251 | 8229 8230 10737 10738 |
| C252 | 3745 8231 |
| C253 | 1186 10739 10740 |
| C254 | 10742 10743 |
| C255 | 10747 10748 |
| C256 | 10750 10751 10752 |
| C257 | 1188 1189 3911 3912 |
| C258 | 10756 10757 |
| C259 | 1191 10758 |
| C260 | 10765 10766 |
| C261 | 10768 10769 10770 10771 |
| C262 | 1197 10772 |
| C263 | 134 10776 |
| C264 | 10777 10778 |
| C265 | 10782 10783 10784 |
| C266 | 10789 10790 |
| C267 | 10795 10796 |
| C268 | 8232 8675 |
| C269 | 136 137 8233 |
| C270 | 1205 3746 |
| C271 | 1206 1207 |
| C321 | 11109 11110 11111 |
| C322 | 8259 8260 11114 11115 11116 |
| C275 | 1214 3916 3917 10825 10826 10827 10828 10829 10830 14941 14951 |
| C276 | 1220 1221 |
| C277 | 1222 1223 10833 10834 10835 |
| C278 | 1229 1230 |
| C279 | 1231 10845 14980 |
| C280 | 10866 10867 |
| C281 | 10868 10869 |
| C282 | 1239 3919 10884 |
| C283 | 1240 10885 10886 |
| C284 | 8235 10891 |
| C285 | 141 142 143 8236 |
| C286 | 3920 3921 10905 10906 10907 |
| C287 | 8237 8238 |
| C288 | 145 10925 |
| C289 | 1250 10933 |
| C290 | 8239 8240 |
| C291 | 3922 10941 |
| C292 | 147 148 |
| C293 | 3923 3924 |
| C294 | 1254 1255 3925 10954 |
| C295 | 10955 10956 |
| C296 | 10959 10960 |
| C297 | 8242 10966 |
| C298 | 10968 10969 |
| C299 | 10971 10972 |
| C300 | 150 3748 10978 |
| C301 | 10982 14949 |
| C302 | 10985 14958 |
| C303 | 151 152 8245 10990 |
| C304 | 10993 10994 10995 |
| C305 | 1269 1270 10997 10998 |
| C306 | 1274 3929 11011 |
| C307 | 3749 11015 |
| C308 | 154 155 |
| C309 | 1280 1281 1282 |
| C310 | 157 8248 11031 |
| C311 | 11038 11039 |
| C312 | 11040 11041 11042 |
| C313 | 1288 11047 11048 11049 |
| C314 | 1289 1290 1291 11052 |
| C315 | 1294 11059 11060 |
| C316 | 1297 3930 11068 |
| C317 | 3931 11084 11085 |
| C318 | 8253 11090 |
| C319 | 1308 11092 |
| C320 | 1310 11096 |
| C364 | 11386 11387 11388 |
| C365 | 1408 11391 |
| C366 | 1413 1414 |
| C367 | 1422 3950 3951 11421 |
| C368 | 183 184 |
| C369 | 1426 1427 |
| C370 | 1429 11431 |
| C371 | 8294 11432 |
| C372 | 185 186 1430 11436 11437 |
| C373 | 11443 11444 11445 |
| C374 | 187 3758 |
| C375 | 14930 14955 |
| C376 | 8295 8296 |
| C377 | 1434 11453 |
| C378 | 11467 11468 |
| C379 | 1440 11470 |
| C380 | 11471 11472 |
| C381 | 1450 11486 |
| C382 | 11487 11488 |
| C383 | 1453 11492 |
| C323 | 11117 11118 11119 |
| C324 | 1317 11121 |
| C325 | 1319 1320 |
| C326 | 8262 11132 11133 11134 11135 |
| C327 | 3750 3751 3752 14933 14934 |
| C328 | 1325 11141 11142 |
| C329 | 11146 11147 |
| C330 | 1331 1332 1333 |
| C331 | 1334 11153 11154 11155 |
| C332 | 11164 11165 11166 11167 |
| C333 | 165 8264 |
| C334 | 1339 11172 11173 11174 11175 11176 11177 11178 11179 11180 11181 |
| C335 | 1341 11185 11186 11187 11188 |
| C336 | 1343 8268 8269 |
| C337 | 1346 1347 |
| C338 | 11221 11222 |
| C339 | 1350 1351 |
| C340 | 3935 11242 |
| C341 | 11247 11248 |
| C342 | 11249 11250 |
| C343 | 1354 11256 |
| C344 | 1359 1360 11268 11269 11270 11271 11272 11273 11274 |
| C345 | 173 11280 |
| C346 | 11291 11292 |
| C347 | 3936 11293 |
| C348 | 1366 1367 11294 11295 11296 11297 11298 11299 |
| C349 | 3937 11302 |
| C350 | 1369 1370 |
| C351 | 176 177 8279 11307 |
| C352 | 1378 8280 |
| C353 | 3940 11331 11332 |
| C354 | 3754 3755 |
| C355 | 1387 8283 8284 |
| C356 | 1392 11349 11350 |
| C357 | 1394 3941 11355 11356 14960 |
| C358 | 1397 11364 |
| C359 | 1400 1401 3943 11365 |
| C360 | 1402 3944 11371 11372 |
| C361 | 11373 11374 |
| C362 | 1403 1404 1405 3945 11378 11379 |
| C363 | 11384 11385 |
| C416 | 11679 11680 |
| C417 | 1540 1541 1542 |
| C418 | 11697 11698 |
| C419 | 11701 11702 |
| C420 | 11705 11706 |
| C421 | 199 8320 |
| C422 | 1547 11721 |
| C423 | 1550 11730 |
| C424 | 11732 11733 |
| C425 | 1551 11735 |
| C426 | 1560 3963 |
| C427 | 3964 11760 |
| C428 | 11769 11770 |
| C429 | 11782 11783 11784 11785 11786 |
| C430 | 11788 11789 |
| C431 | 1573 11794 |
| C432 | 11824 11825 |
| C433 | 3966 11831 |
| C434 | 1590 1591 |

TABLE I-continued

| Internal Reference Of Cluster | SEQ ID NOs: of Variants in Cluster | Internal Reference Of Cluster | SEQ ID NOs: of Variants in Cluster |
|---|---|---|---|
| C384 | 1457 1458 | C435 | 203 204 |
| C385 | 11500 11501 | C436 | 1593 1594 3969 |
| C386 | 11502 11503 | C437 | 1603 1604 1605 1606 8346 8347 11909 |
| C387 | 1460 11508 | C438 | 1610 11919 |
| C388 | 3760 8299 | C439 | 8348 11923 |
| C389 | 3955 11518 | C440 | 1611 11929 |
| C390 | 11520 11521 11522 | C441 | 11941 11942 11943 11944 |
| C391 | 1468 11530 11531 | C442 | 11948 11949 |
| C392 | 1471 1472 | C443 | 11951 11952 |
| C393 | 8672 11534 11535 11536 11537 11538 | C444 | 1614 1615 1616 1617 11954 11955 |
| C394 | 1486 1487 | C445 | 11959 11960 |
| C395 | 11558 11559 11560 | C446 | 1619 3972 |
| C396 | 1491 11565 | C447 | 1620 11965 |
| C397 | 8305 8306 | C448 | 14956 14977 |
| C398 | 1506 3958 | C449 | 3973 11981 |
| C399 | 1507 1508 11599 11600 | C450 | 206 207 3765 |
| C400 | 3959 11613 | C451 | 1624 1625 |
| C401 | 3960 11618 | C452 | 8673 11984 |
| C402 | 1512 1513 1514 | C453 | 1628 3975 |
| C403 | 1517 11625 11626 | C454 | 3977 11997 11998 |
| C404 | 1518 11628 | C455 | 1632 12003 |
| C405 | 1519 8310 | C456 | 1633 1634 |
| C406 | 11642 11643 | C457 | 1636 12009 |
| C407 | 1528 11655 | C458 | 1637 1638 1639 1640 1641 |
| C408 | 11660 11661 | C459 | 210 211 212 213 3766 3767 8354 12022 |
| C409 | 1530 11663 | C460 | 214 8355 |
| C410 | 11667 11668 | C461 | 1646 1647 |
| C411 | 1533 1534 | C462 | 12052 12053 |
| C412 | 1536 11672 | C463 | 1655 12059 |
| C413 | 1537 11674 | C464 | 1657 12062 |
| C414 | 1538 11675 14973 | C517 | 1811 8401 |
| C415 | 11676 11677 | C518 | 1812 1813 |
| C465 | 3768 3769 3770 8361 | C519 | 240 241 |
| C466 | 1662 8362 | C520 | 8403 8404 8405 |
| C467 | 8365 12088 12089 | C521 | 1827 1828 |
| C468 | 1670 8366 | C522 | 1835 1836 |
| C469 | 1680 1681 | C523 | 12525 12526 |
| C470 | 12112 12113 | C524 | 1844 12529 12530 12531 |
| C471 | 12115 12116 | C525 | 12543 12544 |
| C472 | 1687 12119 12120 | C526 | 12584 12585 |
| C473 | 1688 3983 | C527 | 1864 1865 12589 |
| C474 | 1690 12128 | C528 | 8419 12594 |
| C475 | 1706 12193 | C529 | 1869 1870 1871 |
| C476 | 220 221 8380 | C530 | 1875 12605 |
| C477 | 1707 1708 | C531 | 12617 12618 |
| C478 | 12196 12197 | C532 | 12624 12625 |
| C479 | 1710 12206 | C533 | 1880 12630 |
| C480 | 12220 12221 | C534 | 1883 12636 |
| C481 | 12224 12225 12226 | C535 | 1884 1885 12641 |
| C482 | 12238 12239 | C536 | 1889 12650 12651 |
| C483 | 1717 3988 | C537 | 12657 12658 |
| C484 | 12247 12248 | C538 | 3780 12661 |
| C485 | 12255 12256 | C539 | 1895 12670 |
| C486 | 223 1723 | C540 | 4013 4014 |
| C487 | 12272 12273 | C541 | 1900 1901 1902 1903 1904 12681 12682 |
| C488 | 225 1733 | C542 | 12709 12710 |
| C489 | 12305 12306 | C543 | 1910 12725 12726 |
| C490 | 1744 1745 | C544 | 12729 12730 12731 12732 |
| C491 | 3774 8385 | C545 | 1913 1914 |
| C492 | 1747 12314 | C546 | 1915 12740 |
| C493 | 1749 1750 | C547 | 12745 12746 |
| C494 | 12323 12324 | C548 | 1918 12750 |
| C495 | 1755 3992 12333 | C549 | 251 8438 |
| C496 | 12336 12337 | C550 | 12757 12758 12759 |
| C497 | 3994 3995 | C551 | 1932 12773 |
| C498 | 1762 12346 | C552 | 1934 1935 1936 4015 4016 |
| C499 | 8390 12354 | | |
| C500 | 12359 12360 | | |
| C501 | 12362 12363 | | |

| Internal Reference Of Cluster | SEQ ID NOs: of Variants in Cluster | Internal Reference Of Cluster | SEQ ID NOs: of Variants in Cluster |
|---|---|---|---|
| C502 | 12366 12367 | | 4017 8439 12800 12801 12802 12803 12804 |
| C503 | 8391 12368 | C553 | 1938 12818 |
| C504 | 1775 12395 14978 | C554 | 1940 12831 |
| C505 | 1780 12412 | C555 | 1945 12837 12838 |
| C506 | 1781 1782 | C556 | 1949 12841 |
| C507 | 14972 14983 | C557 | 1950 1951 1952 |
| C508 | 1787 4001 12418 | C558 | 1953 1954 |
| C509 | 1788 12421 | C559 | 1957 12857 |
| C510 | 12422 12423 12424 12425 | C560 | 1958 12860 |
| C511 | 1794 1795 | C561 | 12862 12863 |
| C512 | 4004 12429 | C562 | 12873 12874 |
| C513 | 1805 12450 | C563 | 12879 12880 |
| C514 | 237 8397 | C564 | 4020 4021 12884 |
| C515 | 1806 14935 | C565 | 1964 4022 |
| C516 | 1807 12466 12467 12468 12469 | C566 | 1968 1969 |
| C567 | 12904 12905 | C614 | 2144 13490 |
| C568 | 8446 8447 8448 12916 | C615 | 294 13565 |
| C569 | 1971 12922 12923 | C616 | 2167 13580 |
| C570 | 259 3783 12933 12934 | C617 | 2171 2172 |
| C571 | 12940 12941 12942 | C618 | 13597 13598 |
| C572 | 1980 1981 | C619 | 13625 13626 |
| C573 | 262 1997 12999 | C620 | 13654 13655 13656 |
| C574 | 267 268 | C621 | 2185 13661 13662 |
| C575 | 2010 4026 | C622 | 13688 13689 |
| C576 | 2011 13035 | C623 | 2207 13741 13742 13743 |
| C577 | 13039 13040 | C624 | 2208 2209 |
| C578 | 2014 13053 | C625 | 13787 13788 |
| C579 | 2020 8463 | C626 | 2222 4047 |
| C580 | 8465 13078 | C627 | 8536 13824 13825 |
| C581 | 2025 4028 | C628 | 2231 13844 13845 |
| C582 | 2027 2028 | C629 | 13851 13852 |
| C583 | 13092 13093 | C630 | 2237 13871 |
| C584 | 272 3785 | C631 | 13872 13873 |
| C585 | 2035 13108 | C632 | 2243 13908 |
| C586 | 13117 13118 | C633 | 4051 13955 |
| C587 | 2044 2045 | C634 | 13992 13993 |
| C588 | 13130 13131 | C635 | 2264 2265 |
| C589 | 13134 13135 | C636 | 8565 14034 |
| C590 | 13146 13147 | C637 | 2278 4052 14050 |
| C591 | 2062 13169 | C638 | 2280 14058 |
| C592 | 277 278 8476 | C639 | 2290 14085 |
| C593 | 2068 2069 | C640 | 14112 14113 |
| C594 | 13194 13195 | C641 | 2304 14161 |
| C595 | 280 281 282 283 2070 | C642 | 2307 14198 |
| C596 | 2071 4033 13197 | C643 | 14262 14263 |
| C597 | 2075 2076 13203 | C644 | 8596 8597 14275 |
| C598 | 13226 13227 | C645 | 2327 14289 |
| C599 | 2087 13240 | C646 | 14325 14326 |
| C600 | 13265 13266 | C647 | 14327 14328 |
| C601 | 13289 13290 | C648 | 14344 14345 14346 |
| C602 | 2096 4037 | C649 | 14393 14394 |
| C603 | 2097 13304 | C650 | 14471 14472 |
| C604 | 2102 13323 13324 | C651 | 14493 14494 |
| C605 | 13328 13329 | C652 | 14495 14496 |
| C606 | 2110 4039 | C653 | 8630 14565 |
| C607 | 2119 2120 | C654 | 14579 14580 |
| C608 | 2124 13378 | C655 | 14587 14588 |
| C609 | 13410 13411 | C656 | 14605 14606 |
| C610 | 2131 2132 | C657 | 14651 14652 |
| C611 | 13461 13462 | C658 | 14676 14677 |
| C612 | 13486 13487 | | |
| C613 | 2143 13489 | | |

TABLE II

| SEQ ID NO. | Spatial Distribution |
|---|---|
| 24: | B:14 G:1 H:2 I:1 K:3 O:2 P:2 T:2 W:1 Y:1 |
| 25: | F:2 |
| 26: | F:4 J:4 R:5 S:1 |
| 27: | H:2 T:1 W:1 AC:1 |
| 28: | C:2 |
| 29: | P:2 AA:1 |
| 30: | P:11 |
| 31: | C:1 O:1 P:7 |
| 32: | C:1 O:1 P:6 |
| 33: | C:3 P:9 S:2 T:1 |
| 34: | C:11 P:17 S:3 T:1 X:2 |
| 35: | C:7 P:17 S:4 T:1 X:2 |
| 36: | C:3 P:7 S:2 T:1 X:1 |
| 37: | C:4 P:11 S:2 T:1 |
| 38: | C:7 P:12 S:3 T:1 X:1 |
| 39: | P:7 T:2 Z:1 |
| 40: | O:2 P:2 S:1 |
| 41: | O:1 P:2 S:1 |
| 42: | O:2 P:5 S:1 |
| 43: | O:1 P:7 S:2 |
| 44: | O:1 P:1 S:2 |
| 45: | P:7 |
| 46: | P:3 |
| 47: | P:2 AA:3 |
| 48: | P:2 |
| 49: | O:1 P:1 |
| 50: | C:1 K:2 P:27 S:2 X:2 Y:1 AA:2 |
| 51: | C:1 K:2 P:26 S:2 X:2 Y:1 AA:2 |
| 52: | C:1 K:1 P:23 S:2 AA:1 |
| 53: | C:1 K:2 P:25 S:2 X:2 Y:1 AA:2 |
| 54: | C:1 K:2 P:26 S:2 X:1 Y:1 AA:2 |
| 55: | C:1 K:2 P:26 S:2 T:1 X:2 Y:1 AA:2 |
| 56: | C:1 K:1 P:24 S:2 X:1 AA:1 |
| 57: | C:1 K:2 P:24 S:2 X:2 AA:1 |
| 58: | C:1 K:2 P:28 S:2 X:2 Y:1 AA:2 |
| 59: | C:1 K:3 P:26 S:2 X:1 Y:1 AA:2 |
| 60: | P:13 S:2 AA:1 |
| 61: | P:14 S:1 AA:1 |
| 62: | P:14 S:1 AA:1 |
| 63: | P:14 S:1 AA:1 |
| 64: | P:15 S:1 AA:1 |
| 65: | C:1 P:17 S:2 AA:1 |
| 66: | C:1 K:2 P:16 S:2 X:1 AA:1 |
| 67: | P:12 S:1 X:1 AA:1 |
| 68: | P:12 S:1 X:1 AA:1 |
| 69: | C:1 K:2 P:26 S:2 X:1 Y:1 AA:2 |
| 70: | C:1 K:2 P:26 S:2 X:1 Y:1 AA:2 |
| 71: | C:1 K:1 P:23 S:2 X:2 Y:1 AA:2 |
| 72: | C:1 K:2 P:19 S:2 X:1 Y:1 AA:2 |
| 73: | P:13 S:1 X:1 AA:1 |
| 74: | P:12 S:1 X:1 AA:1 |
| 75: | C:1 K:2 P:25 S:2 X:1 Y:1 AA:2 |
| 76: | B:1 C:1 G:1 H:4 I:4 J:4 K:7 P:1 S:5 T:19 W:2 Y:2 |
| 77: | B:10 C:3 E:1 H:7 K:1 N:3 S:1 T:10 W:2 AA:16 AC:1 |
| 78: | A:2 B:18 C:26 E:8 F:2 G:23 H:22 I:2 J:4 K:11 N:6 O:15 P:20 Q:9 R:10 S:22 T:10 U:1 V:6 W:2 X:2 Y:9 Z:4 AA:15 AC:2 AD:12 |
| 79: | H:2 U:132 |
| 80: | U:35 |
| 81: | U:35 |

TABLE II-continued

| SEQ ID NO. | Spatial Distribution |
|---|---|
| 82: | B:1 G:1 H:2 R:1 S:1 |
| 83: | B:21 G:6 S:2 W:3 |
| 84: | H:10 Z:39 |
| 85: | H:1 K:1 N:1 P:3 S:5 AA:1 AC:1 |
| 86: | C:3 H:4 K:4 S:9 AA:6 |
| 87: | C:5 E:3 F:1 H:3 I:2 J:1 K:4 N:4 O:2 S:4 Z:2 |
| 88: | B:2 K:5 N:1 X:1 Y:1 |
| 89: | B:1 C:1 F:1 H:1 J:4 K:1 P:1 S:1 T:2 W:3 Z:1 AC:3 AD:1 |
| 90: | B:4 C:8 H:1 J:1 K:15 O:4 P:4 S:10 T:8 W:9 Y:2 Z:6 AA:11 AC:1 AD:4 |
| 91: | B:4 C:6 D:2 F:41 H:10 K:6 L:1 N:9 O:2 P:2 R:5 S:9 T:16 V:4 W:1 Y:1 Z:4 AA:6 |
| 92: | B:3 C:6 D:2 F:1 H:8 K:5 L:1 N:9 O:2 P:2 R:4 S:9 T:14 V:4 W:1 Y:1 Z:4 AA:6 |
| 93: | D:28 |
| 94: | A:2 B:1 C:9 E:2 F:2 H:2 K:1 L:1 N:1 P:3 S:6 T:4 U:4 W:5 Y:2 AA:35 AC:1 AD:2 |
| 95: | C:4 F:1 H:5 K:1 S:5 U:1 W:2 Y:1 AA:3 AC:2 AD:1 |
| 96: | A:86 H:13 I:3 |
| 97: | P:3 |
| 98: | P:2 S:1 AA:1 |
| 99: | K:2 P:8 W:1 AC:2 |
| 100: | B:1 C:2 F:1 I:1 J:3 L:1 S:6 T:2 V:5 |
| 101: | B:3 |
| 102: | A:2 B:1 C:5 G:1 H:3 J:1 K:1 O:4 S:3 T:4 V:2 W:1 AC:9 |
| 103: | C:1 H:1 |
| 104: | B:1 C:1 G:2 H:3 S:2 W:1 X:2 AC:1 |
| 105: | B:2 C:2 H:4 J:2 O:1 P:2 S:3 W:2 X:4 AA:2 |
| 106: | H:2 Y:2 |
| 107: | C:3 K:1 P:2 S:1 U:1 W:2 AC:1 |
| 108: | C:3 K:1 P:2 S:1 U:1 W:2 AC:1 |
| 109: | C:2 V:27 |
| 110: | V:22 |
| 111: | C:2 AC:1 |
| 112: | B:1 C:1 G:1 K:1 S:3 Y:7 Z:1 |
| 113: | C:12 K:3 O:3 S:9 AA:1 |
| 114: | B:1 C:5 F:1 H:2 J:1 K:9 O:1 P:3 S:7 W:5 X:8 Y:1 AA:7 |
| 115: | B:1 C:5 F:1 H:2 J:1 K:9 O:1 P:3 S:7 W:5 X:8 Y:1 AA:7 |
| 116: | A:2 I:4 N:104 |
| 117: | A:3 B:27 C:36 D:3 E:7 F:10 G:28 H:33 I:1 J:3 K:12 L:1 N:18 O:13 P:26 Q:10 R:17 S:29 T:14 U:9 V:11 W:10 X:9 Y:7 Z:19 AA:30 AC:11 AD:12 |
| 118: | B:18 G:1 W:1 Y:1 |
| 119: | C:1 K:1 Q:1 |
| 120: | B:2 |
| 121: | B:1 C:2 K:2 O:1 T:3 X:2 AD:2 |
| 122: | B:7 D:4 E:1 H:4 K:1 L:1 N:5 O:1 P:2 T:7 V:3 W:1 AA:2 |
| 123: | A:1 H:2 |
| 124: | H:2 I:143 L:2 N:219 T:3 U:2 AA:11 |
| 125: | H:2 I:147 L:2 N:230 T:3 U:2 AA:11 |
| 126: | E:1 O:2 AC:1 |
| 127: | H:2 U:26 |
| 128: | S:1 X:1 |
| 129: | G:3 P:1 S:1 W:3 AA:4 |

TABLE II-continued

| SEQ ID NO. | Spatial Distribution |
|---|---|
| 130: | K:1 I:1 P:1 W:1 |
| 131: | B:2 F:1 H:2 K:1 Y:1 AA:3 AC:1 |
| 132: | C:1 H:1 J:1 R:1 |
| 133: | F:1 T:2 AA:1 |
| 134: | B:10 P:3 Y:7 |
| 135: | K:2 P:3 T:2 W:1 AA:3 |
| 136: | P:1 T:2 |
| 137: | K:3 P:5 S:7 T:2 W:1 X:3 Z:1 AA:4 |
| 138: | A:3 AA:1 |
| 139: | C:3 H:2 J:2 K:2 T:5 W:1 |
| 140: | B:1 W:2 Y:1 |
| 141: | B:3 C:6 D:5 F:9 G:4 H:13 K:2 O:4 P:2 S:4 T:10 V:1 W:19 Y:9 AC:23 AD:2 |
| 142: | B:3 C:5 D:5 F:9 G:3 H:12 K:1 O:3 P:2 S:4 T:10 V:1 W:15 Y:9 AC:23 AD:2 |
| 143: | B:3 C:5 D:5 F:9 G:3 H:12 K:1 O:3 P:2 S:4 T:10 V:1 W:15 Y:9 AC:23 AD:2 |
| 144: | U:3 |
| 145: | B:6 G:1 S:1 Y:1 AA:4 |
| 146: | B:5 K:1 P:1 T:1 Y:2 |
| 147: | C:1 H:2 K:3 O:3 S:1 W:1 Z:1 AD:2 |
| 148: | C:1 H:1 K:4 O:5 S:2 W:1 Z:1 AD:2 |
| 149: | A:2 J:1 O:1 Q:1 Y:1 AA:1 |
| 150: | P:3 S:1 T:1 Y:1 AA:1 |
| 151: | B:3 C:4 E:2 G:1 H:6 K:3 L:3 O:2 Q:1 S:1 T:1 |
| 152: | B:4 C:4 E:2 G:1 H:8 K:3 L:3 O:4 Q:2 S:2 T:1 |
| 153: | U:3 |
| 154: | I:38 N:35 S:1 |
| 155: | I:33 N:34 S:1 |
| 156: | V:3 |
| 157: | B:12 C:6 E:2 F:4 G:15 H:14 I:3 K:1 L:1 O:3 P:8 R:3 S:1 T:19 U:6 W:5 X:2 Y:5 AC:10 AD:9 |
| 158: | B:2 K:1 O:1 S:2 |
| 159: | H:3 J:1 K:2 T:1 V:1 AA:1 |
| 160: | B:7 S:1 Y:2 |
| 161: | B:7 F:1 G:2 P:2 T:1 X:1 Y:1 AC:1 AD:2 |
| 162: | K:1 X:2 |
| 163: | S:1 Y:1 |
| 164: | B:1 H:1 T:1 W:1 |
| 165: | P:11 |
| 166: | H:2 J:1 W:1 AA:2 AD:2 |
| 167: | N:2 S:1 U:5 |
| 168: | R:1 Y:1 |
| 169: | O:1 S:2 |
| 170: | B:27 C:1 G:3 H:3 P:1 S:2 W:1 Y:2 AC:1 |
| 171: | P:1 T:3 X:3 |
| 172: | B:5 I:2 S:1 W:2 Y:2 |
| 173: | C:3 H:4 K:1 O:2 P:1 R:1 S:2 V:4 W:2 Z:1 AC:2 |
| 174: | H:2 S:1 T:1 AA:1 |
| 175: | N:12 |
| 176: | B:2 C:2 K:2 N:3 O:2 P:3 S:7 W:1 |
| 177: | B:2 C:3 K:2 N:4 O:2 P:1 S:5 W:1 |
| 178: | N:3 |
| 179: | B:1 H:1 I:2 N:7 Q:3 W:11 Y:1 |
| 180: | C:1 AC:1 |
| 181: | U:4 |
| 182: | N:2 P:2 |
| 183: | B:14 C:9 G:1 H:8 K:1 O:1 P:2 S:4 Y:2 |
| 184: | B:14 C:9 G:1 H:7 K:1 O:1 P:2 S:3 Y:2 |
| 185: | A:2 G:1 J:3 X:3 AA:1 |
| 186: | A:1 G:1 J:3 X:2 AA:2 |
| 187: | B:1 C:16 F:2 H:11 J:3 K:7 N:4 O:11 P:35 S:35 T:15 U:3 V:2 W:21 X:9 Y:4 Z:3 AA:26 AC:5 AD:2 |
| 188: | B:1 O:1 T:2 W:1 A C:1 |
| 189: | B:3 |
| 190: | F:1 V:1 W:2 |
| 191: | K:2 P:3 S:2 AA:2 AC:1 |
| 192: | A:2 E:3 H:1 N:1 O:1 Q:1 S:1 X:2 |
| 193: | C:1 E:1 S:1 W:1 |
| 194: | C:1 S:13 |
| 195: | C:1 H:1 P:1 |
| 196: | AA:1 AC:1 |
| 197: | W:4 |
| 198: | S:9 |
| 199: | C:2 H:13 P:3 S:2 V:5 W:1 AC:28 AD:3 |
| 200: | P:1 X:1 |
| 201: | B:4 |
| 202: | C:3 F:1 H:5 K:1 S:7 T:4 W:1 AA:1 AD:1 |
| 203: | C:4 F:1 H:2 K:8 O:3 P:1 S:2 W:1 AA:5 |
| 204: | C:4 F:1 H:2 K:8 O:3 P:1 S:2 W:1 AA:5 |
| 205: | B:4 G:1 K:6 Y:1 |
| 206: | H:3 S:2 |
| 207: | C:1 H:3 S:2 |
| 208: | Y:4 |
| 209: | R:1 S:1 AC:2 |
| 210: | A:1 B:7 C:9 G:1 H:2 J:1 K:3 L:2 N:4 O:3 P:8 Q:1 R:1 S:12 T:16 U:1 V:4 X:7 Z:2 AA:17 AC:5 AD:2 |
| 211: | A:1 B:8 C:9 G:1 H:2 J:1 K:3 L:2 N:3 O:4 P:8 Q:1 R:2 S:13 T:15 U:1 V:4 W:1 X:7 Z:2 AA:19 AC:6 AD:2 |
| 212: | B:7 C:9 G:1 H:4 J:2 K:1 N:4 O:2 P:10 R:1 S:15 T:12 U:10 V:4 X:2 Z:2 AA:10 AC:4 |
| 213: | H:1 P:2 S:2 T:1 W:2 X:1 Y:1 AA:1 |
| 214: | B:1 C:2 F:1 K:3 L:2 O:3 P:2 S:3 T:5 W:1 Z:1 AA:1 |
| 215: | P:1 S:1 |
| 216: | B:2 P:1 S:1 X:2 |
| 217: | A:1 B:1 G:2 H:2 P:4 V:1 Z:2 AA:1 |
| 218: | L:2 R:2 |
| 219: | H:5 T:5 |
| 220: | C:44 H:2 K:83 O:1 S:145 |
| 221: | C:62 H:3 K:101 O:1 S:177 |
| 222: | S:1 T:1 AC:1 |
| 223: | B:3 C:27 D:7 E:2 F:11 G:1 H:7 I:5 J:7 K:2 N:1 O:7 P:6 S:10 U:6 W:15 X:3 Y:15 AA:19 |
| 224: | H:1 L:3 |
| 225: | C:2 K:1 W:1 |
| 226: | Y:2 |
| 227: | F:4 G:1 R:5 S:3 AC:1 |
| 228: | F:1 H:4 |
| 229: | K:1 AA:3 |
| 230: | C:1 H:1 S:1 T:1 |
| 231: | B:1 D:6 N:2 Q:1 R:5 W:3 AA:21 |
| 232: | F:1 G:1 H:7 S:1 U:1 X:1 |
| 233: | D:2 C:1 G:1 H:1 O:1 P:2 S:8 U:2 V:2 Z:1 AA:3 |
| 234: | B:1 C:1 H:2 |
| 235: | H:1 N:2 S:1 T:1 W:1 Y:2 |

TABLE II-continued

| SEQ ID NO. | Spatial Distribution |
|---|---|
| 236: | W:3 Y:2 |
| 237: | C:2 F:1 H:2 K:8 L:1 N:3 O:8 P:2 Q:1 R:1 S:4 V:1 W:1 Y:3 AA:11 AC:3 |
| 238: | C:3 H:1 K:1 R:1 |
| 239: | C:8 G:2 J:1 S:6 |
| 240: | B:2 C:3 H:4 K:1 S:3 Z:1 |
| 241: | B:2 C:2 H:5 K:1 S:1 Z:1 |
| 242: | C:1 K:2 N:1 O:4 S:1 T:6 W:1 AA:1 |
| 243: | C:3 F:1 H:3 W:2 Y:2 |
| 244: | A:2 B:2 C:6 G:1 J:1 K:3 O:1 P:3 R:1 S:4 T:1 X:1 Z:2 AC:1 |
| 245: | AC:2 |
| 246: | H:10 L:1 T:1 |
| 247: | F:2 H:4 R:1 S:1 |
| 248: | B:1 S:1 T:1 AA:8 |
| 249: | B:2 H:2 W:3 X:1 Y:1 AC:2 |
| 250: | B:2 |
| 251: | C:10 F:1 H:1 J:2 N:1 S:1 T:2 V:1 AC:2 |
| 252: | B:2 H:4 R:1 T:1 Y:1 |
| 253: | G:1 N:1 P:1 S:3 V:1 AA:1 |
| 254: | S:1 X:2 |
| 255: | H:2 I:1 O:3 P:1 T:4 AA:3 |
| 256: | S:3 |
| 257: | B:3 C:1 O:1 S:1 W:1 AC:1 |
| 258: | H:2 O:1 AA:1 |
| 259: | B:15 G:14 W:6 |
| 260: | G:1 H:2 P:1 Y:1 |
| 261: | B:1 C:5 H:3 K:3 P:2 S:2 T:2 W:1 Y:2 AA:1 AD:1 |
| 262: | B:10 C:2 F:3 G:1 H:4 L:1 N:1 S:2 T:2 W:2 AA:18 AB:1 AC:2 |
| 263: | B:1 C:3 F:1 G:1 H:4 S:2 T:8 W:1 Z:1 AA:3 AC:1 AD:3 |
| 264: | Q:1 X:2 |
| 265: | B:2 F:1 J:1 L:2 |
| 266: | T:2 |
| 267: | B:1 C:10 G:4 H:15 J:1 K:11 O:1 P:4 R:1 S:14 T:2 U:1 Z:1 AA:14 AC:1 |
| 268: | B:1 C:10 G:3 H:15 J:1 K:10 O:1 P:3 R:1 S:13 T:2 U:1 Z:1 AA:14 AC:1 |
| 269: | C:1 N:1 W:3 Y:2 |
| 270: | C:2 Q:1 |
| 271: | H:1 O:1 S:3 W:1 AA:1 |
| 272: | A:2 AA:25 |
| 273: | C:1 K:1 AA:1 |
| 274: | K:1 O:1 |
| 275: | B:2 H:2 K:3 T:1 Y:1 |
| 276: | P:4 |
| 277: | C:2 U:26 |
| 278: | C:4 U:25 |
| 279: | B:4 C:1 |
| 280: | C:9 F:2 G:1 H:2 I:19 J:2 K:20 L:1 N:33 O:7 R:2 S:46 T:8 W:11 Z:1 AA:52 AC:1 |
| 281: | C:9 F:2 G:1 H:2 I:19 J:2 K:22 L:1 N:35 O:8 R:2 S:47 T:8 W:14 Z:1 AA:55 AC:1 |
| 282: | C:16 F:2 G:2 H:2 I:33 J:4 K:30 L:1 N:18 O:10 R:2 S:68 T:16 W:15 Z:2 AA:73 AC:2 |
| 283: | C:16 F:2 G:2 H:2 I:33 J:4 K:32 L:2 N:50 O:11 R:2 S:69 T:16 W:18 Z:2 AA:76 AC:2 |
| 284: | F:1 S:1 |
| 285: | C:5 K:1 S:2 |
| 286: | W:1 Y:1 |
| 287: | C:2 K:1 N:1 P:4 S:1 X:1 |
| 288: | C:5 H:5 K:3 S:1 |
| 289: | F:2 H:1 J:1 |
| 290: | B:3 |
| 291: | B:2 C:4 G:5 N:3 O:1 T:2 AC:1 |
| 292: | B:1 C:1 O:1 |
| 293: | B:2 |
| 294: | B:1 E:1 Q:1 |
| 295: | Z:6 |
| 296: | U:3 |
| 297: | B:1 Y:2 |
| 298: | W:1 AD:1 |
| 299: | B:2 H:4 P:1 AA:1 |
| 300: | B:3 |
| 301: | B:7 C:4 F:1 K:3 N:1 S:4 W:1 Y:1 AA:1 |
| 302: | B:1 G:1 |
| 303: | C:2 E:1 G:1 J:1 W:1 Y:2 |
| 304: | B:3 |
| 305: | A:1 B:2 P:1 S:3 T:1 AC:3 |
| 306: | I:2 N:1 |
| 307: | G:1 AD:1 |
| 308: | I:1 N:5 |
| 309: | B:2 |
| 310: | B:4 C:1 O:1 S:1 |
| 311: | C:1 H:1 J:1 O:2 S:1 T:1 W:1 AA:1 |
| 312: | B:2 C:2 F:2 AC:1 AD:2 |
| 313: | H:2 |
| 314: | B:1 F:1 Y:1 AC:1 |
| 315: | F:1 H:1 O:1 AC:1 |
| 316: | B:2 |
| 317: | B:2 W:1 Y:1 |
| 318: | R:1 X:1 |
| 319: | C:1 G:1 H:1 O:3 P:4 V:2 AA:2 |
| 320: | G:1 S:1 W:1 AC:1 |
| 321: | S:2 W:1 |
| 322: | E:1 F:1 H:1 O:1 |
| 323: | S:2 |
| 324: | B:1 H:1 |
| 325: | B:2 |
| 326: | K:1 P:1 |
| 327: | T:2 |
| 328: | F:1 O:1 |
| 329: | B:2 R:2 |
| 330: | H:1 K:1 |
| 331: | P:2 X:1 |
| 332: | T:2 |
| 333: | B:1 C:2 |
| 334: | T:2 |
| 335: | S:1 T:2 V:1 Y:1 AA:2 |
| 336: | V:1 |
| 337: | B:1 |
| 338: | B:1 |
| 339: | U:1 |
| 340: | U:1 |
| 341: | U:1 |
| 342: | X:1 |
| 343: | X:1 |
| 344: | X:1 |
| 345: | X:1 |
| 346: | X:1 |
| 347: | X:1 |
| 348: | X:1 |
| 349: | X:1 |
| 350: | L:1 |
| 351: | L:1 |
| 352: | N:1 |
| 353: | E:1 |
| 354: | E:1 |
| 355: | Q:1 |
| 356: | J:1 |
| 357: | J:1 |
| 358: | J:1 |
| 359: | T:1 |
| 360: | T:1 |

TABLE II-continued

| SEQ ID NO. | Spatial Distribution |
|---|---|
| 361: | T:1 |
| 362: | T:1 |
| 363: | T:1 |
| 364: | T:1 |
| 365: | T:1 |
| 366: | T:1 |
| 367: | T:1 |
| 368: | T:1 |
| 369: | T:1 |
| 370: | T:1 |
| 371: | T:1 |
| 372: | T:1 |
| 373: | T:1 |
| 374: | T:1 |
| 375: | T:1 |
| 376: | T:1 |
| 377: | T:1 |
| 378: | T:1 |
| 379: | T:1 |
| 380: | F:1 |
| 381: | F:1 |
| 382: | F:1 |
| 383: | F:1 |
| 384: | F:1 |
| 385: | F:1 |
| 386: | F:1 |
| 387: | F:1 |
| 388: | O:1 |
| 389: | O:1 |
| 390: | O:1 |
| 391: | O:1 |
| 392: | O:1 |
| 393: | O:1 |
| 394: | O:1 |
| 395: | O:1 |
| 396: | O:1 |
| 397: | O:1 |
| 398: | O:1 |
| 399: | O:1 |
| 400: | V:1 |
| 401: | B:1 |
| 402: | B:1 |
| 403: | B:1 |
| 404: | B:1 |
| 405: | B:1 |
| 406: | B:1 |
| 407: | B:1 |
| 408: | B:1 |
| 409: | B:1 |
| 410: | B:1 |
| 411: | B:1 |
| 412: | B:1 |
| 413: | B:1 |
| 414: | B:1 |
| 415: | B:1 |
| 416: | AC:1 |
| 417: | AC:1 |
| 418: | AC:1 |
| 419: | AC:1 |
| 420: | AC:1 |
| 421: | AC:1 |
| 422: | O:1 |
| 423: | Y:1 |
| 424: | Y:1 |
| 425: | Y:1 |
| 426: | Y:1 |
| 427: | Y:1 |
| 428: | Y:1 |
| 429: | Y:1 |
| 430: | Y:1 |
| 431: | Y:1 |
| 432: | Y:1 |
| 433: | Y:1 |
| 434: | Y:1 |
| 435: | Y:1 |
| 436: | Y:1 |
| 437: | Y:1 |
| 438: | Y:1 |
| 439: | Y:1 |
| 440: | P:1 |
| 441: | P:1 |
| 442: | P:1 |
| 443: | P:1 |
| 444: | P:1 |
| 445: | P:1 |
| 446: | P:1 |
| 447: | P:1 |
| 448: | P:1 |
| 449: | P:1 |
| 450: | P:1 |
| 451: | P:1 |
| 452: | AA:1 |
| 453: | AA:1 |
| 454: | AA:1 |
| 455: | AA:1 |
| 456: | AA:1 |
| 457: | AA:1 |
| 458: | AA:1 |
| 459: | AA:1 |
| 460: | AA:1 |
| 461: | AA:1 |
| 462: | AA:1 |
| 463: | AA:1 |
| 464: | AA:1 |
| 465: | AA:1 |
| 466: | AA:1 |
| 467: | AA:1 |
| 468: | AA:1 |
| 469: | AA:1 |
| 470: | AA:1 |
| 471: | AA:1 |
| 472: | AA:1 |
| 473: | AA:1 |
| 474: | AA:1 |
| 475: | AA:1 |
| 476: | AA:1 |
| 477: | AA:1 |
| 478: | AA:1 |
| 479: | AA:1 |
| 480: | AA:1 |
| 481: | AA:1 |
| 482: | AA:1 |
| 483: | AA:1 |
| 484: | AA:1 |
| 485: | AA:1 |
| 486: | AA:1 |
| 487: | AA:1 |
| 488: | AA:1 |
| 489: | AA:1 |
| 490: | AA:1 |
| 491: | N:1 |
| 492: | X:1 |
| 493: | X:1 |
| 494: | D:1 |
| 495: | D:1 |
| 496: | G:1 |
| 497: | G:1 |
| 498: | G:1 |
| 499: | G:1 |
| 500: | G:1 |
| 501: | G:1 |
| 502: | G:1 |
| 503: | G:1 |
| 504: | G:1 |
| 505: | H:1 |
| 506: | H:1 |
| 507: | H:1 |
| 508: | H:1 |
| 509: | H:1 |
| 510: | H:1 |
| 511: | H:1 |
| 512: | H:1 |
| 513: | H:1 |
| 514: | H:1 |

TABLE II-continued

| SEQ ID NO. | Spatial Distribution |
|---|---|
| 515: | H:1 |
| 516: | H:1 |
| 517: | H:1 |
| 518: | H:1 |
| 519: | H:1 |
| 520: | H:1 |
| 521: | H:1 |
| 522: | H:1 |
| 523: | H:1 |
| 524: | H:1 |
| 525: | H:1 |
| 526: | H:1 |
| 527: | H:1 |
| 528: | H:1 |
| 529: | H:1 |
| 530: | H:1 |
| 531: | H:1 |
| 532: | H:1 |
| 533: | H:1 |
| 534: | H:1 |
| 535: | H:1 |
| 536: | H:1 |
| 537: | H:1 |
| 538: | H:1 |
| 539: | H:1 |
| 540: | H:1 |
| 541: | H:1 |
| 542: | H:1 |
| 543: | H:1 |
| 544: | H:1 |
| 545: | H:1 |
| 546: | H:1 |
| 547: | H:1 |
| 548: | H:1 |
| 549: | H:1 |
| 550: | H:1 |
| 551: | H:1 |
| 552: | H:1 |
| 553: | H:1 |
| 554: | H:1 |
| 555: | H:1 |
| 556: | H:1 |
| 557: | H:1 |
| 558: | H:1 |
| 559: | H:1 |
| 560: | H:1 |
| 561: | H:1 |
| 562: | H:1 |
| 563: | H:1 |
| 564: | H:1 |
| 565: | H:1 |
| 566: | H:1 |
| 567: | H:1 |
| 568: | H:1 |
| 569: | H:1 |
| 570: | H:1 |
| 571: | H:1 |
| 572: | H:1 |
| 573: | H:1 |
| 574: | H:1 |
| 575: | O:1 |
| 576: | Q:1 |
| 577: | O:1 |
| 578: | O:1 |
| 579: | O:1 |
| 580: | S:1 |
| 581: | S:1 |
| 582: | S:1 |
| 583: | S:1 |
| 584: | S:1 |
| 585: | Z:1 |
| 586: | Z:1 |
| 587: | Z:1 |
| 588: | Z:1 |
| 589: | A:1 |
| 590: | AD:1 |
| 591: | AD:1 |
| 592: | AD:1 |
| 593: | AD:1 |
| 594: | AD:1 |
| 595: | AD:1 |
| 596: | C:1 |
| 597: | C:1 |
| 598: | C:1 |
| 599: | C:1 |
| 600: | C:1 |
| 601: | C:1 |
| 602: | C:1 |
| 603: | C:1 |
| 604: | C:1 |
| 605: | C:1 |
| 606: | C:1 |
| 607: | C:1 |
| 608: | C:1 |
| 609: | C:1 |
| 610: | C:1 |
| 611: | C:1 |
| 612: | C:1 |
| 613: | C:1 |
| 614: | K:1 |
| 615: | K:1 |
| 616: | K:1 |
| 617: | K:1 |
| 618: | K:1 |
| 619: | K:1 |
| 620: | K:1 |
| 621: | K:1 |
| 622: | S:1 |
| 623: | S:1 |
| 624: | S:1 |
| 625: | S:1 |
| 626: | S:1 |
| 627: | S:1 |
| 628: | S:1 |
| 629: | S:1 |
| 630: | S:1 |
| 631: | S:1 |
| 632: | S:1 |
| 633: | S:1 |
| 634: | S:1 |
| 635: | S:1 |
| 636: | S:1 |
| 637: | S:1 |
| 638: | S:1 |
| 639: | S:1 |
| 640: | S:1 |
| 641: | S:1 |
| 642: | S:1 |
| 643: | S:1 |
| 644: | S:1 |
| 645: | W:1 |
| 646: | W:1 |
| 647: | W:1 |
| 648: | W:1 |
| 649: | W:1 |
| 650: | W:1 |
| 651: | N:1 |
| 652: | N:1 |
| 653: | B:13 C:35 E:6 F:7 G:23 H:52 J:5 K:19 L:3 N:4 O:14 P:15 Q:19 S:33 T:28 U:3 W:8 X:4 Y:6 Z:2 AA:23 AC:8 AD:21 |
| 654: | G:1 N:1 S:3 AC:2 |
| 655: | F:1 R:10 |
| 656: | H:3 P:1 AC:2 |
| 657: | G:3 H:2 I:3 K:1 P:2 W:1 Y:2 |
| 658: | B:1 G:2 |
| 659: | J:4 R:1 |
| 660: | B:5 S:3 W:6 X:2 AA:3 |
| 661: | B:6 G:1 H:7 S:1 |
| 662: | B:6 G:1 H:6 S:2 |
| 663: | B:3 C:12 D:1 E:3 F:1 G:12 H:21 J:2 K:11 O:5 P:9 Q:4 R:3 S:18 T:10 U:1 V:2 W:8 |

TABLE II-continued

| SEQ ID NO. | Spatial Distribution |
|---|---|
| | Y:2 Z:1 AC:3 AD:12 |
| 664: | B:1 C:1 H:1 AA:1 |
| 665: | E:1 G:1 H:1 |
| 666: | B:1 C:7 E:1 G:1 H:6 P:1 Q:1 S:1 T:1 W:1 AC:3 |
| 667: | B:2 X:1 |
| 668: | B:7 C:2 G:1 H:2 K:1 Q:1 U:2 X:2 AA:1 |
| 669: | B:1 G:3 |
| 670: | O:1 T:4 X:1 AC:1 |
| 671: | B:25 C:1 G:2 |
| 672: | B:23 C:1 G:2 |
| 673: | B:1 W:2 Y:2 |
| 674: | G:1 H:2 K:1 AC:1 |
| 675: | B:2 C:1 AA:1 |
| 676: | A:1 B:7 C:1 D:2 H:3 I:1 P:5 S:7 V:1 W:1 AD:3 |
| 677: | B:1 F:2 P:1 AC:1 |
| 678: | B:2 N:1 O:1 U:3 |
| 679: | C:16 K:1 S:4 |
| 680: | AA:4 |
| 681: | AA:3 |
| 682: | B:14 G:1 Y:3 |
| 683: | B:3 |
| 684: | B:10 C:3 E:20 F:9 G:2 H:4 J:3 K:5 L:6 N:15 O:2 P:18 R:5 S:11 T:66 V:14 X:1 Y:2 Z:3 AA:2 AC:4 AD:5 |
| 685: | B:10 C:3 E:20 F:9 G:2 H:6 J:3 K:5 L:6 N:16 O:2 P:19 R:6 S:11 T:66 V:14 X:1 Y:2 Z:4 AA:3 AC:4 AD:6 |
| 686: | B:10 C:3 E:20 F:9 G:2 H:6 J:3 K:5 L:6 N:16 O:2 P:19 R:6 S:11 T:66 V:14 X:1 Y:2 Z:4 AA:3 AC:4 AD:6 |
| 687: | H:5 X:1 AD:1 |
| 688: | B:1 C:3 E:4 F:1 S:5 W:2 Y:1 AA:11 |
| 689: | G:5 Y:4 |
| 690: | B:9 C:6 G:17 H:10 K:2 O:2 Q:1 R:7 S:4 T:5 W:3 Y:3 AA:1 |
| 691: | B:4 C:2 E:1 G:2 H:5 J:2 K:6 O:3 R:3 S:3 T:3 V:1 W:5 Y:3 Z:1 AA:1 AC:1 |
| 692: | B:11 C:5 G:2 H:2 K:10 O:4 Q:2 R:3 S:2 T:6 Y:4 Z:2 AA:2 AC:2 AD:3 |
| 693: | W:2 |
| 694: | B:3 E:2 F:1 H:1 O:2 P:1 S:2 T:1 W:1 Y:1 AD:2 |
| 695: | H:4 |
| 696: | H:3 |
| 697: | C:3 H:2 |
| 698: | B:4 C:1 G:3 H:9 K:1 P:1 S:4 W:1 X:4 Y:1 |
| 699: | A:4 B:28 G:10 H:12 I:4 K:5 O:8 S:2 Y:2 AC:9 |
| 700: | A:1 B:16 G:6 H:6 I:1 K:3 O:5 S:1 Y:1 AC:6 |
| 701: | A:2 B:16 G:6 H:7 I:2 K:3 O:5 S:1 Y:1 AC:6 |
| 702: | A:4 B:27 G:10 H:12 I:4 K:6 O:9 S:2 Y:2 AC:9 |
| 703: | A:2 B:13 G:3 H:6 I:2 K:3 O:5 S:1 Y:1 AC:6 |
| 704: | AA:6 |
| 705: | C:2 P:2 |
| 706: | B:20 C:26 D:3 E:4 F:3 G:6 H:35 K:12 N:2 O:12 P:17 Q:10 R:3 S:22 T:7 U:4 V:1 W:3 X:2 Y:5 Z:2 AA:14 AC:5 AD:10 |
| 707: | B:21 C:29 D:3 E:4 F:3 G:8 H:37 I:1 K:13 N:3 O:13 P:17 Q:10 R:3 S:23 T:8 U:4 V:1 W:3 X:2 Y:5 Z:2 AA:16 AC:6 AD:10 |
| 708: | B:22 C:29 D:3 E:4 F:3 G:8 H:37 I:1 K:13 N:3 O:13 P:17 Q:10 R:3 S:23 T:8 U:4 V:1 W:3 X:2 Y:5 Z:2 AA:16 AC:6 AD:11 |
| 709: | B:19 C:26 D:3 E:4 F:3 G:5 H:33 K:12 N:2 O:12 P:17 Q:10 R:3 S:22 T:7 U:4 V:1 W:3 X:2 Y:5 Z:2 AA:14 AC:4 AD:9 |
| 710: | B:19 C:26 D:3 E:4 F:3 G:5 H:34 K:12 N:2 O:13 P:17 Q:10 R:3 S:22 T:7 U:3 V:1 W:3 X:2 Y:5 Z:2 AA:14 AC:4 AD:9 |
| 711: | B:20 C:29 D:3 E:4 F:3 G:7 H:35 I:1 K:13 N:3 O:13 P:17 Q:10 R:3 S:23 T:8 U:4 V:1 W:3 X:2 Y:5 Z:2 AA:16 AC:5 AD:9 |
| 712: | B:21 C:29 D:3 E:4 F:3 G:7 H:35 I:1 K:13 N:3 O:13 P:17 Q:10 R:3 S:23 T:8 U:4 V:1 W:3 X:2 Y:5 Z:2 AA:16 AC:5 AD:10 |
| 713: | B:24 C:35 D:3 E:4 F:3 G:9 H:47 I:1 K:16 N:3 O:14 P:17 Q:12 R:4 S:30 T:8 U:7 V:1 W:3 X:2 Y:5 Z:2 AA:21 AC:5 AD:14 |
| 714: | B:20 C:29 D:3 E:4 F:3 G:7 H:36 I:1 K:13 N:3 O:14 P:17 Q:10 R:3 S:23 T:8 U:3 V:1 W:3 X:2 Y:5 Z:2 AA:16 AC:5 AD:9 |
| 715: | B:21 C:29 D:3 E:4 F:3 G:7 H:36 I:1 K:13 N:3 O:14 P:17 Q:10 R:3 S:23 T:8 U:3 V:1 W:3 X:2 Y:5 Z:2 AA:16 AC:5 AD:10 |
| 716: | B:24 C:35 D:3 E:4 F:3 G:9 H:48 I:1 K:16 N:3 O:15 P:17 Q:12 R:4 S:30 T:8 U:6 V:1 W:3 X:2 Y:5 Z:2 AA:21 AC:5 AD:14 |
| 717: | B:1 P:1 |
| 718: | B:1 H:1 N:1 O:2 R:2 S:1 |
| 719: | B:4 |
| 720: | B:5 C:4 H:1 J:1 K:3 S:4 T:1 V:3 Y:1 AA:3 AD:2 |
| 721: | A:2 B:30 C:73 D:4 E:37 F:5 G:31 H:88 I:5 J:9 K:35 L:2 N:7 O:24 P:50 Q:14 R:11 S:39 T:29 U:3 V:4 W:16 X:10 Y:8 Z:17 AA:44 AC:28 AD:20 |
| 722: | A:5 B:51 C:159 D:2 E:25 F:5 G:78 H:95 I:4 J:10 K:70 L:1 N:15 O:19 P:52 Q:10 R:17 S:119 T:28 U:5 V:8 W:9 X:16 Y:15 Z:6 AA:22 AC:14 AD:45 |
| 723: | A:7 B:53 C:188 D:2 E:26 F:5 G:94 H:127 I:5 J:10 K:82 L:1 N:15 O:19 P:58 Q:11 R:17 S:136 T:31 U:7 V:8 W:9 X:17 Y:17 Z:7 AA:24 AC:15 AD:52 |
| 724: | A:5 B:50 C:172 D:2 E:25 F:5 G:84 H:103 I:4 J:10 K:77 L:1 N:15 O:19 P:54 Q:10 R:17 S:122 T:29 U:5 V:8 W:9 X:16 Y:15 Z:6 AA:22 AC:14 AD:48 |

TABLE II-continued

| SEQ ID NO. | Spatial Distribution |
|---|---|
| 725: | A:5 B:60 C:162 D:1 E:25 F:5 G:78 H:105 I:5 J:10 K:69 L:1 N:15 O:23 P:50 Q:11 R:16 S:117 T:28 U:7 V:9 W:8 X:17 Y:18 Z:6 AA:20 AC:16 AD:45 |
| 726: | B:2 C:2 E:2 G:1 Q:2 S:1 |
| 727: | H:2 |
| 728: | G:6 H:5 P:2 Q:1 S:4 |
| 729: | C:1 G:1 H:1 Q:2 |
| 730: | B:69 C:293 D:10 E:8 F:8 G:90 H:186 I:6 J:21 K:270 N:14 O:40 P:79 Q:23 R:24 S:271 T:33 U:26 V:6 W:25 X:20 Y:21 Z:14 AA:98 AB:3 AC:30 AD:103 |
| 731: | B:19 C:9 G:8 H:10 K:9 O:6 S:11 W:2 Y:2 |
| 732: | B:13 C:6 G:4 H:9 K:6 O:6 S:12 W:5 Y:1 |
| 733: | B:29 C:11 G:6 H:11 K:10 O:8 S:18 W:5 Y:3 |
| 734: | W:1 Y:3 |
| 735: | H:1 P:1 |
| 736: | B:1 C:4 H:1 K:1 P:1 R:3 T:3 V:1 AA:1 AC:1 |
| 737: | H:4 |
| 738: | B:11 C:4 E:1 H:8 K:2 N:3 S:1 T:10 W:2 AA:29 AC:1 |
| 739: | B:11 C:4 E:1 H:8 K:2 N:3 S:1 T:10 W:2 AA:29 AC:1 |
| 740: | B:10 C:3 E:1 H:7 K:1 N:3 S:1 T:10 W:2 AA:16 AC:1 |
| 741: | C:4 H:1 K:1 P:1 W:2 AA:4 |
| 742: | B:3 H:1 O:1 T:1 Y:3 AC:1 |
| 743: | T:2 |
| 744: | B:2 AC:1 |
| 745: | B:1 C:2 E:1 F:2 G:2 H:3 J:1 P:1 S:3 T:1 Y:2 Z:1 AA:1 |
| 746: | B:1 C:1 E:1 G:4 H:4 J:1 S:3 T:3 V:4 W:5 X:2 Z:1 AC:1 AD:1 |
| 747: | B:14 C:3 E:5 F:2 G:9 H:4 J:1 K:3 O:11 P:3 Q:3 R:3 S:6 T:2 U:1 V:1 X:5 Y:2 AA:1 AC:2 |
| 748: | B:11 C:2 E:4 F:2 G:6 H:2 K:2 O:10 P:3 Q:2 R:2 S:6 T:2 U:1 X:5 Y:2 AC:1 |
| 749: | B:19 C:5 E:6 F:2 G:8 H:5 J:1 K:4 O:15 P:3 Q:2 R:2 S:7 T:2 U:1 V:1 X:5 Y:3 AA:1 AC:2 |
| 750: | E:1 G:1 H:1 O:1 S:1 U:1 AC:1 |
| 751: | B:9 C:2 G:5 H:6 J:3 O:1 R:1 S:2 T:8 W:1 X:2 Y:1 AC:1 AD:3 |
| 752: | B:5 C:1 G:4 H:2 J:2 O:1 R:1 S:2 T:5 W:3 X:1 Y:1 AC:1 AD:2 |
| 753: | B:2 H:1 S:1 W:1 AC:1 |
| 754: | B:13 C:3 G:2 H:9 J:5 O:1 R:1 S:3 T:5 W:5 X:3 Y:3 AC:1 AD:2 |
| 755: | B:5 C:3 E:1 F:2 G:4 H:13 K:1 L:1 O:6 P:4 S:5 T:10 V:4 W:7 X:1 Y:1 AA:3 AC:3 |
| 756: | A:3 C:3 H:6 K:3 Q:4 W:2 |
| 757: | H:1 X:1 |
| 758: | B:6 C:1 H:2 |
| 759: | B:36 C:34 D:2 E:2 F:2 G:16 H:40 I:1 J:3 K:22 N:6 O:7 P:10 Q:9 R:8 S:33 T:3 U:7 W:5 X:1 Y:4 Z:2 AA:13 AC:9 AD:8 |
| 760: | B:18 C:30 D:2 E:2 F:2 G:14 H:39 I:1 J:3 K:21 N:6 O:7 P:10 Q:8 R:8 S:33 T:3 U:3 W:5 X:1 Y:2 Z:2 AA:11 AC:8 AD:8 |
| 761: | B:23 C:34 D:2 E:2 F:2 G:16 H:39 I:1 J:3 K:22 N:6 O:7 P:10 Q:8 R:8 S:33 T:3 U:3 W:5 X:1 Y:3 Z:2 AA:13 AC:9 AD:8 |
| 762: | B:36 C:34 D:2 E:2 F:2 G:16 H:39 I:1 J:3 K:22 N:6 O:7 P:10 Q:8 R:8 S:33 T:3 U:3 W:5 X:1 Y:3 Z:2 AA:14 AC:9 AD:8 |
| 763: | B:53 C:58 D:3 E:4 F:4 G:26 H:64 I:2 J:6 K:30 N:9 O:13 P:19 Q:15 R:15 S:56 T:6 U:10 W:9 X:2 Y:5 Z:4 AA:21 AC:15 AD:14 |
| 764: | B:33 C:3 F:1 G:2 H:5 J:1 K:7 N:2 O:5 S:7 T:3 U:1 V:1 W:2 X:1 Y:8 Z:1 AA:8 AC:4 |
| 765: | B:4 W:3 Y:2 |
| 766: | B:1 C:1 S:1 AC:1 |
| 767: | H:1 O:1 Y:1 |
| 768: | B:2 W:1 |
| 769: | A:4 B:45 C:76 D:11 E:78 F:39 G:39 H:73 I:4 J:24 K:42 L:2 N:31 O:14 P:29 Q:10 R:13 S:58 T:98 U:2 V:5 W:5 X:11 Y:6 Z:13 AA:26 AB:1 AC:8 AD:36 |
| 770: | H:4 |
| 771: | B:1 Y:3 AC:1 |
| 772: | B:2 C:3 G:2 K:1 O:2 S:2 T:4 Y:2 |
| 773: | B:12 C:1 G:4 H:1 R:1 S:3 Y:3 |
| 774: | B:12 C:1 G:4 H:1 R:1 S:2 Y:2 |
| 775: | B:15 C:2 G:5 H:2 R:1 S:3 Y:4 |
| 776: | B:8 C:1 G:3 H:1 Q:2 S:2 Y:3 |
| 777: | B:16 C:1 G:1 N:3 W:3 X:6 Y:1 Z:1 AA:2 |
| 778: | B:3 C:12 G:3 H:6 K:9 O:2 P:9 Q:1 S:8 T:2 Y:2 AC:2 |
| 779: | B:7 C:5 H:4 P:2 Q:4 AD:2 |
| 780: | B:4 C:1 E:3 F:1 H:4 J:1 K:2 N:1 O:3 P:2 R:2 S:1 T:2 V:1 Y:1 AA:2 |
| 781: | G:2 H:1 V:1 |
| 782: | H:2 AC:1 |
| 783: | F:2 T:2 |
| 784: | H:1 O:2 W:1 |
| 785: | B:5 Y:1 |
| 786: | C:1 J:1 O:2 W:2 |
| 787: | B:2 X:3 |
| 788: | B:1 C:1 G:1 H:1 O:1 Y:1 |
| 789: | B:1 G:1 H:5 P:2 Q:3 AC:1 |
| 790: | B:3 K:1 N:1 P:1 |
| 791: | B:5 K:1 N:1 P:1 AA:3 |
| 792: | B:1 Y:2 |
| 793: | G:2 |
| 794: | B:2 O:1 S:3 X:1 |
| 795: | B:2 G:1 H:2 P:2 Q:1 S:1 |
| 796: | B:1 T:3 |
| 797: | B:2 C:1 E:1 G:2 H:1 K:2 O:1 S:2 |
| 798: | A:1 B:56 C:55 D:7 E:24 F:4 G:37 H:59 I:2 J:12 K:24 N:16 O:7 P:51 Q:15 R:6 S:42 T:31 U:2 V:10 W:5 X:9 Y:17 Z:9 AA:48 AC:10 AD:31 |
| 799: | A:1 B:58 C:56 D:7 E:24 F:4 G:37 H:61 I:2 J:12 K:25 |

TABLE II-continued

| SEQ ID NO. | Spatial Distribution |
|---|---|
| | N:16 O:8 P:51 Q:15 R:6 S:42 T:31 U:2 V:10 W:5 X:9 Y:17 Z:10 AA:50 AC:10 AD:31 |
| 800: | B:1 W:5 AA:2 |
| 801: | B:4 C:1 H:2 K:3 O:1 S:2 T:1 Y:1 AA:1 |
| 802: | AC:3 |
| 803: | B:2 C:1 E:1 H:3 K:3 S:6 Y:2 AC:1 |
| 804: | B:2 C:1 E:1 H:3 K:2 S:8 Y:2 AC:1 |
| 805: | C:2 K:1 S:1 AC:1 |
| 806: | F:1 S:1 T:1 X:1 |
| 807: | B:5 K:1 |
| 808: | B:3 K:1 AA:1 |
| 809: | B:3 F:1 |
| 810: | C:1 H:3 AA:2 |
| 811: | C:1 H:1 |
| 812: | H:3 |
| 813: | C:1 S:3 |
| 814: | C:3 H:4 L:1 R:1 AC:2 |
| 815: | B:5 W:1 |
| 816: | B:4 G:2 Y:1 |
| 817: | B:2 K:3 N:1 X:1 Y:1 |
| 818: | B:22 C:3 G:2 H:2 O:2 Q:3 S:4 X:1 Y:2 |
| 819: | B:1 N:2 S:1 T:1 AA:2 AC:1 AD:2 |
| 820: | C:1 H:1 K:1 |
| 821: | C:2 K:10:2 P:1 Q:1 X:3 |
| 822: | C:1 P:2 Y:1 |
| 823: | G:6 H:8 J:4 S:3 T:7 U:6 W:7 X:2 Y:2 Z:2 AA:1 |
| 824: | G:2 H:9 J:6 S:3 T:3 U:6 W:11 X:1 Y:3 Z:1 AA:2 |
| 825: | B:2 H:3 K:4 S:2 W:2 |
| 826: | B:2 C:9 D:1 G:4 H:6 J:1 K:4 N:1 R:1 S:3 T:1 W:2 Y:4 Z:1 AA:4 AC:4 |
| 827: | O:2 P:4 S:2 T:1 |
| 828: | B:1 C:1 G:1 H:1 O:5 P:3 S:2 T:1 AD:2 |
| 829: | B:1 C:1 G:1 H:1 O:4 P:3 S:2 T:1 AD:1 |
| 830: | Y:2 |
| 831: | R:2 S:2 AA:2 |
| 832: | B:3 G:2 |
| 833: | B:3 H:5 K:3 P:1 Q:2 S:3 AC:1 |
| 834: | B:5 C:4 G:3 H:3 K:1 N:1 O:8 P:1 S:1 W:1 Y:3 AA:1 AC:1 |
| 835: | G:1 H:1 I:1 O:2 W:2 Y:1 |
| 836: | B:3 C:6 D:1 F:3 H:8 K:5 L:1 N:7 O:2 P:2 R:3 S:8 T:12 V:4 W:1 Y:1 Z:3 AA:3 |
| 837: | C:1 I:1 AA:4 |
| 838: | B:5 |
| 839: | B:2 C:1 O:1 |
| 840: | B:4 S:1 :U:2 |
| 841: | B:1 E:1 K:1 |
| 842: | B:1 H:5 |
| 843: | B:8 G:1 W:2 |
| 844: | B:1 E:2 G:4 K:2 N:2 O:2 R:1 S:4 Y:1 AA:4 AC:3 |
| 845: | B:3 C:1 G:5 O:2 AA:2 |
| 846: | C:1 E:1 K:2 |
| 847: | B:2 H:2 Y:1 |
| 848: | J:2 |
| 849: | B:3 H:1 Y:2 |
| 850: | B:1 C:2 G:1 H:6 N:1 O:3 P:3 S:2 T:4 V:4 Y:1 AA:4 |
| 851: | B:2 C:4 G:2 H:9 N:2 O:3 P:2 S:1 T:4 V:8 Y:2 AA:3 |
| 852: | B:5 H:1 AC:1 |
| 853: | B:4 H:1 AC:1 |
| 854: | C:1 K:2 |
| 855: | R:2 |
| 856: | B:2 C:4 G:2 H:5 O:1 P:2 Q:4 W:1 AA:15 AC:1 |
| 857: | B:1 Y:1 AA:2 |
| 858: | B:2 K:1 |
| 859: | B:1 AA:2 |
| 860: | O:1 S:1 T:1 |
| 861: | H:2 AA:1 |
| 862: | P:2 |
| 863: | H:3 I:1 O:1 R:2 W:1 |
| 864: | B:1 H:3 L:1 S:1 U:2 W:2 X:4 Y:2 Z:2 |
| 865: | B:2 H:2 L:1 S:2 U:3 W:3 X:6 Y:3 Z:1 |
| 866: | AA:4 |
| 867: | B:2 C:2 S:2 AA:1 |
| 868: | B:2 C:3 E:1 F:1 G:3 H:6 I:2 K:2 N:1 O:3 S:4 T:1 V:1 W:3 Y:1 Z:1 AA:1 |
| 869: | B:2 C:3 E:1 F:1 G:3 H:6 I:2 K:2 N:1 O:3 S:4 T:1 V:1 W:3 Y:1 Z:1 AA:1 |
| 870: | F:3 Y:1 |
| 871: | B:6 |
| 872: | B:1 C:1 J:5 N:1 T:2 |
| 873: | B:1 E:1 G:1 H:6 W:2 Y:3 Z:1 |
| 874: | B:4 H:7 P:2 AC:1 |
| 875: | B:4 H:8 P:2 AC:2 |
| 876: | O:1 P:1 |
| 877: | B:4 C:4 E:1 G:1 H:8 J:1 N:1 O:2 P:2 Q:1 T:6 V:2 W:3 X:1 Z:1 AA:3 AC:1 |
| 878: | X:3 |
| 879: | C:1 H:3 O:1 Y:1 |
| 880: | B:1 C:2 G:1 H:2 W:2 |
| 881: | B:1 C:2 H:2 K:1 Z:1 AA:2 AD:1 |
| 882: | B:3 C:3 G:2 H:4 K:1 W:3 Z:1 AA:1 AD:1 |
| 883: | C:1 H:3 |
| 884: | S:1 AA:1 |
| 885: | B:2 G:6 |
| 886: | B:10 C:1 H:2 O:1 P:3 W:2 Y:2 AA:3 |
| 887: | AA:2 |
| 888: | H:2 P:1 Y:2 |
| 889: | B:1 C:1 O:2 P:2 R:1 S:1 V:5 |
| 890: | B:3 |
| 891: | B:9 C:1 F:1 S:2 AC:3 |
| 892: | B:10 T:2 AA:1 |
| 893: | B:4 C:8 D:2 E:2 F:2 G:8 H:4 J:2 K:1 O:2 P:3 Q:2 R:1 S:6 U:1 W:1 Y:1 AA:1 AC:3 AD:1 |
| 894: | O:1 T:4 |
| 895 | B:2 H:3 J:1 N:2 R:1 T:2 V:2 X:1 AA:1 |
| 896: | B:2 H:3 J:1 N:2 R:1 T:2 V:2 X:1 AA:1 |
| 897: | B:4 C:2 G:2 H:1 I:1 Q:2 U:1 V:1 Y:1 AA:1 |
| 898: | B:1 P:1 Z:1 AC:1 |
| 899: | H:4 |
| 900: | F:1 R:1 S:2 |
| 901: | B:1 C:1 H:3 O:1 P:2 Q:1 S:4 Y:1 AA:2 |
| 902: | B:1 C:1 H:5 O:1 P:4 Q:1 S:5 Y:1 AA:2 |
| 903: | C:2 F:4 H:1 P:1 S:3 T:1 Y:1 AC:6 |
| 904: | B:12 C:2 G:1 H:4 I:2 J:1 O:1 P:1 Q:1 R:2 S:1 T:4 V:2 X:1 AA:3 |
| 905: | B:12 C:2 G:1 H:4 I:4 J:1 O:1 P:1 Q:1 R:2 S:1 T:4 V:2 X:2 AA:3 |
| 906: | A:5 B:49 C:36 D:3 B:50 F:9 G:90 H:75 I:2 J:9 K:9 L:8 |

TABLE II-continued

| SEQ ID NO. | Spatial Distribution |
|---|---|
| | N:23 O:30 P:21 R:2 S:13 T:55 V:8 W:5 X:17 Y:8 AA:62 AC:7 AD:8 |
| 907: | A:3 B:42 C:26 D:2 E:39 F:6 G:60 H:49 I:1 J:6 K:6 L:6 N:19 O:18 P:14 R:1 S:7 T:43 V:6 W:2 X:10 Y:4 AA:42 AC:4 AD:8 |
| 908: | A:1 C:2 G:1 H:8 J:1 K:2 N:1 O:3 P:4 Q:1 S:5 T:1 W:6 Y:2 AA:1 AC:2 |
| 909: | A:1 C:2 G:1 H:8 J:1 K:2 N:1 O:3 P:5 Q:2 S:6 T:1 W:6 Y:3 AA:1 AC:3 |
| 910: | G:7 H:1 O:1 P:3 T:3 X:2 Y:1 AA:2 |
| 911: | B:2 G:2 H:1 S:1 |
| 912: | B:6 G:1 Y:1 |
| 913: | H:1 Y:2 S:2 |
| 915: | B:1 C:1 H:8 T:1 Y:2 |
| 916: | B:1 C:1 H:9 K:1 T:2 Y:1 |
| 917: | B:4 C:6 K:1 N:2 O:3 P:3 R:4 S:5 AA:4 |
| 918: | K:3 P:3 S:1 |
| 919: | B:1 C:1 G:5 AA:1 AC:1 |
| 920: | B:1 C:1 G:6 AA:1 AC:1 |
| 921: | B:1 C:1 G:5 AA:1 AC:1 |
| 922: | C:1 H:1 W:1 X:1 |
| 923: | B:1 Y:1 |
| 924: | B:10 C:8 D:2 G:3 H:20 J:1 K:2 O:8 Q:4 S:1 T:2 Y:8 AA:2 AC:1 |
| 925: | B:9 C:6 D:2 G:2 H:15 J:1 K:2 O:8 Q:3 S:1 T:2 Y:7 AA:2 AC:1 |
| 926: | A:2 B:1 C:6 G:1 H:6 J:1 K:1 O:4 S:3 T:4 V:2 W:1 AC:10 |
| 927: | B:9 C:10 E:4 F:1 G:12 H:13 I:2 J:2 K:6 O:10 P:11 Q:3 R:3 S:6 T:7 V:3 W:5 X:4 Z:5 AA:1 AC:6 |
| 928: | A:2 B:112 C:10 F:4 G:26 H:46 J:2 K:4 O:2 P:17 Q:7 R:3 S:20 T:10 W:14 X:7 Y:9 Z:2 AA:5 AC:5 |
| 929: | A:2 B:115 C:10 F:4 G:24 H:33 J:2 K:5 O:3 P:17 Q:7 R:2 S:18 T:11 W:13 X:6 Y:10 Z:2 AA:5 AC:4 |
| 930: | T:4 AA:2 |
| 931: | B:1 G:2 J:1 T:8 Y:5 AA:6 AD:5 |
| 932: | B:1 G:1 J:3 T:13 Y:5 AA:5 AD:2 |
| 933: | B:1 G:3 J:2 T:12 Y:5 AA:5 AD:6 |
| 934: | B:2 |
| 935: | B:7 H:1 J:1 |
| 936: | B:12 C:1 H:6 N:1 P:4 S:1 T:8 AA:2 |
| 937: | B:16 C:3 H:12 N:3 P:5 S:3 T:15 AA:4 |
| 938: | B:12 C:1 H:6 N:1 P:4 S:1 T:8 AA:4 |
| 939: | A:1 B:8 C:5 F:1 G:2 H:1 K:4 L:1 N:1 R:2 S:2 AA:2 AC:2 |
| 940: | B:3 H:3 O:1 S:1 T:1 AD:1 |
| 941: | C:1 J:2 V:3 |
| 942: | B:1 G:2 X:2 |
| 943: | B:1 C:1 E:1 H:1 K:3 AC:3 |
| 944: | Q:2 |
| 945: | H:2 X:1 |
| 946: | AA:3 |
| 947: | B:4 C:10 E:1 G:1 H:13 K:5 O:3 P:4 R:2 S:6 T:2 U:3 V:2 Y:1 Z:1 AA:1 AC:2 AD:4 |
| 948: | B:1 Y:1 AD:2 |
| 949: | A:2 B:10 E:7 F:1 G:2 H:10 J:1 K:1 L:1 N:3 O:4 P:1 Q:1 S:1 T:12 V:2 W:2 X:1 AA:3 AD:1 |
| 950: | B:1 C:2 H:3 P:1 Q:2 U:3 AA:1 |
| 951: | B:1 C:2 H:3 P:2 Q:1 U:1 AA:3 |
| 952: | B:3 K:1 |
| 953: | C:2 E:1 H:1 O:2 R:1 S:1 AA:3 AC:1 |
| 954: | B:1 G:3 |
| 955: | B:19 C:1 G:1 H:2 O:2 S:3 Y:2 AA:2 |
| 956: | C:1 F:4 S:4 T:5 Z:1 |
| 957: | E:1 H:2 |
| 958: | B:1 G:2 H:6 S:2 Y:1 Z:1 AA:16 |
| 959: | H:1 AC:1 |
| 960: | H:1 N:2 P:2 S:2 T:1 |
| 961: | B:2 C:1 H:1 Q:1 S:1 |
| 962: | H:2 O:1 P:1 |
| 963: | G:2 H:1 R:1 T:4 X:2 AC:2 |
| 964: | F:5 S:1 |
| 965: | AA:13 |
| 966: | E:1 J:1 O:2 T:1 W:1 |
| 967: | B:5 H:4 K:1 |
| 968: | B:4 O:1 P:1 S:1 W:1 |
| 969: | B:5 C:2 H:2 O:3 P:1 Q:1 S:11 W:2 X:2 Y:1 AC:2 |
| 970: | B:5 C:2 H:3 O:5 P:2 Q:1 S:16 W:2 X:2 Y:1 AC:2 |
| 971: | B:1 Y:1 |
| 972: | B:4 C:1 H:2 J:2 O:2 T:3 Y:3 Z:1 AA:3 |
| 973: | B:22 C:4 F:1 G:2 H:3 O:2 S:6 V:1 W:1 X:1 Y:2 AA:1 AC:2 AD:1 |
| 974: | B:8 |
| 975: | E:1 L:1 N:17 O:2 R:9 T:7 V:3 W:2 Z:1 AA:9 AC:6 |
| 976: | C:2 I:2 P:1 X:1 AA:1 |
| 977: | G:1 H:1 |
| 978: | B:7 C:4 E:3 G:4 H:4 K:5 O:4 P:1 Q:3 S:3 T:5 X:1 AA:2 AC:1 AD:1 |
| 979: | B:3 S:1 Y:1 |
| 980: | B:14 C:5 D:1 E:2 F:1 G:6 H:1 K:1 N:1 O:2 Q:1 R:3 T:9 V:2 W:1 Y:3 Z:2 AA:6 AC:1 AD:1 |
| 981: | B:7 C:2 D:1 E:1 G:3 J:1 K:2 Q:3 R:1 T:3 V:3 AA:2 AC:1 |
| 982: | B:2 |
| 983: | B:3 S:1 |
| 984: | C:2 |
| 985: | H:1 O:1 S:2 V:1 |
| 986: | H:5 T:2 AA:2 |
| 987: | B:4 |
| 988: | C:4 |
| 989: | N:2 |
| 990: | B:13 C:6 G:2 H:6 I:1 K:3 O:1 P:2 S:5 U:2 W:1 X:1 Y:4 AA:1 AC:3 |
| 991: | B:2 E:2 F:6 H:3 K:2 N:2 O:2 P:4 R:1 S:4 T:6 W:4 Y:2 Z:1 AA:15 |
| 992: | B:3 C:2 H:4 O:2 Q:1 S:2 T:4 V:1 W:3 X:4 Z:1 AA:1 AD:2 |
| 993: | B:4 C:2 H:6 O:4 Q:1 S:4 T:4 V:1 W:2 X:2 Z:2 AA:1 AD:2 |
| 994: | A:1 B:29 C:30 D:1 E:6 G:26 H:49 I:1 J:10 K:16 L:1 N:4 O:14 P:25 Q:13 R:5 S:30 T:6 U:3 V:3 W:6 X:10 Y:15 Z:13 AA:19 AC:7 AD:21 |

TABLE II-continued

| SEQ ID NO. | Spatial Distribution |
|---|---|
| 995: | B:2 |
| 996: | H:1 I:1 P:1 S:2 |
| 997: | Y:2 |
| 998: | B:2 C:6 F:1 G:4 H:7 K:1 L:1 N:2 O:4 P:1 S:14 T:6 V:7 W:1 X:1 AA:9 AC:3 AD:2 |
| 999: | C:1 G:1 Y:1 |
| 1000: | F:1 H:4 S:4 W:2 Y:2 Z:1 AA:2 |
| 1001: | B:21 G:2 H:7 K:1 S:2 T:3 W:5 X:1 Y:3 AA:5 AD:1 |
| 1002: | B:35 C:1 D:3 G:1 H:11 K:3 O:1 S:1 T:2 W:4 X:2 Y:8 Z:2 AA:5 AD:1 |
| 1003: | B:33 C:1 D:2 G:1 H:14 K:4 O:1 S:1 T:2 W:3 X:2 Y:10 Z:2 AA:4 |
| 1004: | S:1 T:1 Y:1 |
| 1005: | B:2 C:1 F:2 G:1 H:7 O:2 T:1 X:1 |
| 1006: | B:16 C:6 H:4 K:3 O:6 S:9 W:1 Y:4 Z:2 AA:2 AC:1 |
| 1007: | B:1 G:1 H:1 O:1 S:1 X:1 Y:1 |
| 1008: | C:1 K:3 P:1 W:1 |
| 1009: | C:1 K:3 P:1 W:1 |
| 1010: | B:22 G:1 P:2 |
| 1011: | A:5 B:46 C:144 D:11 E:8 F:11 G:102 H:95 J:15 K:72 L:2 N:20 O:31 P:53 Q:39 R:19 S:50 T:57 U:11 V:2 W:9 X:28 Y:6 Z:12 AA:31 AB:2 AC:19 AD:16 |
| 1012: | A:2 B:21 C:70 D:5 E:4 F:5 G:46 H:39 J:7 K:33 L:1 N:8 O:13 P:30 Q:17 R:12 S:24 T:26 U:6 V:1 W:4 X:12 Y:2 Z:6 AA:17 AB:1 AC:9 AD:7 |
| 1013: | A:7 B:74 C:13 D:21 E:3 F:12 G:22 H:68 I:19 J:16 K:7 L:9 N:77 O:30 P:34 Q:3 R:36 S:44 T:66 V:3 W:43 X:5 Y:23 Z:21 AA:62 AB:1 AC:17 AD:18 |
| 1014: | A:6 B:63 C:12 D:19 E:3 F:12 G:21 H:60 I:19 J:16 K:7 L:9 N:75 O:29 P:33 Q:3 R:36 S:44 T:66 V:3 W:42 X:5 Y:22 Z:21 AA:62A B:1 AC:17 AD:18 |
| 1015: | A:10 B:108 C:19 D:26 E:5 F:22 G:37 H:92 I:31 J:28 K:12 L:14 N:123 O:46 P:52 Q:6 R:47 S:67 T:110 V:6 W:56 X:8 Y:38 Z:35 AA:95 AB:2 AC:31 AD:23 |
| 1016: | A:2 B:21 C:64 D:5 E:4 F:5 G:40 H:36 J:7 K:29 L:1 N:8 O:11 P:27 Q:15 R:11 S:22 T:27 U:4 V:1 W:4 X:11 Y:2 Z:6 AA:15 AB:1 AC:8 AD:6 |
| 1017: | A:4 B:38 C:125 D:9 E:7 F:10 G:84 H:81 J:15 K:64 L:2 N:15 OQ:27 P:47 Q:34 R:13 S:42 T:42 U:11 V:1 W:7 X:27 Y:6 Z:8 AA:29 AB:2 AC:16 AD:14 |
| 1018: | A:4 B:39 C:109 D:8 E:8 F:10 G:73 H:66 J:13 K:51 L:2 N:16 O:21 P:50 Q:29 R:18 S:39 T:51 U:7 V:2 W:8 X:21 Y:4 Z:12 AA:23 AB:2 AC:14 AD:12 |
| 1019: | A:4 B:39 C:115 D:8 E:8 F:10 G:79 H:69 J:13 K:55 L:2 N:16 O:23 P:53 Q:31 R:19 S:41 T:50 U:9 V:2 W:8 X:22 Y:4 Z:12 AA:25 AB:2 AC:15 AD:13 |
| 1020: | B:6 G:1 H:1 O:1 |
| 1021: | B:1 C:2 S:1 |
| 1022: | A:1 H:2 T:9 |
| 1023: | B:2 C:6 F:1 G:2 H:4 Q:1 R:1 W:1 X:2 Z:1 AD:1 |
| 1024: | H:1 AA:2 |
| 1025: | B:6 C:2 T:2 W:1 |
| 1026: | F:1 S:1 |
| 1027: | B:1 F:2 H:2 J:2 K:2 N:1 O:2 S:7 Y:1 AC:2 |
| 1028: | B:1 F:1 H:1 J:2 K:1 N:1 O:3 S:6 Y:1 AC:2 |
| 1029: | B:1 C:1 F:2 H:2 J:2 K:2 N:1 O:3 S:5 Y:1 AC:1 |
| 1030: | B:10 C:2 G:3 H:8 I:2 Q:1 S:3 T:3 W:4 Y:6 AA:1 AC:1 AD:1 |
| 1031: | B:16 C:10 F:2 G:7 H:15 K:6 O:1 R:2 S:4 T:4 W:3 X:1 Y:4 Z:1 AB:2 AC:2 |
| 1032: | B:5 C:1 G:1 H:1 S:2 |
| 1033: | G:2 H:1 AC:1 |
| 1034: | H:4 |
| 1035: | G:1 AA:3 |
| 1036: | G:1 AA:3 |
| 1037: | H:2 AA:1 |
| 1038: | P:2 AD:2 |
| 1039: | C:3 E:2 F:2 H:4 K:4 O:3 P:2 R:1 S:1 W:1 AA:4 AC:3 |
| 1040: | B:2 C:8 G:3 H:15 J:1 K:8 O:9 Q:1 R:2 S:3 T:2 W:2 AA:4 AC:4 AD:13 |
| 1041: | C:2 G:5 H:6 J:2 K:5 O:5 Q:1 S:3 T:5 V:1 W:3 AA:1 AC:2 AD:3 |
| 1042: | C:2 G:3 H:12 K:4 O:3 Q:2 S:2 T:1 W:1 AC:3 AD:4 |
| 1043: | C:3 E:1 G:1 H:13 J:1 K:5 N:2 O:3 P:1 Q:1 R:1 S:2 T:1 W:1 AA:2 AC:2 AD:3 |
| 1044: | C:3 D:1 G:2 H:10 J:1 K:5 O:4 S:1 W:1 AC:2 AD:4 |
| 1045: | C:2 |
| 1046: | B:14 C:3 D:4 F:3 H:3 J:9 K:2 P:2 R:30 S:6 T:2 V:1 W:25 Y:12 Z:1 AA:8 AC:7 AD:1 |
| 1047: | B:14 C:3 D:4 F:3 H:3 J:9 K:2 P:2 R:30 S:6 T:2 V:1 W:27 Y:12 Z:1 AA:8 AC:7 AD:1 |
| 1048: | B:13 C:3 D:3 F:3 G:1 H:2 J:9 K:2 N:1 P:1 R:30 S:5 T:2 W:22 Y:9 Z:1 AA:7 AC:6 AD:1 |
| 1049: | B:15 C:3 D:4 F:3 H:3 J:9 K:2 P:2 R:30 S:6 T:2 V:1 W:26 Y:12 Z:1 AA:8 AC:7 AD:1 |
| 1050: | B:2 G:1 N:1 P:3 |
| 1051: | B:15 C:3 D:4 F:3 H:3 J:9 K:2 P:2 R:30 S:7 T:2 V:1 W:26 Y:12 Z:1 AA:8 AC:9 AD:1 |
| 1052: | B:18 C:6 D:4 F:4 H:5 J:10 K:3 P:3 R:33 S:6 T:2 V:1 W:33 Y:16 Z:2 AA:14 AC:11 AD:2 |
| 1053: | B:4 C:3 E:2 F:1 G:1 H:3 J:1 K:1 P:1 S:1 T:3 W:1 Y:1 AC:4 |
| 1054: | B:3 G:2 K:1 S:1 Y:1 |
| 1055: | B:6 |
| 1056: | B:2 |
| 1057: | B:4 H:2 |
| 1058: | B:1 C:1 S:4 AD:1 |
| 1059: | B:1 P:2 T:3 |
| 1060: | B:7 C:1 G:4 H:1 O:2 P:1 S:2 AA:1 |

TABLE II-continued

| SEQ ID NO. | Spatial Distribution |
|---|---|
| 1061: | B:9 C:1 D:3 E:1 G:11 H:5 L:2 Q:3 S:2 AA:1 |
| 1062: | H:4 K:1 |
| 1063: | B:2 C:3 S:1 Y:2 |
| 1064: | B:2 E:1 K:1 |
| 1065: | A:2 B:32 C:48 D:3 E:8 F:10 G:34 H:46 I:1 J:3 K:14 L:1 N:22 O:14 P:30 Q:11 R:26 S:36 T:14 U:9 V:11 W:12 X:10 Y:10 Z:24 AA:32 AC:12 AD:21 |
| 1066: | A:2 B:30 C:46 D:3 E:7 F:10 G:31 H:45 I:1 3:3 K:13 L:1 N:22 O:14 P:28 Q:11 R:22 S:33 T:14 U:9 V:11 W:10 X:11 Y:8 Z:22 AA:32 AC:11 AD:18 |
| 1067: | C:1 N:2 |
| 1068: | B:4 C:3 F:1 H:10 K:2 R:1 S:3 T:2 W:1 X:1 Y:2 AA:4 AC:1 |
| 1069: | A:1 B:3 E:1 G:4 H:2 X:1 Y:1 AC:1 |
| 1070: | B:2 C:1 E:2 K:3 N:3 S:2 T:1 W:3 Y:4 AA:1 AD:3 |
| 1071: | B:1 C:1 E:1 K:2 N:2 S:1 T:1 W:2 Y:2 AA:1 AC:1 AD:3 |
| 1072: | B:24 C:6 H:11 O:1 P:3 S:2 T:2 V:2 W:5 Y:2 Z:1 AA:2 AD:1 |
| 1073: | H:3 O:1 W:2 |
| 1074: | Q:1 R:1 S:1 T:1 |
| 1075: | B:2 G:2 P:1 S:2 |
| 1076: | B:1 Y:2 |
| 1077: | B:45 G:1 K:1 Y:4 |
| 1078: | B:54 G:1 K:1 Y:4 |
| 1079: | B:5 X:1 |
| 1080: | C:1 K:3 |
| 1081: | A:1 B:50 C:96 D:10 E:15 F:2 G:68 H:137 I:4 J:10 K:51 N:7 O:30 P:63 Q:41 R:22 S:101 T:19 V:7 W:19 X:4 Y:15 Z:12 AA:48 AC:19 AD:38 |
| 1082: | H:1 T:4 V:3 |
| 1083: | A:2 B:1 C:2 E:3 H:5 K:1 N:1 P:4 Q:1 S:5 T:9 W:1 X:3 Y:2 Z:1 AC:2 AD:1 |
| 1084: | B:1 H:1 J:1 N:3 S:2 U:5 X:1 |
| 1085: | H:2 AC:1 |
| 1086: | L:1 X:1 |
| 1087: | J:2 X:1 |
| 1088: | B:1 O:2 S:1 |
| 1089: | B:5 C:4 G:7 H:16 I:1 J:2 K:3 L:1 N:2 O:6 P:2 Q:1 S:6 V:1 W:5 X:2 Y:2 Z:1 AA:1 |
| 1090: | B:8 C:5 G:8 H:22 I:2 J:1 K:5 L:2 N:2 O:7 P:4 Q:2 S:10 V:1 W:5 X:2 Y:4 Z:2 AA:2 |
| 1091: | B:8 C:4 G:9 H:22 I:2 J:2 K:5 L:2 N:1 O:7 P:4 Q:2 S:10 V:1 W:4 X:1 Y:4 Z:2 AA:2 |
| 1092: | B:11 C:8 G:14 H:32 I:3 J:3 K:7 L:3 N:3 O:12 P:6 Q:3 S:15 V:1 W:7 X:3 Y:6 Z:2 AA:3 |
| 1093: | B:11 C:8 G:14 H:32 I:3 J:3 K:7 L:3 N:3 O:12 P:6 Q:3 S:15 V:1 W:7 X:3 Y:6 Z:2 AA:3 |
| 1094: | B:4 F:1 G:1 H:2 R:1 T:2 |
| 1095: | H:1 I:1 |
| 1096: | B:1 J:2 O:4 S:1 |
| 1097: | F:1 H:2 S:1 W:2 Y:1 AA:1 |
| 1098: | O:1 S:1 AD:1 |
| 1099: | N:1 S:1 T:1 AC:1 |
| 1100: | H:1 V:1 |
| 1101: | B:2 |
| 1102: | P:1 X:1 |
| 1103: | H:4 |
| 1104: | A:2 B:35 C:99 D:14 E:25 F:6 G:35 H:62 J:6 K:71 N:6 O:40 P:28 Q:32 R:6 S:56 T:6 U:5 V:2 X:12 Y:9 Z:5 AA:156 AB:2 AC:12 AD:80 |
| 1105: | A:1 D:1 G:1 K:3 P:2 Q:1 S:2 AA:2 |
| 1106: | G:2 O:1 T:1 V:1 |
| 1107: | H:1 P:3 |
| 1108: | S:2 AC:1 |
| 1109: | B:3 H:1 N:1 O:1 Q:2 Y:1 Z:1 |
| 1110: | N:2 |
| 1111: | H:1 W:2 |
| 1112: | P:1 S:1 |
| 1113: | Y:2 Z:1 |
| 1114: | B:1 Q:1 S:2 Y:2 AC:2 |
| 1115: | B:3 G:2 O:1 AA:3 |
| 1116: | AD:4 |
| 1117: | S:1 T:4 |
| 1118: | B:2 P:1 |
| 1119: | B:5 H:2 W:2 |
| 1120: | G:2 |
| 1121: | B:3 S:3 W:3 Y:1 AC:1 AD:1 |
| 1122: | S:1 Y:1 |
| 1123: | K:3 S:5 T:5 |
| 1124: | B:2 C:1 G:3 H:1 K:1 |
| 1125: | C:1 P:1 |
| 1126: | AA:4 |
| 1127: | B:1 L:1 T:2 AA:4 |
| 1128: | B:6 C:1 E:2 G:3 H:14 J:2 K:1 N:1 P:1 Q:5 S:5 T:7 U:2 V:2 Y:3 |
| 1129: | B:4 F:2 G:2 R:2 S:2 AC:1 |
| 1130: | B:1 C:1 E:1 S:1 |
| 1131: | B:2 C:2 H:4 |
| 1132: | H:4 P:1 |
| 1133: | H:1 W:1 |
| 1134: | F:1 P:3 T:1 |
| 1135: | B:2 G:3 |
| 1136: | B:6 C:6 G:2 H:9 I:2 K:1 O:2 P:8 Q:2 R:3 S:5 T:3 Y:5 Z:24 AA:1 AD:4 |
| 1137: | A:1 B:2 E:1 H:2 K:2 O:1 P:1 S:3 T:4 W:3 Y:1 AA:4 |
| 1138: | B:3 G:1 S:1 |
| 1139: | A:2 B:3 C:3 G:1 H:3 J:3 O:1 R:1 S:6 V:3 W:1 Y:1 AA:4 |
| 1140: | A:1 B:3 C:2 G:1 H:2 J:1 O:1 R:1 S:4 V:3 W:1 Y:1 AA:4 |
| 1141: | B:1 C:1 H:3 S:1 Y:2 AA:1 |
| 1142: | B:1 F:1 G:1 H:1 O:3 R:1 S:3 T:2 AA:2 |
| 1143: | B:8 H:1 |
| 1144: | B:2 C:1 I:1 P:2 S:2 |
| 1145: | F:203 R:58 S:1 AA:1 |
| 1146: | S:2 X:1 |
| 1147: | B:2 G:1 H:1 S:1 |
| 1148: | B:1 K:1 |
| 1149: | P:1 AA:1 |
| 1150: | B:1 K:2 O:1 Y:2 AA:1 |
| 1151: | B:6 Y:3 |
| 1152: | B:3 H:1 Y:1 |
| 1153: | O:1 V:2 |
| 1154: | P:2 |
| 1155: | C:1 H:1 AA:2 |
| 1156: | H:4 S:1 Y:1 AC:1 |
| 1157: | H:4 S:2 Y:2 AC:1 |
| 1158: | B:4 G:6 H:2 Q:2 S:1 W:1 AA:2 |
| 1159: | B:4 S:1 T:1 |
| 1160: | H:3 T:1 |
| 1161: | N:2 S:3 Y:1 |
| 1162: | V:4 |
| 1163: | B:1 F:1 O:1 |

TABLE II-continued

| SEQ ID NO. | Spatial Distribution |
|---|---|
| 1164: | B:1 C:1 |
| 1165: | E:1 H:4 |
| 1166: | B:1 C:1 E:1 H:7 P:1 S:2 W:3 AA:1 AD:3 |
| 1167: | B:1 C:1 E:1 H:5 P:1 S:3 W:4 AA:1 AD:3 |
| 1168: | B:2 H:2 K:1 O:2 W:4 |
| 1169: | C:2 H:2 K:1 S:1 V:1 |
| 1170: | C:1 H:3 K:1 S:2 V:1 |
| 1171: | B:5 C:2 G:1 S:2 AD:1 |
| 1172: | B:1 F:2 G:1 O:2 T:1 |
| 1173: | Y:1 AA:1 |
| 1174: | B:1 G:1 |
| 1175: | B:3 C:2 H:4 K:1 O:3 P:1 R:2 T:2 Y:1 AA:1 |
| 1176: | B:2 H:4 S:2 W:3 AA:3 |
| 1177: | B:2 F:1 H:3 K:1 Y:1 AA:4 AC:2 |
| 1178: | B:1 C:7 G:1 H:2 K:1 Y:2 Z:1 |
| 1179: | B:1 C:4 H:4 Y:1 Z:2 |
| 1180: | B:4 C:3 F:1 G:1 H:2 O:1 T:1 Y:3 Z:1 AC:1 |
| 1181: | B:7 G:3 Y:1 |
| 1182: | B:5 C:3 H:3 O:1 U:1 |
| 1183: | P:1 S:1 |
| 1184: | X:1 Y:68 |
| 1185: | C:4 K:1 |
| 1186: | A:2 B:3 C:34 E:6 F:1 G:20 H:20 I:3 J:5 K:8 N:13 O:6 P:41 Q:2 R:3 S:36 T:10 V:4 X:1 Y:4 AA:8 AC:6 AD:8 |
| 1187: | P:1 U:2 |
| 1188: | B:2 C:3 D:1 G:4 H:1 J:1 K:2 L:2 O:3 P:1 Q:1 S:2 Y:1 AD:3 |
| 1189: | B:2 C:3 D:1 G:4 H:1 J:1 K:2 L:2 O:3 P:1 Q:1 S:2 Y:1 AD:3 |
| 1190: | C:1 X:2 AD:1 |
| 1191: | B:1 D:2 F:1 H:2 O:2 Q:1 S:1 AA:1 AC:1 |
| 1192: | G:2 T:1 |
| 1193: | H:2 P:1 |
| 1194: | B:2 C:1 B:1 T:9 W:2 AC:2 |
| 1195: | P:1 S:3 |
| 1196: | C:1 P:1 R:1 |
| 1197: | B:8 G:2 H:4 O:1 T:1 V:1 |
| 1198: | B:6 H:3 P:2 |
| 1199: | B:1 C:1 K:1 X:1 AA:1 |
| 1200: | H:1 S:2 |
| 1201: | B:2 |
| 1202: | C:2 E:2 H:3 |
| 1203: | H:2 Y:1 |
| 1204: | B:1 C:2 S:3 |
| 1205: | B:3 C:2 G:1 J:2 S:1 T:5 Y:4 AA:1 AC:1 |
| 1206: | B:4 G:4 H:2 I:1 Q:1 S:2 T:1 W:2 |
| 1207: | B:8 G:5 H:2 I:2 Q:4 S:3 T:2 W:2 |
| 1208: | O:1 P:2 |
| 1209: | B:3 |
| 1210: | Y:3 |
| 1211: | B:2 H:1 L:1 N:1 Y:1 AA:3 |
| 1212: | B:15 C:7 D:1 E:4 F:2 G:9 H:7 J:2 K:4 L:5 N:6 O:2 P:2 Q:1 S:6 T:5 V:1 W:5 Y:11 Z:3 AA:1 AC:4 AD:1 |
| 1213: | B:15 C:7 D:1 E:4 F:2 G:9 H:7 J:2 K:4 L:5 N:6 O:2 P:2 Q:1 S:6 T:5 V:1 W:4 Y:11 Z:3 AA:1 AC:3 AD:1 |
| 1214: | B:70 C:8 G:20 H:17 I:1 J:1 K:6 L:1 N:1 O:6 P:2 Q:1 S:10 T:1 V:5 W:2 Y:4 Z:1 AA:6 |
| 1215: | Y:3 |
| 1216: | AA:3 |
| 1217: | C:1 G:3 AD:1 |
| 1218: | B:1 C:2 |
| 1219: | H:7 N:7 |
| 1220: | B:3 C:19 H:3 L:2 S:1 Y:1 |
| 1221: | B:2 C:17 H:3 L:2 S:1 Y:1 |
| 1222: | A:4 B:46 C:73 D:7 E:12 G:59 H:207 K:6 N:8 O:13 P:24 Q:18 R:6 S:79 T:24 V:12 W:17 Y:26 Z:4 AA:16 AC:8 AD:2 |
| 1223: | A:2 B:25 C:39 D:6 E:6 G:36 H:113 K:3 N:4 O:10 P:15 Q:13 R:3 S:43 T:13 Y:6 W:9 Y:16 Z:2 AA:10 AC:4 AD:1 |
| 1224: | Y:1 AD:1 |
| 1225: | K:3 S:2 |
| 1226: | B:2 |
| 1227: | B:1 AA:1 |
| 1228: | B:4 C:1 E:1 H:1 J:1 K:2 P:1 R:1 Y:3 |
| 1229: | B:2 H:5 K:1 T:1 W:1 Z:3 AA:2 |
| 1230: | B:2 H:5 K:1 T:1 W:1 Z:3 AA:2 |
| 1231: | A:4 B:18 C:38 E:1 G:24 H:37 I:3 J:1 K:12 N:2 O:3 P:2 Q:1 R:1 S:44 T:9 U:2 W:9 X:3 Y:10 Z:2 AA:6 AC:3 AD:18 |
| 1232: | B:8 Y:1 |
| 1233: | B:1 J:2 AA:1 |
| 1234: | C:1 H:2 W:3 AC:2 |
| 1235: | E:2 O:1 AA:5 |
| 1236: | O:1 W:1 |
| 1237: | P:1 Z:2 AC:1 AD:1 |
| 1238: | C:1 H:1 R:2 AC:1 |
| 1239: | B:19 C:4 F:1 H:5 I:1 J:4 K:3 O:2 P:4 R:8 S:7 U:2 W:1 X:1 Y:7 AA:6 AC:1 AD:2 |
| 1240: | C:4 O:1 P:2 AC:1 |
| 1241: | B:11 D:2 E:2 F:1 G:4 H:8 K:4 O:2 P:4 R:3 S:8 V:2 X:4 Z:2 AA:3 AC:2 AD:5 |
| 1242: | A:1 H:1 O:2 |
| 1243: | G:3 |
| 1244: | C:2 V:1 X:1 |
| 1245: | O:4 S:1 AA:4 |
| 1246: | A:1 E:1 H:1 AA:1 AD:1 |
| 1247: | B:1 H:3 X:4 |
| 1248: | B:1 H:1 P:2 AA:1 |
| 1249: | B:5 C:5 G:2 H:4 Q:1 R:1 S:2 W:2 AC:1 |
| 1250: | N:1 P:2 Z:1 |
| 1251: | B:5 C:1 E:1 G:2 J:1 K:2 O:2 S:1 Y:1 AA:2 |
| 1252: | H:4 AA:1 |
| 1253: | R:3 |
| 1254: | B:4 C:4 G:1 H:6 J:1 K:2 O:2 T:2 Y:1 AA:3 AD:1 |
| 1255: | B:2 C:3 G:1 H:5 O:1 Y:1 AA:3 AD:1 |
| 1256: | C:3 F:1 G:3 H:1 |
| 1257: | G:1 H:1 O:2 Y:1 AC:1 |
| 1258: | B:3 H:1 Y:2 |
| 1259: | P:2 S:1 |
| 1260: | S:2 AA:1 |
| 1261: | B:1 C:2 H:1 J:2 |
| 1262: | B:3 |
| 1263: | B:1 D:1 O:1 |
| 1264: | AA:2 |
| 1265: | E:1 H:1 AA:2 |
| 1266: | G:1 V:1 Y:1 |
| 1267: | D:1 W:3 Y:1 |
| 1268: | P:3 S:1 |

TABLE II-continued

| SEQ ID NO. | Spatial Distribution |
|---|---|
| 1269: | B:36 C:21 D:4 E:12 G:48 H:16 K:7 N:1 O:8 P:17 Q:27 R:2 S:17 U:3 W:3 X:3 Y:13 Z:3 AA:4 AC:12 |
| 1270: | B:18 C:12 D:2 E:4 G:28 H:10 K:4 N:1 O:5 P:7 Q:12 R:2 S:9 U:1 W:1 X:1 Y:5 Z:1 AA:4 AC:4 |
| 1271: | B:2 G:1 H:1 N:3 Z:2 AA:2 |
| 1272: | B:1 E:1 W:3 X:1 AA:1 |
| 1273: | F:4 R:1 S:3 |
| 1274: | A:1 B:14 C:50 E:2 F:7 G:13 H:22 I:3 J:3 K:19 N:1 O:7 P:19 Q:3 R:4 S:31 T:10 U:3 V:2 W:3 X:4 Y:3 Z:3 AA:13 AC:8 AD:13 |
| 1275: | F:1 H:2 K:1 S:1 T:1 |
| 1276: | B:3 |
| 1277: | B:1 K:2 S:7 Y:1 |
| 1278: | B:6 W:7 Y:1 |
| 1279: | K:1 S:1 |
| 1280: | B:1 C:2 E:2 H:6 I:1 R:1 S:5 AA:1 AC:1 |
| 1281: | B:1 C:5 E:2 H:7 I:2 R:2 S:6 AA:1 AC:1 |
| 1282: | B:2 C:3 E:2 H:6 I:2 R:1 S:5 AA:1 AC:1 |
| 1283: | R:1 S:3 |
| 1284: | C:2 H:1 Q:3 |
| 1285: | H:1 O:1 Q:2 |
| 1286: | O:1 S:3 W:2 |
| 1287: | B:1 AD:1 |
| 1288: | B:2 D:3 G:1 N:2 O:2 Q:2 S:2 Z:2 AA:1 |
| 1289: | B:41 C:71 D:6 E:1 F:2 G:28 H:57 I:2 J:3 K:16 N:4 O:13 P:32 Q:10 R:8 S:36 T:1 U:1 W:16 X:3 Y:23 Z:7 AA:20 AB:2 AC:7 AD:4 |
| 1290: | B:54 C:84 D:9 E:1 F:2 G:29 H:70 I:2 J:3 K:21 N:5 O:15 P:37 Q:13 R:8 S:42 T:1 U:1 W:17 X:4 Y:25 Z:9 AA:24 AB:3 AC:7 AD:3 |
| 1291: | B:54 C:84 D:9 E:1 F:2 G:29 H:70 I:2 J:3 K:21 N:5 O:15 P:37 Q:13 R:8 S:42 T:1 U:1 W:17 X:4 Y:25 Z:9 AA:24 AB:3 AC:7 AD:3 |
| 1292: | H:3 S:2 |
| 1293: | A:2 B:3 C:2 H:13 P:1 S:2 T:3 AA:8 AC:1 AD:2 |
| 1294: | B:3 C:1 D:1 E:2 H:2 T:1 Y:2 |
| 1295: | C:1 E:1 P:2 T:1 Z:1 AA:1 |
| 1296: | O:2 |
| 1297: | B:5 E:1 K:3 P:1 S:3 V:2 |
| 1298: | G:9 |
| 1299: | B:16 Y:1 |
| 1300: | B:9 G:1 |
| 1301: | H:1 R:1 AA:1 |
| 1302: | B:2 P:1 S:1 |
| 1303: | B:10 E:1 H:5 J:2 K:2 R:1 S:3 X:6 Y:1 AC:1 |
| 1304: | C:2 F:1 H:1 W:3 |
| 1305: | H:1 R:2 |
| 1306: | H:2 O:1 R:5 S:2 |
| 1307: | B:3 C:1 G:4 |
| 1308: | C:2 P:1 T:1 AA:1 |
| 1309: | B:5 C:2 H:1 P:4 |
| 1310: | C:2 S:4 |
| 1311: | B:1 O:3 AC:2 |
| 1312: | S:2 |
| 1313: | B:2 R:1 S:1 |
| 1314: | X:1 AA:3 |
| 1315: | C:1 J:1 |
| 1316: | C:1 H:8 K:1 O:3 Q:1 X:1 AA:2 AC:2 AD:3 |
| 1317: | O:1 S:1 V:1 |
| 1318: | G:4 H:1 I:1 W:1 |
| 1319: | B:9 C:5 E:1 F:2 G:1 H:5 K:2 O:1 P:2 R:6 S:4 T:2 W:4 Z:3 AA:1 AD:1 |
| 1320: | B:10 C:4 E:2 F:1 H:6 K:1 O:1 P:3 R:10 S:5 T:4 W:6 Z:2 AA:1 AD:1 |
| 1321: | G:3 H:2 S:1 |
| 1322: | C:3 H:2 S:7 T:2 W:2 AC:2 |
| 1323: | B:9 F:1 S:2 Y:1 AC:1 |
| 1324: | E:2 H:1 S:1 AA:1 |
| 1325: | B:5 H:4 S:7 W:1 Y:1 AC:2 |
| 1326: | B:2 H:1 |
| 1327: | B:3 G:2 W:1 |
| 1328: | G:4 H:3 S:1 |
| 1329: | B:1 P:1 AA:1 |
| 1330: | B:3 |
| 1331: | B:1 C:3 F:1 L:2 N:2 O:2 Q:1 R:7 S:1 T:2 |
| 1332: | B:3 C:6 F:2 H:1 L:4 N:4 O:4 Q:2 R:10 S:2 T:1 |
| 1333: | B:3 C:6 F:2 H:2 L:4 N:4 O:4 Q:2 R:10 S:2 T:3 |
| 1334: | B:5 C:1 E:1 H:3 T:3 AC:2 |
| 1335: | A:1 J:3 O:1 P:3 S:2 X:1 AA:1 |
| 1336: | B:1 C:1 H:1 P:1 |
| 1337: | B:1 C:1 H:2 W:2 |
| 1338: | B:1 H:3 S:4 Y:2 |
| 1339: | B:9 C:31 D:4 E:11 F:1 G:19 H:28 I:2 J:3 K:16 N:2 O:5 P:7 Q:2 R:3 S:31 T:25 U:1 W:2 Y:6 Z:7 AA:6 AC:11 AD:3 |
| 1340: | P:3 W:1 |
| 1341: | B:23 C:79 D:1 E:17 F:8 G:20 H:56 I:2 J:7 K:28 N:2 O:12 P:45 Q:4 R:11 S:44 T:46 U:2 V:5 W:11 X:9 Y:10 Z:10 AA:20 AC:11 AD:26 |
| 1342: | H:5 |
| 1343: | B:8 C:7 E:1 G:1 H:15 J:2 K:5 O:4 P:3 S:6 T:1 W:1 Y:1 AC:4 |
| 1344: | C:4 F:1 H:10 J:4 L:2 N:3 O:1 P:3 Q:1 S:2 V:4 AC:4 |
| 1345: | B:2 C:2 F:2 H:3 J:2 K:1 Q:1 R:1 S:1 X:1 Y:3 AA:2 AC:1 |
| 1346: | B:1 C:1 P:7 S:2 T:2 Y:1 AA:2 |
| 1347: | B:2 C:1 P:6 S:2 T:2 Y:1 AA:2 |
| 1348: | H:3 R:1 AD:1 |
| 1349: | C:1 S:2 |
| 1350: | K:3 P:3 Q:2 T:1 V:1 X:4 |
| 1351: | K:5 P:3 Q:1 T:1 V:1 X:4 |
| 1352: | B:2 |
| 1353: | C:2 G:3 H:2 O:1 P:1 R:3 V:3 Y:1 AA:1 |
| 1354: | B:1 D:1 G:6 H:4 T:2 X:1 Y:1 |
| 1355: | B:5 C:1 H:2 S:1 T:3 |
| 1356: | B:3 C:2 H:4 S:1 AC:2 |
| 1357: | B:4 G:2 |
| 1358: | E:1 O:1 P:2 |
| 1359: | A:1 B:62 C:102 D:5 E:21 F:5 G:109 H:91 I:2 J:24 K:35 N:14 O:18 P:105 Q:37 R:30 S:72 T:17 U:2 V:7 W:22 X:18 Y:26 Z:22 AA:88 AB:1 AC:26 AD:45 |
| 1360: | A:1 B:62 C:102 D:5 E:20 F:5 G:109 H:91 I:2 J:24 K:35 N:14 O:20 P:105 Q:37 R:30 S:72 T:17 U:2 V:7 W:22 X:18 Y:26 Z:22 AA:88 AB:1 AC:26 AD:45 |

TABLE II-continued

| SEQ ID NO. | Spatial Distribution |
|---|---|
| 1361: | AA:3 |
| 1362: | B:2 |
| 1363: | B:1 C:2 H:2 K:1 P:1 Q:1 V:1 Y:2 |
| 1364: | O:1 S:1 U:1 |
| 1365: | P:1 S:1 Y:3 |
| 1366: | B:15 C:21 D:3 E:8 F:13 G:12 H:42 J:2 K:12 L:1 N:4 O:8 P:22 Q:7 S:12 T:24 W:2 X:17 Y:6 Z:2 AA:22 AC:8 AD:13 |
| 1367: | B:19 C:30 D:4 E:13 F:19 G:15 H:59 J:2 K:17 L:2 N:5 O:12 P:31 Q:11 S:17 T:39 W:3 X:21 Y:7 Z:4 AA:34 AC:11 AD:22 |
| 1368: | G:2 H:1 S:1 T:4 W:1 |
| 1369: | D:1 O:1 P:2 X:2 AA:1 |
| 1370: | D:2 O:1 P:2 X:2 AA:1 |
| 1371: | F:1 K:1 N:2 O:1 |
| 1372: | B:9 C:1 G:1 H:4 K:2 O:2 S:4 T:1 Y:2 |
| 1373: | B:1 C:2 O:1 S:2 W:3 |
| 1374: | C:1 N:5 T:1 AA:2 |
| 1375: | H:1 V:1 AC:2 |
| 1376: | C:1 W:2 |
| 1377: | W:4 |
| 1378: | G:1 H:1 S:1 |
| 1379: | T:2 |
| 1380: | H:4 N:1 P:1 Q:1 |
| 1381: | B:3 H:3 K:1 P:1 T:2 V:1 |
| 1382: | S:1 W:2 |
| 1383: | H:2 O:2 AA:2 |
| 1384: | B:1 C:1 F:1 P:2 S:1 Y:1 Z:1 |
| 1385: | B:8 G:1 |
| 1386: | R:4 |
| 1387: | B:5 G:1 H:6 K:1 O:1 P:2 S:2 W:2 Y:1 AA:1 |
| 1388: | C:2 F:1 K:2 O:1 S:1 V:3 |
| 1389: | E:1 W:2 |
| 1390: | B:1 K:3 O:1 P:1 Z:1 |
| 1391: | S:2 |
| 1392: | C:1 G:2 K:3 S:2 Y:2 Z:2 AA:3 |
| 1393: | G:1 H:2 J:1 Y:3 |
| 1394: | B:8 D:3 G:2 H:4 K:3 P:6 Q:1 S:4 T:10 W:1 X:1 AA:1 AC:1 |
| 1395: | C:1 E:2 G:1 Y:1 |
| 1396: | H:2 |
| 1397: | B:8 C:8 G:3 H:6 Q:1 S:7 T:2 X:2 |
| 1398: | B:1 C:1 H:2 S:2 |
| 1399: | B:1 C:7 U:4 AD:2 |
| 1400: | B:42 C:21 E:4 F:1 G:9 H:21 I:5 J:20 K:7 N:2 O:4 P:17 Q:2 R:8 S:19 T:17 U:1 V:3 W:14 X:3 Y:21 Z:4 AA:19 AC:7 AD:8 |
| 1401: | B:42 C:21 E:4 F:1 G:9 H:21 I:5 J:20 K:7 N:2 O:4 P:17 Q:2 R:8 S:19 T:17 U:1 V:3 W:14 X:3 Y:21 Z:4 AA:19 AC:7 AD:8 |
| 1402: | B:4 C:19 E:9 F:4 G:8 H:28 J:3 K:11 N:4 O:5 P:13 Q:18 S:28 T:13 W:8 X:2 Y:1 Z:5 AA:29 AC:2 AD:14 |
| 1403: | A:1 B:3 C:3 G:3 H:3 J:2 O:7 P:3 Q:2 R:2 S:1 T:2 U:2 X:1 Z:2 AA:2 AD:2 |
| 1404: | A:1 B:2 C:1 G:2 H:2 J:1 O:2 P:3 Q:1 S:1 T:2 X:1 Z:1 AA:2 |
| 1405: | A:2 B:5 C:4 G:5 H:6 J:3 O:9 P:2 Q:4 R:3 S:2 T:4 U:2 Z:4 AA:2 AD:3 |
| 1406: | C:2 G:1 K:1 |
| 1407: | G:2 S:2 T:2 |
| 1408: | B:4 G:3 O:1 X:1 AA:1 |
| 1409: | B:1 R:2 Y:2 |
| 1410: | B:5 R:1 T:3 AA:1 |
| 1411: | B:2 |
| 1412: | B:2 C:2 H:1 W:2 |
| 1413: | A:2 C:2 E:2 N:1 S:2 V:8 |
| 1414: | A:2 C:2 E:2 N:1 S:2 V:8 |
| 1415: | B:2 P:1 |
| 1416: | D:1 G:2 |
| 1417: | E:2 H:2 S:1 AC:1 |
| 1418: | B:2 J:1 Y:2 |
| 1419: | B:4 E:1 S:2 AA:1 |
| 1420: | B:2 Q:1 T:2 AC:1 |
| 1421: | B:2 H:2 K:1 O:1 S:2 T:1 W:1 Z:1 |
| 1422: | B:1 C:8 D:2 G:1 H:9 K:6 O:1 P:5 Q:2 R:2 S:8 U:1 Z:1 AA:5 AC:2 |
| 1423: | B:6 C:8 G:2 K:4 S:9 |
| 1424: | B:1 Y:2 |
| 1425: | B:2 C:3 S:1 T:3 Y:1 Z:2 AA:2 |
| 1426: | B:2 G:5 |
| 1427: | B:2 G:5 |
| 1428: | B:3 C:24 E:8 F:7 G:20 H:21 J:3 K:6 L:1 N:7 O:8 P:10 Q:1 R:5 S:27 T:42 W:5 X:1 Y:1 AA:7 AC:4 AD:9 |
| 1429: | B:1 C:1 X:1 AC:1 |
| 1430: | A:1 G:1 J:3 X:2 AA:2 |
| 1431: | O:1 W:1 |
| 1432: | Y:1 AC:1 |
| 1433: | C:1 K:1 S:2 |
| 1434: | B:2 C:1 H:2 O:2 S:2 T:2 Y:2 AA:1 AC:1 |
| 1435: | C:1 R:3 T:1 |
| 1436: | B:2 |
| 1437: | G:2 H:5 S:2 T:1 |
| 1438: | X:2 |
| 1439: | G:1 H:3 N:1 P:2 S:1 T:1 AA:6 |
| 1440: | B:1 Y:3 Z:1 |
| 1441: | C:3 |
| 1442: | E:1 R:1 W:2 X:2 |
| 1443: | A:1 B:1 H:4 O:5 X:2 AA:1 |
| 1444: | C:2 D:2 G:2 H:3 J:1 S:1 AA:4 AC:1 |
| 1445: | B:2 O:2 S:1 |
| 1446: | C:1 H:1 N:1 |
| 1447: | S:1 T:3 AC:3 |
| 1448: | B:3 |
| 1449: | B:2 |
| 1450: | B:16 C:7 E:2 G:6 H:13 Q:4 S:4 X:2 AA:2 AC:2 |
| 1451: | AA:2 |
| 1452: | H:1 P:3 AA:2 |
| 1453: | H:3 I:1 T:3 W:1 AC:1 |
| 1454: | O:1 U:1 AA:2 |
| 1455: | C:4 H:2 |
| 1456: | F:2 H:1 |
| 1457: | B:5 AC:1 |
| 1458: | B:5 AC:1 |
| 1459: | B:2 H:1 O:2 |
| 1460: | K:1 Q:1 Y:1 |
| 1461: | H:5 |
| 1462: | B:3 E:2 H:3 K:1 R:2 |
| 1463: | B:1 K:1 |
| 1464: | B:3 S:2 Y:2 |
| 1465: | B:1 G:2 |
| 1466: | B:1 G:1 |
| 1467: | B:1 S:1 |
| 1468: | C:1 F:1 G:1 N:1 P:1 S:4 Y:2 AA:1 |
| 1469: | C:2 K:1 T:2 V:1 AC:2 |
| 1470: | B:9 H:1 |

TABLE II-continued

| SEQ ID NO. | Spatial Distribution |
|---|---|
| 1471: | B:6 H:2 S:2 W:1 AA:3 |
| 1472: | B:5 H:2 S:1 W:1 AA:1 |
| 1473: | H:2 |
| 1474: | B:2 H:1 K:2 O:2 P:1 R:2 S:1 T:1 AA:2 |
| 1475: | B:5 C:6 G:2 H:2 K:2 Y:1 |
| 1476: | B:2 C:3 E:1 K:2 L:1 N:1 S:3 |
| 1477: | H:1 S:1 AA:3 |
| 1478: | G:1 O:1 |
| 1479: | E:1 O:1 |
| 1480: | F:1 H:3 K:1 S:3 X:1 |
| 1481: | B:2 R:1 S:1 |
| 1482: | B:2 |
| 1483: | B:1 F:1 AA:1 |
| 1484: | B:1 S:2 |
| 1485: | AA:7 |
| 1486: | H:4 K:3 S:3 Z:3 |
| 1487: | H:2 K:6 S:5 Z:2 |
| 1488: | F:2 H:1 S:1 W:2 Y:1 |
| 1489: | G:2 H:1 |
| 1490: | G:4 H:1 P:2 X:1 |
| 1491: | B:4 H:1 O:2 S:2 Y:2 AC:1 |
| 1492: | C:1 G:1 K:2 |
| 1493: | B:12 C:6 F:2 K:2 L:1 S:6 T:3 Y:1 |
| 1494: | AA:2 |
| 1495: | G:3 K:2 T:2 X:2 |
| 1496: | B:1 C:2 S:1 |
| 1497: | H:1 T:1 |
| 1498: | H:8 R:2 AA:2 |
| 1499: | Y:4 |
| 1500: | C:1 G:1 H:5 S:4 AC:1 |
| 1501: | S:1 AA:1 |
| 1502: | C:1 P:1 |
| 1503: | B:3 |
| 1504: | B:2 H:2 |
| 1505: | F:1 J:1 |
| 1506: | C:1 K:2 L:1 S:8 T:12 W:1 AA:7 AC:18 AD:1 |
| 1507: | B:19 G:1 Y:2 |
| 1508: | B:10 Y:1 |
| 1509: | S:1 AD:1 |
| 1510: | B:29 C:11 E:1 G:4 H:10 K:6 O:5 P:5 S:8 T:5 V:1 W:5 X:1 Y:3 Z:2 AA:2 AC:6 |
| 1511: | N:3 |
| 1512: | H:2 Q:1 S:2 |
| 1513: | H:1 Q:1 S:2 |
| 1514: | H:1 Q:2 S:2 |
| 1515: | B:1 R:1 V:1 W:1 |
| 1516: | B:4 W:3 |
| 1517: | B:2 G:1 H:5 P:3 S:2 U:3 W:1 Y:1 |
| 1518: | C:6 H:2 I:2 N:1 R:1 S:2 T:7 Y:2 |
| 1519: | A:1 B:3 C:10 F:2 G:6 H:12 K:1 O:7 P:1 R:2 S:9 T:1 W:3 AA:1 AC:4 |
| 1520: | G:2 K:2 AD:1 |
| 1521: | Q:1 S:2 W:1 X:2 |
| 1522: | B:1 N:1 R:2 S:1 |
| 1523: | E:1 H:1 K:1 P:1 T:1 W:1 |
| 1524: | A:1 C:2 E:2 W:1 |
| 1525: | B:2 |
| 1526: | T:2 |
| 1527: | C:1 E:1 H:2 O:1 P:1 T:1 AC:1 |
| 1528: | B:3 C:2 D:1 G:1 H:9 O:3 P:1 S:2 V:1 W:2 Z:6 AA:9 AD:4 |
| 1529: | F:5 R:8 |
| 1530: | B:1 O:1 T:1 |
| 1531: | H:1 K:1 AA:1 |
| 1532: | H:2 |
| 1533: | R:19 S:4 |
| 1534: | R:15 S:5 |
| 1535: | AA:9 |
| 1536: | B:2 C:2 H:1 K:2 Y:1 Z:1 |
| 1537: | B:1 C:1 T:5 Y:3 |
| 1538: | B:5 D:2 W:7 Y:8 |
| 1539: | C:2 G:3 H:2 S:3 W:4 X:3 |
| 1540: | B:3 C:1 E:4 G:2 H:5 J:1 K:1 O:1 P:1 S:1 T:2 |
| 1541: | B:4 C:1 E:5 G:2 H:4 J:2 K:2 O:1 P:1 S:2 T:2 |
| 1542: | B:5 C:2 E:7 G:2 H:4 J:2 K:2 O:2 P:2 S:2 T:4 |
| 1543: | C:5 G:1 H:5 O:4 S:2 W:1 |
| 1544: | C:1 H:4 K:1 O:1 P:2 |
| 1545: | B:2 O:1 T:1 Y:1 AC:1 |
| 1546: | B:2 D:1 E:3 K:2 Y:4 AC:2 |
| 1547: | H:2 AA:1 |
| 1548: | C:2 K:1 S:1 |
| 1549: | B:2 |
| 1550: | C:3 F:1 K:1 |
| 1551: | B:1 E:1 H:1 N:1 Y:1 |
| 1552: | C:1 F:1 S:1 T:1 |
| 1553: | B:1 H:3 |
| 1554: | C:1 J:1 |
| 1555: | C:2 |
| 1556: | B:3 F:2 Q:1 W:1 AC:1 |
| 1557: | B:1 C:1 F:3 G:1 H:3 N:6 R:1 W:3 |
| 1558: | H:1 N:2 O:1 P:3 T:6 |
| 1559: | A:6 B:2 K:1 AA:1 |
| 1560: | B:1 C:1 G:1 J:1 P:3 S:1 T:3 Y:1 AA:1 AC:1 |
| 1561: | B:3 |
| 1562: | B:1 D:1 R:1 AD:1 |
| 1563: | E:1 H:5 P:1 W:1 |
| 1564: | P:4 |
| 1565: | B:2 |
| 1566: | F:1 O:1 W:1 |
| 1567: | B:2 S:1 |
| 1568: | P:2 |
| 1569: | S:1 T:1 AC:1 AD:1 |
| 1570: | B:3 C:2 H:4 N:4 O:1 S:2 V:1 Y:1 |
| 1571 | A:4 H:1 Y:2 |
| 1572: | N:1 Q:1 |
| 1573: | B:18 C:8 D:3 E:4 F:1 G:8 H:16 J:1 K:3 N:1 O:5 P:13 Q:1 R:4 S:15 T:14 U:1 V:5 W:5 X:2 Y:1 Z:3 AA:11 AD:5 |
| 1574: | B:4 C:1 G:1 K:3 S:2 W:2 AD:2 |
| 1575: | B:1 E:1 H:3 W:1 AA:1 |
| 1576: | H:1 V:2 |
| 1577: | B:1 C:1 H:3 P:1 S:2 AC:1 |
| 1578: | C:3 Z:1 |
| 1579: | C:1 Q:2 |
| 1580: | H:1 P:1 Q:2 |
| 1581: | B:4 F:1 O:1 |
| 1582: | C:6 D:1 AA:1 |
| 1583: | B:2 H:2 |
| 1584: | H:2 T:1 W:1 |
| 1585: | H:5 P:1 |
| 1586: | K:3 AA:1 |
| 1587: | B:2 C:2 G:1 H:2 T:1 W:3 |
| 1588: | C:1 H:5 Y:1 |
| 1589: | B:1 H:4 |
| 1590: | B:1 H:3 N:1 R:1 T:2 AA:1 AD:2 |
| 1591: | B:4 H:3 N:3 R:2 T:4 AA:2 AD:6 |
| 1592: | H:5 K:1 Q:2 S:2 |
| 1593: | B:6 G:2 H:5 |
| 1594: | B:9 G:3 H:10 |
| 1595: | G:4 H:1 O:2 S:2 |
| 1596: | H:2 |
| 1597: | J:1 P:1 AA:1 |
| 1598: | B:1 T:1 AD:1 |
| 1599: | H:1 I:1 |
| 1600: | B:3 K:3 Q:1 |

TABLE II-continued

| SEQ ID NO. | Spatial Distribution |
|---|---|
| 1601: | B:2 C:2 H:1 O:1 |
| 1602: | E:1 T:1 AA:6 |
| 1603: | B:10 D:1 W:11 Y:2 |
| 1604: | B:11 D:2 W:10 Y:2 |
| 1605: | B:11 D:2 W:11 Y:2 |
| 1606: | B:12 D:2 W:10 Y:2 |
| 1607: | H:5 J:1 S:1 X:1 Y:3 AA:4 |
| 1608: | S:2 |
| 1609: | AA:11 |
| 1610: | C:3 H:2 P:1 T:4 W:1 |
| 1611: | B:5 H:1 K:4 P:1 S:12 T:2 AC:3 AD:4 |
| 1612: | D:1 T:1 |
| 1613: | C:2 H:1 P:2 X:1 AA:1 |
| 1614: | C:3 G:2 H:1 AA:28 |
| 1615: | C:3 G:2 H:1 AA:27 |
| 1616: | C:2 G:1 H:2 AA:18 |
| 1617: | C:4 G:2 H:3 AA:31 |
| 1618: | B:8 C:1 F:2 H:4 O:2 S:4 AC:2 |
| 1619: | B:23 C:4 D:4 E:4 F:1 G:4 H:30 I:1 J:1 K:6 N:4 O:3 P:5 Q:2 R:3 S:16 T:1 W:10 X:1 Y:2 Z:1 AA:10 AC:1 AD:1 |
| 1620: | H:2 W:7 |
| 1621: | S:2 AA:1 |
| 1622: | B:6 C:1 G:3 H:2 N:1 P:1 |
| 1623: | C:1 T:4 W:3 AA:1 |
| 1624: | B:4 H:2 O:1 S:3 U:2 |
| 1625: | B:2 H:2 O:1 S:5 U:4 |
| 1626: | G:1 H:1 P:2 |
| 1627: | G:1 N:1 |
| 1628: | B:8 C:5 E:1 H:9 K:3 P:3 S:5 T:1 AA:3 AD:2 |
| 1629: | B:4 H:5 K:2 S:1 T:1 W:3 |
| 1630: | P:1 Y:1 |
| 1631: | F:1 Y:1 |
| 1632: | B:1 C:1 F:1 M:4 T:2 AA:1 |
| 1633: | B:2 C:1 E:1 F:1 G:3 H:1 K:1 O:2 X:1 Y:1 AA:5 |
| 1634: | B:2 C:2 E:1 F:1 G:3 H:1 K:1 O:2 X:1 Y:1 AA:5 |
| 1635: | N:2 S:1 |
| 1636: | H:1 R:1 T:1 W:1 AA:1 |
| 1637: | A:2 B:32 C:8 D:2 E:1 H:1 J:4 K:2 O:2 P:4 S:6 T:3 V:1 X:1 Y:2 Z:1 AC:1 AD:2 |
| 1638: | A:3 B:22 C:8 D:2 J:4 K:2 O:1 P:5 R:1 S:6 T:4 Y:1 AC:1 AD:2 |
| 1639: | A:2 B:20 C:8 D:2 J:4 K:2 O:1 P:5 R:1 S:6 T:4 Y:1 AC:1 AD:2 |
| 1640: | A:5 B:39 C:14 D:3 E:1 H:1 J:5 K:3 O:3 P:7 R:1 S:7 T:5 X:1 Y:2 Z:1 AC:2 AD:3 |
| 1641: | A:4 B:37 C:14 D:3 E:1 H:1 J:5 K:3 O:3 P:7 R:1 S:7 T:5 X:1 Y:2 Z:1 AC:2 AD:3 |
| 1642: | O:3 |
| 1643: | B:12 C:7 D:3 E:9 G:4 H:6 J:1 N:3 O:1 P:3 Q:2 S:4 T:3 W:2 X:4 Y:1 AA:1 AC:1 |
| 1644: | B:10 |
| 1645: | B:2 |
| 1646: | A:5 H:4 K:3 P:6 W:5 Y:2 |
| 1647: | A:4 H:3 K:2 P:4 W:5 Y:2 |
| 1648: | B:24 H:5 S:3 X:1 Y:3 Z:2 AA:2 AD:2 |
| 1649: | B:1 R:1 S:1 T:1 W:2 Y:1 |
| 1650: | H:4 K:1 S:3 |
| 1651: | D:1 K:1 |
| 1652: | B:2 |
| 1653: | B:1 C:1 O:1 S:3 Y:2 |
| 1654: | B:1 C:2 K:4 S:1 |
| 1655: | B:1 C:1 O:1 P:1 S:1 W:2 |
| 1656: | B:2 C:3 E:1 H:7 N:2 P:1 Q:3 S:1 T:1 W:1 X:1 AA:3 AD:2 |
| 1657: | C:4 D:1 F:1 G:9 H:5 J:4 K:2 L:2 O:3 S:2 V:3 W:1 X:1 |
| 1658: | S:1 T:3 V:1 W:1 AC:1 |
| 1659: | B:3 H:5 N:2 |
| 1660: | B:1 C:1 AA:1 |
| 1661: | H:2 J:2 |
| 1662: | B:2 H:2 |
| 1663: | B:3 C:4 E:1 G:1 J:1 P:1 R:1 W:4 X:1 AA:4 |
| 1664: | I:1 T:1 |
| 1665: | B:1 C:1 H:1 P:2 |
| 1666: | H:1 K:1 S:1 |
| 1667: | G:1 O:1 |
| 1668: | B:2 T:3 |
| 1669: | B:7 D:1 F:1 H:6 K:3 O:2 P:4 Q:1 S:4 X:1 Y:1 AA:1 AD:1 |
| 1670: | B:3 C:2 G:1 H:2 S:5 T:4 W:1 |
| 1671: | X:2 |
| 1672: | O:1 AA:1 |
| 1673: | C:2 |
| 1674: | B:2 G:2 Z:1 |
| 1675: | AA:7 |
| 1676: | B:5 C:1 H:1 K:1 O:2 P:4 S:2 T:3 W:1 Y:1 AC:2 AD:1 |
| 1677: | B:1 K:1 |
| 1678: | C:1 E:1 H:2 W:1 |
| 1679: | T:5 |
| 1680: | C:2 H:4 K:5 P:1 T:1 W:1 AA:2 AC:1 |
| 1681: | C:2 H:4 K:5 P:1 T:1 W:1 AA:2 AC:1 |
| 1682: | B:4 C:2 |
| 1683: | S:1 AC:1 |
| 1684: | B:1 H:1 |
| 1685: | B:11 C:1 G:1 H:1 J:1 K:1 O:1 P:1 S:1 W:3 X:1 Z:1 AA:4 |
| 1686: | B:1 O:1 S:4 |
| 1687: | A:2 C:7 |
| 1688: | A:1 B:4 C:4 D:1 G:1 H:9 O:4 R:3 S:3 Z:2 AA:2 AC:1 |
| 1689: | C:2 H:1 S:1 |
| 1690: | B:31 C:4 G:9 H:10 J:5 K:7 N:2 P:3 Y:4 Z:1 AA:3 |
| 1691: | H:6 |
| 1692: | T:2 |
| 1693: | B:2 C:1 G:2 H:1 K:2 R:2 W:1 |
| 1694: | H:3 O:1 |
| 1695: | A:2 B:1 C:2 F:1 G:1 K:5 L:1 N:1 S:2 W:2 X:1 AA:1 |
| 1696: | B:1 C:2 H:2 S:1 W:1 |
| 1697: | B:1 P:1 |
| 1698: | E:1 G:1 H:1 N:2 S:1 T:3 AC:1 |
| 1699: | C:1 P:2 S:1 AD:1 |
| 1700: | H:3 |
| 1701: | H:5 K:1 T:3 |
| 1702: | C:3 O:1 AC:1 |
| 1703: | H:2 V:6 AC:2 |
| 1704: | B:1 S:1 |
| 1705: | B:2 G:2 H:2 P:1 Q:1 |
| 1706: | B:4 C:1 E:1 K:2 K:1 O:1 |
| 1707: | G:4 H:4 P:2 S:3 T:1 Y:1 |
| 1708: | G:3 H:6 P:3 S:2 T:1 Y:1 |
| 1709: | O:2 T:1 AC:1 |
| 1710: | B:3 E:1 F:2 G:8 H:22 I:2 P:3 Q:1 S:3 T:2 W:2 Y:3 AC:5 |
| 1711: | H:3 |
| 1712: | B:2 H:1 |
| 1713: | B:1 C:1 E:1 H:2 K:1 O:2 AA:2 |
| 1714: | C:1 H:2 |
| 1715: | B:1 H:5 J:1 S:1 W:3 |
| 1716: | G:2 I:1 O:1 W:2 Y:2 AC:1 |

TABLE II-continued

| SEQ ID NO. | Spatial Distribution |
|---|---|
| 1717: | K:2 O:1 S:3 V:3 Y:3 AC:3 AD:1 |
| 1718: | H:2 T:1 AA:3 |
| 1719: | B:4 C:4 F:3 G:4 H:7 J:1 K:1 N:1 O:1 P:1 Q:2 R:2 S:1 X:3 Y:1 |
| 1720: | B:2 O:1 |
| 1721: | B:5 |
| 1722: | C:6 H:1 Q:4 U:1 AD:1 |
| 1723: | B:3 C:15 D:3 E:2 F:5 G:1 H:7 I:3 J:6 K:2 N:1 O:5 P:3 S:8 U:2 W:12 X:2 Y:10 AA:14 |
| 1724: | B:1 G:1 H:2 O:1 P:1 Q:1 S:1 |
| 1725: | B:3 C:1 |
| 1726: | N:1 T:1 |
| 1727: | X:1 AA:3 AD:1 |
| 1728: | Q:1 S:1 |
| 1729: | T:2 |
| 1730: | X:4 |
| 1731: | B:2 C:1 E:1 G:2 K:2 N:1 O:10 S:2 T:1 AA:1 AC:2 |
| 1732: | A:3 C:1 F:2 I:1 J:1 K:1 O:1 Q:2 S:1 T:2 V:1 W:1 AA:4 |
| 1733: | C:1 K:2 W:1 |
| 1734: | T:2 Z:7 |
| 1735: | Q:1 AA:2 |
| 1736: | B:3 G:1 R:2 T:3 |
| 1737: | H:2 O:1 |
| 1738: | D:2 |
| 1739: | W:5 |
| 1740: | B:4 E:2 H:4 N:1 S:1 T:4 U:4 W:2 AB:1 |
| 1741: | AA:6 |
| 1742: | B:4 H:1 J:2 Y:1 |
| 1743: | H:1 P:1 |
| 1744: | C:2 F:1 H:2 K:3 S:3 V:1 X:1 AA:1 |
| 1745: | C:3 F:1 H:2 K:3 S:3 V:1 X:1 AA:2 |
| 1746: | D:1 H:3 R:5 T:10 |
| 1747: | B:2 I:3 K:1 S:1 T:1 Y:1 |
| 1748: | C:2 S:1 AA:4 |
| 1749: | B:4 G:2 H:3 P:2 R:1 T:2 |
| 1750: | B:2 G:2 H:4 P:1 R:1 T:2 |
| 1751: | B:5 C:1 E:1 H:3 J:1 L:1 O:3 S:1 V:1 Y:3 Z:1 |
| 1752: | K:2 P:1 |
| 1753: | S:2 Y:2 |
| 1754: | B:2 H:1 N:2 S:3 |
| 1755: | G:5 H:18 I:61 V:10 AC:6 |
| 1756: | A:69 B:3 C:11 F:1 G:1 H:7 I:1 J:2 N:1 O:1 R:2 S:2 T:4 V:11 W:1 AA:6 AC:6 AD:4 |
| 1757: | S:4 |
| 1758: | U:2 |
| 1759: | B:1 K:1 Q:2 W:2 |
| 1760: | B:2 G:2 H:2 T:1 AA:2 |
| 1761: | AA:5 |
| 1762: | C:1 AA:2 AC:3 |
| 1763: | B:7 O:1 W:2 Y:2 AC:2 AD:1 |
| 1764: | B:3 X:2 |
| 1765: | B:4 |
| 1766: | B:2 C:6 G:1 K:4 O:1 S:1 V:1 X:1 Y:1 Z:1 AA:2 |
| 1767: | F:5 J:2 S:1 |
| 1768: | J:2 |
| 1769: | K:3 P:1 S:1 |
| 1770: | B:1 O:1 Z:1 |
| 1771: | C:1 W:1 Y:2 |
| 1772: | B:1 K:1 |
| 1773: | B:1 G:3 |
| 1774: | B:3 C:3 D:2 F:2 H:2 K:2 P:3 R:1 S:2 T:1 W:1 AA:3 AD:2 |
| 1775: | B:4 C:1 E:2 G:1 H:1 O:3 P:1 |
| 1776: | B:3 |
| 1777: | P:3 T:1 |
| 1778: | B:4 C:2 H:3 O:1 S:3 T:1 W:3 Y:4 |
| 1779: | B:1 H:1 V:1 |
| 1780: | E:1 O:1 Q:1 |
| 1781: | D:1 S:3 W:1 |
| 1782: | D:2 S:2 W:1 |
| 1783: | S:2 |
| 1784: | C:1 AD:1 |
| 1785: | A:4 B:1 D:2 F:1 G:2 H:1 J:1 L:1 O:1 P:5 Q:1 T:3 V:3 W:2 Y:4 AA:1 AC:1 |
| 1786: | B:3 |
| 1787: | B:3 C:1 P:4 |
| 1788: | A:1 B:7 S:3 T:2 W:3 AC:2 |
| 1789: | A:4 |
| 1790: | L:1 Y:1 |
| 1791: | G:1 H:3 |
| 1792: | B:1 G:1 K:1 T:2 |
| 1793: | B:1 K:1 S:1 |
| 1794: | H:3 N:1 S:2 T:1 |
| 1795: | H:6 N:2 S:1 T:2 |
| 1796: | K:1 P:1 |
| 1797: | B:1 L:3 P:1 T:4 Y:1 |
| 1798: | B:3 E:1 F:1 H:1 O:1 Q:2 T:1 AA:3 AC:3 |
| 1799: | AA:3 |
| 1800: | B:1 E:1 H:1 T:1 |
| 1801: | B:3 S:3 T:1 AD:4 |
| 1802: | C:1 H:4 |
| 1803: | C:1 O:2 S:1 |
| 1804: | B:1 C:1 |
| 1805: | F:16 R:25 S:1 |
| 1806: | F:32 R:3 AD:2 |
| 1807: | C:2 E:4 F:2 G:2 H:3 I:3 K:6 L:7 N:5 O:10 R:2 S:13 T:17 W:4 X:2 Z:4 AA:25 |
| 1808: | G:1 W:2 |
| 1809: | B:6 H:2 P:1 |
| 1810: | B:1 O:1 |
| 1811: | B:7 H:1 |
| 1812: | B:4 C:2 H:2 W:2 |
| 1813: | B:8 C:1 R:4 W:1 |
| 1814: | B:1 C:2 H:1 K:1 O:2 R:1 S:1 V:1 W:1 AC:1 |
| 1815: | B:1 H:4 Q:1 T:1 Y:1 AC:1 AD:2 |
| 1816: | AA:6 |
| 1817: | Q:2 S:1 |
| 1818: | O:3 |
| 1819: | H:1 S:1 T:1 X:2 |
| 1820: | B:2 C:1 K:1 P:1 S:7 AA:1 |
| 1821: | B:3 C:11 D:1 E:1 G:3 H:10 K:2 O:1 P:1 Q:1 S:7 T:3 V:2 W:3 X:3 Z:1 AA:1 AC:2 AD:2 |
| 1822: | B:2 G:2 |
| 1823: | K:1 W:1 |
| 1824: | H:1 X:1 |
| 1825: | B:4 C:4 H:1 P:2 T:5 |
| 1826: | W:2 Y:3 |
| 1827: | E:2 T:2 W:2 |
| 1828: | E:1 T:2 W:2 |
| 1829: | V:1 AA:3 |
| 1830: | B:4 C:2 G:1 J:1 K:1 P:2 S:4 T:1 W:1 Y:3 AA:2 |
| 1831: | S:1 AC:1 |
| 1832: | B:3 |
| 1833: | H:1 S:3 |
| 1834: | F:1 V:1 |
| 1835: | B:6 C:49 D:4 E:2 G:20 H:46 I:6 J:1 K:16 N:6 O:10 P:13 Q:3 R:1 S:38 T:24 U:2 V:3 W:5 X:5 Y:7 Z:2 AA:18 AB:2 AC:4 AD:14 |
| 1836: | B:10 C:80 D:6 E:4 G:28 H:69 I:10 J:2 K:29 N:9 O:13 P:19 Q:3 R:2 S:64 T:41 U:2 |

TABLE II-continued

| SEQ ID NO. | Spatial Distribution |
|---|---|
| | V:6 W:9 X:9 Y:10 Z:4 AA:25 AB:3 AC:7 AD:23 |
| 1837: | B:2 C:1 N:1 S:2 Y:2 |
| 1838: | F:1 N:1 P:1 R:1 S:1 T:4 W:6 AA:1 |
| 1839: | H:1 N:2 AA:1 AC:1 |
| 1840: | H:3 N:1 |
| 1841: | B:2 |
| 1842: | C:1 G:2 AD:2 |
| 1843: | AA:3 |
| 1844: | G:7 |
| 1845: | E:1 O:1 S:1 |
| 1846: | B:6 E:2 F:1 |
| 1847: | B:1 H:3 K:1 T:2 AC:1 |
| 1848: | E:1 H:2 |
| 1849: | B:1 H:5 AA:1 |
| 1850: | B:1 T:1 |
| 1851: | S:1 AD:1 |
| 1852: | H:1 S:1 |
| 1853: | O:1 S:1 |
| 1854: | F:2 R:1 |
| 1855: | H:2 X:2 |
| 1856: | P:1 U:2 |
| 1857: | B:5 H:2 O:3 P:2 S:2 T:1 W:4 AA:1 |
| 1858: | B:2 |
| 1859: | C:1 E:1 O:3 Q:2 T:1 |
| 1860: | B:3 |
| 1861: | G:2 |
| 1862: | B:2 F:1 S:2 AA:1 |
| 1863: | B:1 G:1 H:1 O:2 S:1 U:1 AA:1 |
| 1864: | B:2 G:2 H:3 R:4 S:5 AA:2 |
| 1865: | B:5 C:1 G:4 H:2 K:1 R:1 S:3 T:1 Y:1 Z:1 AA:5 |
| 1866: | B:3 P:1 AD:2 |
| 1867: | B:1 G:2 W:2 |
| 1868: | H:3 J:2 O:2 V:1 |
| 1869: | G:1 H:1 K:1 N:1 |
| 1870: | G:1 H:1 K:1 N:1 |
| 1871: | G:1 H:1 K:1 N:1 |
| 1872: | Z:5 |
| 1873: | B:1 D:1 Y:1 |
| 1874: | A:1 B:1 H:3 W:1 |
| 1875: | B:3 E:1 G:2 H:3 K:1 P:1 S:1 T:2 Z:2 AD:1 |
| 1876: | H:4 Z:1 |
| 1877: | B:2 F:2 H:4 K:2 N:2 T:5 U:2 W:2 X:4 AC:2 |
| 1878: | T:4 |
| 1879: | F:1 O:1 S:1 AA:1 AD:2 |
| 1880: | A:1 H:1 N:1 P:2 Q:1 X:1 |
| 1881: | H:1 O:2 |
| 1882: | H:1 K:2 AA:1 |
| 1883: | B:2 C:14 D:1 F:1 G:4 H:4 N:6 P:2 Q:1 S:12 T:3 Z:1 AD:1 |
| 1884: | C:1 F:2 K:1 O:3 W:2 X:1 AA:2 AC:3 |
| 1885: | C:1 F:2 K:1 O:3 W:2 X:1 AA:1 AC:2 |
| 1886: | AA:2 |
| 1887: | B:12 C:1 F:4 G:5 H:9 K:4 Q:2 S:4 T:13 U:5 V:2 W:12 X:2 Y:3 AA:1 AC:4 |
| 1888: | B:1 H:2 AC:1 |
| 1889: | C:2 G:1 J:2 S:1 W:2 Z:1 |
| 1890: | C:1 G:1 H:2 Q:1 AA:4 |
| 1891: | V:2 AC:1 |
| 1892: | B:2 I:2 K:2 T:1 W:1 |
| 1893: | B:1 N:1 W:2 |
| 1894: | C:2 W:1 AA:1 |
| 1895: | B:2 C:3 H:1 K:2 P:1 S:1 T:1 W:1 X:4 |
| 1896: | T:1 Y:1 |
| 1897: | H:2 S:1 |
| 1898: | G:3 X:1 |
| 1899: | B:3 C:2 S:2 AD:1 |
| 1900: | B:2 C:7 D:1 E:5 G:3 H:12 I:1 J:1 N:1 O:3 P:9 Q:3 S:2 T:2 W:1 AC:1 AD:6 |
| 1901: | B:3 C:8 D:1 E:6 G:3 H:11 I:1 J:1 N:1 O:3 P:12 Q:3 S:2 T:2 W:1 AC:1 AD:8 |
| 1902: | B:3 C:12 D:1 E:8 G:4 H:12 I:2 J:2 N:2 O:4 P:15 Q:4 S:2 T:2 W:1 AC:1 AD:9 |
| 1903: | B:4 C:13 D:1 E:9 G:4 H:11 I:2 J:2 N:2 O:4 P:18 Q:4 S:2 T:2 W:1 AC:1 AD:11 |
| 1904: | B:3 C:13 D:1 E:10 G:5 H:13 I:3 J:3 N:2 O:4 P:15 Q:4 S:2 T:2 W:1 AC:1 AD:11 |
| 1905: | B:4 C:2 T:1 W:5 |
| 1906: | B:2 |
| 1907: | B:3 F:1 |
| 1908: | AA:4 |
| 1909: | C:1 H:1 X:3 Z:1 |
| 1910: | B:1 C:1 S:1 V:5 |
| 1911: | B:1 AA:2 |
| 1912: | K:1 AA:1 |
| 1913: | B:3 C:4 E:2 G:1 T:1 AA:1 |
| 1914: | B:3 C:2 E:2 G:1 T:1 AA:1 |
| 1915: | A:3 H:2 P:5 T:2 |
| 1916: | W:3 |
| 1917: | G:1 H:1 S:2 |
| 1918: | B:1 C:2 N:4 R:2 S:2 U:1 Z:1 |
| 1919: | B:2 E:1 H:1 |
| 1920: | B:3 G:2 H:1 K:2 O:2 |
| 1921: | B:1 G:2 H:2 |
| 1922: | B:1 G:2 |
| 1923: | H:1 P:1 |
| 1924: | B:5 |
| 1925: | B:1 W:2 |
| 1926: | G:1 S:1 |
| 1927: | B:4 G:1 T:1 |
| 1928: | B:1 Y:2 |
| 1929: | R:2 |
| 1930: | B:2 W:6 Y:1 |
| 1931: | B:2 |
| 1932: | C:1 D:1 K:1 O:1 R:2 S:4 T:11 W:1 Z:1 AB:1 |
| 1933: | B:2 C:1 Z:1 |
| 1934: | A:2 B:28 C:10 D:17 E:15 F:8 G:18 H:59 J:4 K:45 L:5 N:25 O:11 P:35 Q:4 R:5 S:64 T:27 U:1 V:6 W:6 X:4 Y:9 Z:11 AA:56 AB:2 AC:6 AD:17 |
| 1935: | A:2 B:27 C:76 D:13 E:13 F:6 G:17 H:43 J:4 K:39 L:5 N:23 O:11 P:31 Q:4 R:5 S:51 T:25 U:1 V:5 W:4 X:4 Y:9 Z:11 AA:40 AB:2 AC:6 AD:13 |
| 1936: | A:2 B:28 C:99 D:17 E:15 F:8 G:18 H:59 J:4 K:44 L:5 N:25 O:11 P:35 Q:4 R:5 S:63 T:26 U:1 V:6 W:6 X:4 Y:9 Z:11 AA:56 AB:2 AC:6 AD:17 |
| 1937: | B:1 H:1 |
| 1938: | B:2 G:2 T:2 |
| 1939: | B:3 S:1 |
| 1940: | C:2 D:1 P:3 W:4 X:1 AC:1 |
| 1941: | B:5 J:1 |
| 1942: | B:1 G:1 |
| 1943: | B:1 G:1 H:2 R:1 Y:1 AA:1 |
| 1944: | K:2 S:1 Y:4 |
| 1945: | B:5 C:5 E:2 F:3 H:2 O:1 P:2 S:1 T:2 W:2 AA:5 AC:1 AD:2 |
| 1946: | C:1 P:1 |
| 1947: | C:2 E:1 Q:1 |
| 1948: | W:1 AC:1 |
| 1949: | B:1 F:2 H:3 O:1 T:5 Y:2 Z:2 |

TABLE II-continued

| SEQ ID NO. | Spatial Distribution |
|---|---|
| 1950: | H:2 O:1 P:1 T:2 |
| 1951: | H:2 O:1 P:1 T:2 |
| 1952: | H:1 O:1 P:2 T:4 |
| 1953: | N:1 T:4 |
| 1954: | N:3 T:3 |
| 1955: | E:1 H:3 S:2 T:1 X:1 AC:2 |
| 1956: | G:1 J:1 |
| 1957: | B:4 F:3 H:2 J:1 N:2 S:2 T:6 |
| 1958: | H:2 R:1 AC:2 |
| 1959: | B:2 H:1 AA:5 |
| 1960: | E:3 G:4 H:3 O:2 S:1 T:1 V:1 W:1 AC:1 |
| 1961: | AA:5 |
| 1962: | H:2 S:1 |
| 1963: | B:1 W:3 Y:1 |
| 1964: | C:3 E:2 F:1 H:1 |
| 1965: | X:1 AA:1 |
| 1966: | B:1 R:2 S:1 |
| 1967: | C:2 Q:1 W:1 |
| 1968: | B:2 G:2 |
| 1969: | B:2 G:2 |
| 1970: | H:1 W:1 |
| 1971: | B:1 G:2 N:1 O:1 P:2 S:1 W:1 |
| 1972: | H:2 P:1 S:3 |
| 1973: | E:1 O:1 S:2 |
| 1975: | B:3 |
| 1976: | C:1 G:1 |
| 1977: | B:2 F:1 H:5 K:1 T:2 W:2 Y:2 |
| 1978: | H:4 P:1 |
| 1979: | G:1 S:4 AA:1 |
| 1980: | F:2 V:1 AC:1 |
| 1981: | F:2 G:1 T:1 V:1 AC:1 |
| 1982: | AA:5 |
| 1983: | C:2 H:1 |
| 1984: | B:1 G:2 H:3 |
| 1985: | B:2 K:1 Y:1 |
| 1986: | B:3 S:1 |
| 1987: | L:1 S:1 AD:2 |
| 1988: | B:1 AC:1 |
| 1989: | C:1 L:2 T:1 |
| 1990: | B:3 H:1 O:2 AC:1 |
| 1991: | AA:13 |
| 1992: | B:2 O:1 P:1 AA:3 |
| 1993: | B:1 H:1 X:2 |
| 1994: | B:1 L:1 AA:1 |
| 1995: | H:2 O:1 AA:3 |
| 1996: | H:1 O:1 X:1 |
| 1997: | B:9 C:2 F:3 G:1 H:5 L:1 N:1 S:1 T:4 W:2 AA:15 AB:2 AC:1 |
| 1998: | B:1 H:1 |
| 1999: | B:6 O:1 AC:1 |
| 2000: | B:4 T:1 AC:2 |
| 2001: | B:2 R:2 U:1 |
| 2002: | AA:3 |
| 2003: | B:1 H:1 T:1 |
| 2004: | E:3 AC:1 |
| 2005: | B:1 C:1 G:2 |
| 2006: | H:7 AA:1 |
| 2007: | O:1 P:1 |
| 2008: | B:4 |
| 2009: | B:2 |
| 2010: | H:3: O:2 |
| 2011: | C:1 O:1 P:3 S:2 X:2 |
| 2012: | B:2 W:2 Y:1 |
| 2013: | B:1 C:1 F:2 |
| 2014: | C:5 F:1 H:1 |
| 2015: | I:1 AA:1 |
| 2016: | T:3 |
| 2017: | B:1 N:1 |
| 2018: | B:2 G:1 H:5 S:2 T:1 Y:2 AD:1 |
| 2019: | G:1 H:1 O:1 |
| 2020: | B:2 C:2 E:1 G:3 H:2 O:3 S:3 Z:1 AA:3 |
| 2021: | C:1 H:1 N:1 |
| 2022: | H:2 |
| 2023: | B:2 |
| 2024: | B:1 AA:3 |
| 2025: | J:14 |
| 2026: | B:1 G:2 Y:1 |
| 2027: | B:2 Z:3 |
| 2028: | B:5 Z:1 |
| 2029: | B:6 C:3 G:1 H:6 K:4 O:2 R:3 S:2 T:2 W:1 Y:2 |
| 2030: | N:2 |
| 2031: | C:2 O:1 |
| 2032: | D:3 N:1 O:1 S:3 T:4 W:1 AA:4 |
| 2033: | B:3 |
| 2034: | B:2 H:1 |
| 2035: | B:1 G:3 H:5 N:1 T:1 X:1 Z:1 AD:2 |
| 2036: | B:2 H:1 S:1 |
| 2037: | O:1 S:1 AC:1 |
| 2038: | S:7 T:2 AA:2 |
| 2039: | B:1 C:1 G:1 H:2 N:1 Q:1 S:5 Y:1 AA:2 |
| 2040: | B:2 E:1 F:2 H:4 J:1 S:3 W:1 Y:1 |
| 2041: | R:3 |
| 2042: | J:1 T:2 |
| 2043: | C:2 F:4 J:5 P:2 |
| 2044: | H:1 S:7 |
| 2045: | H:2 S:4 |
| 2046: | B:4 K:1 AC:1 |
| 2047: | K:2 T:2 V:1 |
| 2048: | B:3 |
| 2049: | H:1 R:1 |
| 2050: | B:5 C:2 |
| 2051: | K:1 U:3 |
| 2052: | B:1 N:1 S:1 |
| 2053: | B:2 X:1 |
| 2054: | S:1 V:1 |
| 2055: | C:1 K:1 |
| 2056: | B:1 Q:2 T:2 |
| 2057: | B:1 C:1 E:2 G:1 H:3 |
| 2058: | B:2 |
| 2059: | H:4 N:3 O:1 |
| 2060: | AA:3 |
| 2061: | A:1 B:2 C:6 H:3 O:3 S:6 T:3 W:3 AA:5 AC:1 AD:1 |
| 2062: | B:1 C:1 F:3 H:2 K:1 N:3 O:1 S:2 W:1 X:2 Y:1 AA:1 |
| 2063: | B:1 H:3 Y:1 |
| 2064: | B:1 H:1 T:1 |
| 2065: | S:2 T:7 |
| 2066: | P:3 W:1 |
| 2067: | C:1 E:3 H:1 O:1 |
| 2068: | O:1 P:1 U:2 AA:1 |
| 2069: | O:2 P:2 U:1 AA:1 |
| 2070: | C:9 F:2 G:1 H:2 I:19 J:2 K:18 L:1 N:32 O:8 R:2 S:41 T:8 W:8 Z:1 AA:53 AC:1 |
| 2071: | B:8 C:1 G:1 H:2 J:4 S:2 W:1 Y:1 AC:1 |
| 2072: | J:1 W:1 AA:2 |
| 2073: | B:1 R:1 Y:1 |
| 2074: | D:2 E:1 T:2 |
| 2075: | B:8 C:11 E:10 G:1 H:6 J:1 K:3 L:2 N:2 O:2 P:11 Q:6 S:2 T:30 U:3 V:7 W:1 X:2 Y:1 AA:1 AC:4 |
| 2076: | B:8 C:12 E:10 G:1 H:7 J:1 K:3 L:2 N:2 O:2 P:11 Q:5 S:2 T:30 U:4 V:7 W:1 X:2 Y:1 AA:1 AC:3 |
| 2077: | H:1 S:3 |
| 2078: | A:1 J:1 T:4 |
| 2079: | B:2 AA:2 |
| 2080: | D:1 T:1 |
| 2081: | B:1 S:2 T:1 AC:2 |
| 2082: | B:1 G:1 |
| 2083: | C:1 L:1 |

TABLE II-continued

| SEQ ID NO. | Spatial Distribution |
|---|---|
| 2084: | O:2 Q:1 U:1 |
| 2085: | B:2 H:1 |
| 2086: | J:4 |
| 2087: | A:7 B:3 C:3 E:1 F:2 G:8 H:3 N:1 P:2 S:3 W:2 X:1 Y:1 Z:1 |
| 2088: | A:1 C:2 D:2 P:3 AA:3 AB:2 |
| 2089: | H:1 AC:1 |
| 2090: | B:6 C:1 D:2 H:2 S:6 W:1 Y:1 AC:1 |
| 2091: | B:1 H:1 K:2 O:3 W:2 |
| 2092: | B:2 S:1 |
| 2093: | B:2 C:2 W:4 Y:4 |
| 2094: | C:1 S:1 |
| 2095: | AD:2 |
| 2096: | H:3 T:2 U:2 W:4 AC:1 |
| 2097: | A:1 J:1 AA:1 |
| 2098: | B:1 G:2 H:6 O:1 Y:1 |
| 2099: | B:4 C:2 S:4 |
| 2100: | C:5 O:1 T:1 |
| 2101: | H:1 S:1 |
| 2102: | B:2 C:2 E:1 P:1 R:1 S:5 AA:3 AC:1 |
| 2103: | H:2 T:2 |
| 2104: | F:1 S:2 T:1 |
| 2105: | B:6 C:1 H:2 R:1 W:4 Z:1 |
| 2106: | C:2 G:5 O:2 R:1 |
| 2107: | J:11 R:10 |
| 2108: | B:1 H:1 |
| 2109: | E:2 H:3 |
| 2110: | B:4 G:1 P:1 V:1 W:2 AD:1 |
| 2111: | C:1 T:1 |
| 2112: | G:1 H:1 |
| 2113: | N:1 Q:1 S:1 T:3 |
| 2114: | B:2 G:1 |
| 2115: | B:2 K:1 |
| 2116: | B:1 H:2 N:1 O:4 V:1 |
| 2117: | H:3 |
| 2118: | S:1 T:1 U:2 AC:1 |
| 2119: | B:3 K:3 Y:4 AA:2 AC:2 |
| 2120: | B:3 K:3 Y:4 AA:2 AC:2 |
| 2121: | F:1 R:2 |
| 2122: | B:1 G:1 S:1 Y:2 |
| 2123: | B:4 |
| 2124: | B:4 H:1 T:1 AA:1 AC:1 |
| 2125: | B:1 C:1 |
| 2126: | K:2 S:3 AD:1 |
| 2127: | AA:6 |
| 2128: | E:1 H:1 K:1 W:1 |
| 2129: | AA:3 |
| 2130: | B:1 H:4 Y:1 |
| 2131: | C:5 P:2 |
| 2132: | C:5 P:1 |
| 2133: | T:2 AA:1 |
| 2134: | B:3 |
| 2135: | F:1 P:4 |
| 2136: | B:1 H:2 N:1 |
| 2137: | B:2 C:2 D:6 G:3 H:20 I:2 N:25 O:5 P:25 T:5 W:5 Y:15 |
| 2138: | B:11 C:5 F:1 G:2 H:7 K:2 R:2 S:4 W:3 X:2 AB:1 AC:1 |
| 2139: | B:4 H:2 |
| 2140: | B:3 H:1 |
| 2141: | C:1 J:1 T:1 |
| 2142: | AA:3 |
| 2143: | H:2 T:1 |
| 2144: | B:1 J:1 T:1 |
| 2145: | C:1 H:1 S:4 Y:1 |
| 2146: | B:4 |
| 2147: | B:1 S:1 Y:2 |
| 2148: | F:2 H:2 T:1 |
| 2149: | C:2 AA:3 |
| 2150: | B:3 R:1 V:2 |
| 2151: | B:2 G:2 H:1 O:1 |
| 2152: | B:1 T:2 |
| 2153: | C:2 R:2 Y:1 Z:1 |
| 2154: | W:1 Y:1 |
| 2155: | B:5 C:1 G:1 H:2 O:1 X:1 |
| 2156: | B:2 |
| 2157: | B:1 AC:1 |
| 2158: | F:1 H:2 W:2 X:1 |
| 2159: | H:1 O:1 |
| 2160: | S:1 Y:1 AA:2 AD:2 |
| 2161: | N:2 S:2 |
| 2162: | I:1 AD:1 |
| 2163: | H:2 |
| 2164: | W:3 |
| 2165: | B:3 C:2 H:1 |
| 2166: | J:2 W:1 AA:1 AD:2 |
| 2167: | C:2 H:4 S:1 T:1 AC:1 |
| 2168: | B:2 T:2 V:1 |
| 2169: | O:1 S:1 V:3 |
| 2170: | H:3 AD:1 |
| 2171: | F:1 G:2 H:3 N:2 S:8 |
| 2172: | F:1 G:1 H:4 N:2 S:8 |
| 2173: | C:3 H:2 P:1 |
| 2174: | B:1 O:2 X:3 AA:1 AC:2 |
| 2175: | C:2 E:4 H:2 S:3 V:3 AC:7 |
| 2176: | H:1 L:1 N:1 O:3 P:1 R:6 S:4 T:7 AA:4 AC:2 |
| 2177: | E:2 N:3 R:1 |
| 2178: | B:5 G:2 P:1 T:2 |
| 2179: | B:1 H:2 T:2 |
| 2180: | U:2 |
| 2181: | B:3 G:1 |
| 2182: | G:1 H:1 |
| 2183: | B:1 C:2 H:1 P:1 |
| 2184: | B:3 C:4 H:1 K:1 T:1 AA:1 |
| 2185: | A:1 B:4 C:1 E:1 F:1 G:2 H:10 O:1 P:2 T:9 W:1 X:1 Z:1 AD:1 |
| 2186: | B:1 C:1 |
| 2187: | P:1 R:1 |
| 2188: | AA:4 |
| 2189: | G:1 O:2 |
| 2190: | H:2 N:4 P:1 |
| 2191: | B:3 |
| 2192: | C:2 R:1 Z:4 |
| 2193: | H:4 |
| 2194: | B:2 O:1 |
| 2195: | G:1 H:1 |
| 2196: | E:3 G:1 J:1 P:1 S:1 |
| 2197: | K:1 AC:1 |
| 2198: | G:1 O:1 |
| 2199: | C:3 H:3 |
| 2200: | AA:2 |
| 2201: | S:2 |
| 2202: | F:1 O:1 AC:1 |
| 2203: | E:2 L:1 T:2 |
| 2204: | C:1 H:2 W:1 |
| 2205: | H:1 AC:1 |
| 2206: | B:1 C:1 H:1 Y:2 |
| 2207: | B:32 C:20 E:1 F:1 G:11 H:9 J:1 K:9 L:1 P:5 Q:1 R:2 S:8 T:17 V:3 W:1 X:1 Y:1 AA:9 AC:1 AD:4 |
| 2208: | A:1 C:2 G:2 |
| 2209: | A:2 C:1 G:1 |
| 2210: | N:1 Q:2 S:2 T:4 W:4 AA:1 AC:2 |
| 2211: | E:1 K:1 T:2 |
| 2212: | B:1 E:1 Y:1 |
| 2213: | C:1 S:1 W:1 |
| 2214: | B:1 H:1 |
| 2215: | H:1 N:1 |
| 2216: | W:3 |
| 2217: | H:1 X:1 Y:1 |
| 2218: | B:1 G:1 |
| 2219: | G:1 P:1 W:1 Z:1 |
| 2220: | B:1 P:2 AA:1 |
| 2221: | B:2 E:1 G:1 L:1 R:1 |
| 2222: | B:9 D:4 E:2 F:2 J:5 N:2 O:1 R:1 T:2 X:2 Z:1 AA:2 |
| 2223: | H:1 L:1 S:1 |
| 2224: | H:3 T:1 AC:2 |

TABLE II-continued

| SEQ ID NO. | Spatial Distribution |
|---|---|
| 2225: | B:3 J:1 Y:1 |
| 2226: | B:1 W:2 |
| 2227: | B:5 E:1 O:1 S:1 T:3 Y:1 |
| 2228: | B:2 AA:1 |
| 2229: | B:1 C:1 H:2 O:1 |
| 2230: | B:3 C:1 P:1 Q:1 W:1 AA:1 |
| 2231: | B:4 G:1 N:2 O:1 P:9 S:1 T:1 W:1 AA:1 |
| 2232: | B:6 E:3 F:1 P:1 T:2 Y:1 AC:1 |
| 2233: | B:2 H:1 R:2 W:1 |
| 2234: | P:8 |
| 2235: | H:1 O:2 |
| 2236: | C:1 G:2 H:1 N:1 O:2 S:2 W:2 |
| 2237: | B:6 C:3 G:5 N:1 P:3 W:2 AA:1 |
| 2238: | W:2 |
| 2239: | B:1 H:1 |
| 2240: | H:1 AA:2 |
| 2241: | J:1 O:2 |
| 2242: | C:1 V:1 |
| 2243: | J:1 P:2 |
| 2244: | AA:2 AC:1 |
| 2245: | H:1 I:1 |
| 2246: | J:1 Y:1 |
| 2247: | B:2 |
| 2248: | B:1 H:1 T:1 AA:1 |
| 2249: | B:3 H:3 S:1 V:2 |
| 2250: | B:1 D:1 |
| 2251: | F:1 R:1 |
| 2252: | B:2 C:1 P:1 U:1 |
| 2253: | J:2 |
| 2254: | C:2 K:1 |
| 2255: | B:1 C:1 H:1 |
| 2256: | B:2 |
| 2257: | B:1 G:1 Y:1 |
| 2258: | AA:8 |
| 2259: | B:1 AA:1 |
| 2260: | J:2 W:2 |
| 2261: | B:1 O:1 X:1 |
| 2262: | F:1 H:2 L:1 |
| 2263: | C:1 H:2 |
| 2264: | I:1 L:1 S:1 AA:2 |
| 2265: | I:1 L:1 S:1 AA:1 |
| 2266: | E:1 Y:1 |
| 2267: | B:1 J:1 T:1 X:1 Y:1 |
| 2268: | F:2 T:1 |
| 2269: | H:1 AB:1 |
| 2270: | B:1 K:1 |
| 2271: | E:1 H:1 N:2 |
| 2272: | B:1 C:4 J:3 W:1 |
| 2273: | S:1 AA:2 |
| 2274: | H:2 T:1 |
| 2275: | L:1 O:1 |
| 2276: | O:1 P:1 |
| 2277: | N:1 T:1 |
| 2278: | B:2 G:1 Y:1 AA:2 |
| 2279: | L:1 T:1 Y:1 |
| 2280: | B:1 G:1 J:1 N:1 |
| 2281: | G:1 S:1 |
| 2282: | H:1 AA:1 |
| 2283: | S:1 T:1 |
| 2284: | B:1 G:1 |
| 2285: | H:1 I:1 Y:1 |
| 2286: | K:1 S:1 |
| 2287: | AA:2 |
| 2288: | P:2 |
| 2289: | C:1 H:1 O:1 |
| 2290: | H:1 V:2 |
| 2291: | B:1 H:1 |
| 2292: | H:2 W:1 |
| 2293: | B:1 O:1 |
| 2294: | B:1 C:1 Y:1 |
| 2295: | B:1 C:1 T:1 |
| 2296: | B:1 O:1 |
| 2297: | A:1 B:1 G:1 |
| 2298: | H:1 I:1 |
| 2299: | B:2 G:1 AC:1 |
| 2300: | O:1 S:1 |
| 2301: | O:2 |
| 2302: | H:1 T:1 |
| 2303: | S:1 V:1 |
| 2304: | B:1 C:1 W:1 |
| 2305: | B:2 AA:1 |
| 2306: | B:4 C:1 D:2 K:1 P:1 S:2 T:2 Y:1 AC:1 |
| 2307: | B:2 F:1 |
| 2308: | B:1 J:1 |
| 2309: | B:2 H:1 P:1 S:2 W:1 AA:1 |
| 2310: | H:1 T:1 |
| 2311: | B:1 K:1 |
| 2312: | E:1 T:3 |
| 2313: | C:2 |
| 2314: | N:1 S:2 T:3 V:2 |
| 2315: | C:1 O:1 |
| 2316: | C:3 AA:1 |
| 2317: | B:1 G:1 |
| 2318: | R:3 |
| 2319: | P:2 |
| 2320: | B:1 O:1 Q:1 W:1 |
| 2321: | C:1 W:1 |
| 2322: | R:2 |
| 2323: | B:1 H:1 |
| 2324: | T:2 |
| 2325: | O:1 S:2 |
| 2326: | S:1 W:1 |
| 2327: | H:3 L:1 |
| 2328: | W:1 Y:1 |
| 2329: | K:1 Z:1 |
| 2330: | B:2 G:1 |
| 2331: | B:2 |
| 2332: | F:1 Y:1 |
| 2333: | C:1 K:1 |
| 2334: | E:1 S:4 |
| 2335: | T:1 AA:1 AD:1 |
| 2336: | B:1 P:1 |
| 2337: | T:2 |
| 2338: | B:2 |
| 2339: | U:2 |
| 2340: | B:2 |
| 2341: | O:1 AA:1 |
| 2342: | B:1 F:1 P:1 |
| 2343: | AA:2 |
| 2344: | P:3 |
| 2345: | H:1 R:1 Y:1 |
| 2346: | G:1 H:1 |
| 2347: | B:1 H:1 S:1 |
| 2348: | C:1 O:1 T:1 |
| 2349: | A:1 S:1 |
| 2350: | S:1 T:2 |
| 2351: | W:2 Y:2 |
| 2352: | N:2 S:1 |
| 2353: | G:1 H:1 |
| 2354: | AD:2 |
| 2355: | K:1 O:1 |
| 2356: | J:1 O:1 |
| 2357: | B:1 H:1 Q:2 |
| 2358: | B:1 H:2 |
| 2359: | D:2 |
| 2360: | H:1 W:1 |
| 2361: | B:1 K:1 |
| 2362: | B:1 P:1 |
| 2363: | B:1 C:1 |
| 2364: | T:2 |
| 2365: | H:1 O:1 |
| 2366: | T:2 |
| 2367: | AD:2 |
| 2368: | B:1 K:1 |
| 2369: | T:2 |
| 2370: | H:1 Y:1 |
| 2371: | B:2 |
| 2372: | E:2 |
| 2373: | H:1 S:1 |

TABLE II-continued

| SEQ ID NO. | Spatial Distribution |
|---|---|
| 2374: | C:1 N:1 |
| 2375: | C:1 S:1 |
| 2376: | V:1 |
| 2377: | V:1 |
| 2378: | V:1 |
| 2379: | B:1 |
| 2380: | B:1 |
| 2381: | B:1 |
| 2382: | B:1 |
| 2383: | B:1 |
| 2384: | B:1 |
| 2385: | B:1 |
| 2386: | B:1 |
| 2387: | U:1 |
| 2388: | U:1 |
| 2389: | U:1 |
| 2390: | U:1 |
| 2391: | U:1 |
| 2392: | U:1 |
| 2393: | X:1 |
| 2394: | X:1 |
| 2395: | X:1 |
| 2396: | X:1 |
| 2397: | X:1 |
| 2398: | X:1 |
| 2399: | X:1 |
| 2400: | X:1 |
| 2401: | X:1 |
| 2402: | X:1 |
| 2403: | X:1 |
| 2404: | X:1 |
| 2405: | X:1 |
| 2406: | X:1 |
| 2407: | X:1 |
| 2408: | X:1 |
| 2409: | X:1 |
| 2410: | X:1 |
| 2411: | X:1 |
| 2412: | X:1 |
| 2413: | L:1 |
| 2414: | L:1 |
| 2415: | L:1 |
| 2416: | L:1 |
| 2417: | N:1 |
| 2418: | N:1 |
| 2419: | N:1 |
| 2420: | N:1 |
| 2421: | N:1 |
| 2422: | N:1 |
| 2423: | N:1 |
| 2424: | N:1 |
| 2425: | N:1 |
| 2426: | N:1 |
| 2427: | N:1 |
| 2428: | N:1 |
| 2429: | N:1 |
| 2430: | E:1 |
| 2431: | E:1 |
| 2432: | E:1 |
| 2433: | E:1 |
| 2434: | E:1 |
| 2435: | E:1 |
| 2436: | E:1 |
| 2437: | E:1 |
| 2438: | E:1 |
| 2439: | Q:1 |
| 2440: | Q:1 |
| 2441: | Q:1 |
| 2442: | Q:1 |
| 2443: | Q:1 |
| 2444: | Q:1 |
| 2445: | Q:1 |
| 2446: | Q:1 |
| 2447: | Q:1 |
| 2448: | Q:1 |
| 2449: | Q:1 |
| 2450: | Q:1 |
| 2451: | Q:1 |
| 2452: | Q:1 |
| 2453: | Q:1 |
| 2454: | J:1 |
| 2455: | J:1 |
| 2456: | J:1 |
| 2457: | J:1 |
| 2458: | J:1 |
| 2459: | J:1 |
| 2460: | J:1 |
| 2461: | T:1 |
| 2462: | T:1 |
| 2463: | T:1 |
| 2464: | T:1 |
| 2465: | T:1 |
| 2466: | T:1 |
| 2467: | T:1 |
| 2468: | T:1 |
| 2469: | T:1 |
| 2470: | T:1 |
| 2471: | T:1 |
| 2472: | T:1 |
| 2473: | T:1 |
| 2474: | T:1 |
| 2475: | T:1 |
| 2476: | T:1 |
| 2477: | T:1 |
| 2478: | T:1 |
| 2479: | T:1 |
| 2480: | T:1 |
| 2481: | T:1 |
| 2482: | T:1 |
| 2483: | T:1 |
| 2484: | T:1 |
| 2485: | T:1 |
| 2486: | T:1 |
| 2487: | T:1 |
| 2488: | T:1 |
| 2489: | T:1 |
| 2490: | T:1 |
| 2491: | T:1 |
| 2492: | T:1 |
| 2493: | T:1 |
| 2494: | T:1 |
| 2495: | T:1 |
| 2496: | T:1 |
| 2497: | T:1 |
| 2498: | T:1 |
| 2499: | T:1 |
| 2500: | T:1 |
| 2501: | T:1 |
| 2502: | T:1 |
| 2503: | T:1 |
| 2504: | T:1 |
| 2505: | T:1 |
| 2506: | T:1 |
| 2507: | T:1 |
| 2508: | T:1 |
| 2509: | T:1 |
| 2510: | T:1 |
| 2511: | T:1 |
| 2512: | T:1 |
| 2513: | T:1 |
| 2514: | T:1 |
| 2515: | T:1 |
| 2516: | T:1 |
| 2517: | T:1 |
| 2518: | T:1 |
| 2519: | T:1 |
| 2520: | T:1 |
| 2521: | T:1 |
| 2522: | T:1 |
| 2523: | T:1 |
| 2524: | T:1 |
| 2525: | T:1 |
| 2526: | T:1 |
| 2527: | T:1 |

TABLE II-continued

| SEQ ID NO. | Spatial Distribution |
|---|---|
| 2528: | T:1 |
| 2529: | T:1 |
| 2530: | T:1 |
| 2531: | T:1 |
| 2532: | T:1 |
| 2533: | T:1 |
| 2534: | T:1 |
| 2535: | T:1 |
| 2536: | T:1 |
| 2537: | T:1 |
| 2538: | T:1 |
| 2539: | T:1 |
| 2540: | T:1 |
| 2541: | T:1 |
| 2542: | T:1 |
| 2543: | T:1 |
| 2544: | T:1 |
| 2545: | T:1 |
| 2546: | T:1 |
| 2547: | T:1 |
| 2548: | T:1 |
| 2549: | R:1 |
| 2550: | R:1 |
| 2551: | R:1 |
| 2552: | R:1 |
| 2553: | R:1 |
| 2554: | R:1 |
| 2555: | R:1 |
| 2556: | R:1 |
| 2557: | R:1 |
| 2558: | R:1 |
| 2559: | R:1 |
| 2560: | R:1 |
| 2561: | F:1 |
| 2562: | F:1 |
| 2563: | F:1 |
| 2564: | F:1 |
| 2565: | F:1 |
| 2566: | F:1 |
| 2567: | F:1 |
| 2568: | F:1 |
| 2569: | F:1 |
| 2570: | F:1 |
| 2571: | F:1 |
| 2572: | F:1 |
| 2573: | F:1 |
| 2574: | F:1 |
| 2575: | F:1 |
| 2576: | F:1 |
| 2577: | F:1 |
| 2578: | F:1 |
| 2579: | F:1 |
| 2580: | F:1 |
| 2581: | F:1 |
| 2582: | F:1 |
| 2583: | F:1 |
| 2584: | F:1 |
| 2585: | F:1 |
| 2586: | F:1 |
| 2587: | F:1 |
| 2588: | O:1 |
| 2589: | O:1 |
| 2590: | O:1 |
| 2591: | O:1 |
| 2592: | O:1 |
| 2593: | O:1 |
| 2594: | O:1 |
| 2595: | O:1 |
| 2596: | O:1 |
| 2597: | O:1 |
| 2598: | O:1 |
| 2599: | O:1 |
| 2600: | O:1 |
| 2601: | O:1 |
| 2602: | O:1 |
| 2603: | O:1 |
| 2604: | O:1 |
| 2605: | O:1 |
| 2606: | O:1 |
| 2607: | O:1 |
| 2608: | O:1 |
| 2609: | O:1 |
| 2610: | O:1 |
| 2611: | O:1 |
| 2612: | O:1 |
| 2613: | O:1 |
| 2614: | O:1 |
| 2615: | O:1 |
| 2616: | O:1 |
| 2617: | O:1 |
| 2618: | O:1 |
| 2619: | O:1 |
| 2620: | O:1 |
| 2621: | O:1 |
| 2622: | O:1 |
| 2623: | O:1 |
| 2624: | O:1 |
| 2625: | O:1 |
| 2626: | O:1 |
| 2627: | O:1 |
| 2628: | O:1 |
| 2629: | O:1 |
| 2630: | O:1 |
| 2631: | O:1 |
| 2632: | O:1 |
| 2633: | O:1 |
| 2634: | V:1 |
| 2635: | V:1 |
| 2636: | V:1 |
| 2637: | V:1 |
| 2638: | B:1 |
| 2639: | B:1 |
| 2640: | B:1 |
| 2641: | B:1 |
| 2642: | B:1 |
| 2643: | B:1 |
| 2644: | B:1 |
| 2645: | B:1 |
| 2646: | B:1 |
| 2647: | B:1 |
| 2648: | B:1 |
| 2649: | B:1 |
| 2650: | B:1 |
| 2651: | B:1 |
| 2652: | B:1 |
| 2653: | B:1 |
| 2654: | B:1 |
| 2655: | B:1 |
| 2656: | B:1 |
| 2657: | B:1 |
| 2658: | B:1 |
| 2659: | B:1 |
| 2660: | B:1 |
| 2661: | B:1 |
| 2662: | B:1 |
| 2663: | B:1 |
| 2664: | B:1 |
| 2665: | B:1 |
| 2666: | B:1 |
| 2667: | B:1 |
| 2668: | B:1 |
| 2669: | B:1 |
| 2670: | B:1 |
| 2671: | B:1 |
| 2672: | B:1 |
| 2673: | B:1 |
| 2674: | B:1 |
| 2675: | B:1 |
| 2676: | B:1 |
| 2677: | B:1 |
| 2678: | B:1 |
| 2679: | B:1 |
| 2680: | B:1 |
| 2681: | B:1 |

TABLE II-continued

| SEQ ID NO. | Spatial Distribution |
|---|---|
| 2682: | B:1 |
| 2683: | B:1 |
| 2684: | B:1 |
| 2685: | B:1 |
| 2686: | B:1 |
| 2687: | B:1 |
| 2688: | B:1 |
| 2689: | B:1 |
| 2690: | B:1 |
| 2691: | B:1 |
| 2692: | B:1 |
| 2693: | B:1 |
| 2694: | B:1 |
| 2695: | B:1 |
| 2696: | B:1 |
| 2697: | B:1 |
| 2698: | B:1 |
| 2699: | B:1 |
| 2700: | B:1 |
| 2701: | B:1 |
| 2702: | B:1 |
| 2703: | B:1 |
| 2704: | B:1 |
| 2705: | B:1 |
| 2706: | B:1 |
| 2707: | B:1 |
| 2708: | B:1 |
| 2709: | B:1 |
| 2710: | B:1 |
| 2711: | B:1 |
| 2712: | B:1 |
| 2713: | B:1 |
| 2714: | B:1 |
| 2715: | B:1 |
| 2716: | B:1 |
| 2717: | B:1 |
| 2718: | B:1 |
| 2719: | B:1 |
| 2720: | B:1 |
| 2721: | B:1 |
| 2722: | B:1 |
| 2723: | B:1 |
| 2724: | B:1 |
| 2725: | B:1 |
| 2726: | B:1 |
| 2727: | B:1 |
| 2728: | B:1 |
| 2729: | B:1 |
| 2730: | B:1 |
| 2731: | B:1 |
| 2732: | B:1 |
| 2733: | B:1 |
| 2734: | B:1 |
| 2735: | B:1 |
| 2736: | B:1 |
| 2737: | B:1 |
| 2738: | B:1 |
| 2739: | B:1 |
| 2740: | B:1 |
| 2741: | B:1 |
| 2742: | B:1 |
| 2743: | B:1 |
| 2744: | B:1 |
| 2745: | B:1 |
| 2746: | B:1 |
| 2747: | B:1 |
| 2748: | B:1 |
| 2749: | B:1 |
| 2750: | B:1 |
| 2751: | B:1 |
| 2752: | B:1 |
| 2753: | B:1 |
| 2754: | B:1 |
| 2755: | B:1 |
| 2756: | B:1 |
| 2757: | B:1 |
| 2758: | B:1 |
| 2759: | B:1 |
| 2760: | B:1 |
| 2761: | B:1 |
| 2762: | B:1 |
| 2763: | B:1 |
| 2764: | B:1 |
| 2765: | B:1 |
| 2766: | B:1 |
| 2767: | B:1 |
| 2768: | B:1 |
| 2769: | B:1 |
| 2770: | B:1 |
| 2771: | B:1 |
| 2772: | B:1 |
| 2773: | B:1 |
| 2774: | B:1 |
| 2775: | B:1 |
| 2776: | B:1 |
| 2777: | B:1 |
| 2778: | B:1 |
| 2779: | B:1 |
| 2780: | B:1 |
| 2781: | B:1 |
| 2782: | B:1 |
| 2783: | B:1 |
| 2784: | B:1 |
| 2785: | B:1 |
| 2786: | B:1 |
| 2787: | B:1 |
| 2788: | B:1 |
| 2789: | B:1 |
| 2790: | B:1 |
| 2791: | B:1 |
| 2792: | B:1 |
| 2793: | B:1 |
| 2794: | B:1 |
| 2795: | B:1 |
| 2796: | B:1 |
| 2797: | B:1 |
| 2798: | B:1 |
| 2799: | B:1 |
| 2800: | B:1 |
| 2801: | B:1 |
| 2802: | B:1 |
| 2803: | B:1 |
| 2804: | B:1 |
| 2805: | B:1 |
| 2806: | B:1 |
| 2807: | B:1 |
| 2808: | B:1 |
| 2809: | B:1 |
| 2810: | B:1 |
| 2811: | B:1 |
| 2812: | B:1 |
| 2813: | B:1 |
| 2814: | AC:1 |
| 2815: | AC:1 |
| 2816: | AC:1 |
| 2817: | AC:1 |
| 2818: | AC:1 |
| 2819: | AC:1 |
| 2820: | AC:1 |
| 2821: | AC:1 |
| 2822: | AC:1 |
| 2823: | AC:1 |
| 2824: | AC:1 |
| 2825: | AC:1 |
| 2826: | AC:1 |
| 2827: | AC:1 |
| 2828: | AC:1 |
| 2829: | AC:1 |
| 2830: | AC:1 |
| 2831: | AC:1 |
| 2832: | AC:1 |
| 2833: | AC:1 |
| 2834: | AC:1 |
| 2835: | AC:1 |

TABLE II-continued

| SEQ ID NO. | Spatial Distribution |
|---|---|
| 2836: | AC:1 |
| 2837: | AC:1 |
| 2838: | AC:1 |
| 2839: | AC:1 |
| 2840: | AC:1 |
| 2841: | AC:1 |
| 2842: | AC:1 |
| 2843: | AC:1 |
| 2844: | AC:1 |
| 2845: | AC:1 |
| 2846: | AC:1 |
| 2847: | AC:1 |
| 2848: | AC:1 |
| 2849: | AC:1 |
| 2850: | AC:1 |
| 2851: | AC:1 |
| 2852: | O:1 |
| 2853: | U:1 |
| 2854: | U:1 |
| 2855: | Y:1 |
| 2856: | Y:1 |
| 2857: | Y:1 |
| 2858: | Y:1 |
| 2859: | Y:1 |
| 2860: | Y:1 |
| 2861: | Y:1 |
| 2862: | Y:1 |
| 2863: | Y:1 |
| 2864: | Y:1 |
| 2865: | Y:1 |
| 2866: | Y:1 |
| 2867: | Y:1 |
| 2868: | Y:1 |
| 2869: | Y:1 |
| 2870: | Y:1 |
| 2871: | Y:1 |
| 2872: | Y:1 |
| 2873: | Y:1 |
| 2874: | Y:1 |
| 2875: | Y:1 |
| 2876: | Y:1 |
| 2877: | Y:1 |
| 2878: | Y:1 |
| 2879: | Y:1 |
| 2880: | Y:1 |
| 2881: | Y:1 |
| 2882: | Y:1 |
| 2883: | Y:1 |
| 2884: | Y:1 |
| 2885: | Y:1 |
| 2886: | Y:1 |
| 2887: | Y:1 |
| 2888: | Y:1 |
| 2889: | Y:1 |
| 2890: | Y:1 |
| 2891: | Y:1 |
| 2892: | Y:1 |
| 2893: | Y:1 |
| 2894: | Y:1 |
| 2895: | Y:1 |
| 2896: | Y:1 |
| 2897: | Y:1 |
| 2898: | Y:1 |
| 2899: | Y:1 |
| 2900: | Y:1 |
| 2901: | Y:1 |
| 2902: | Y:1 |
| 2903: | Y:1 |
| 2904: | P:1 |
| 2905: | P:1 |
| 2906: | P:1 |
| 2907: | P:1 |
| 2908: | P:1 |
| 2909: | P:1 |
| 2910: | P:1 |
| 2911: | P:1 |
| 2912: | P:1 |
| 2913: | P:1 |
| 2914: | P:1 |
| 2915: | P:1 |
| 2916: | P:1 |
| 2917: | P:1 |
| 2918: | P:1 |
| 2919: | P:1 |
| 2920: | P:1 |
| 2921: | P:1 |
| 2922: | P:1 |
| 2923: | P:1 |
| 2924: | P:1 |
| 2925: | P:1 |
| 2926: | P:1 |
| 2927: | P:1 |
| 2928: | P:1 |
| 2929: | P:1 |
| 2930: | P:1 |
| 2931: | P:1 |
| 2932: | P:1 |
| 2933: | P:1 |
| 2934: | P:1 |
| 2935: | P:1 |
| 2936: | P:1 |
| 2937: | P:1 |
| 2938: | P:1 |
| 2939: | P:1 |
| 2940: | P:1 |
| 2941: | P:1 |
| 2942: | P:1 |
| 2943: | P:1 |
| 2944: | P:1 |
| 2945: | P:1 |
| 2946: | P:1 |
| 2947: | P:1 |
| 2948: | P:1 |
| 2949: | P:1 |
| 2950: | P:1 |
| 2951: | P:1 |
| 2952: | P:1 |
| 2953: | P:1 |
| 2954: | P:1 |
| 2955: | P:1 |
| 2956: | P:1 |
| 2957: | AA:1 |
| 2958: | AA:1 |
| 2959: | AA:1 |
| 2960: | AA:1 |
| 2961: | AA:1 |
| 2962: | AA:1 |
| 2963: | AA:1 |
| 2964: | AA:1 |
| 2965: | AA:1 |
| 2966: | AA:1 |
| 2967: | AA:1 |
| 2968: | AA:1 |
| 2969: | AA:1 |
| 2970: | AA:1 |
| 2971: | AA:1 |
| 2972: | AA:1 |
| 2973: | AA:1 |
| 2974: | AA:1 |
| 2975: | AA:1 |
| 2976: | AA:1 |
| 2977: | AA:1 |
| 2978: | AA:1 |
| 2979: | AA:1 |
| 2980: | AA:1 |
| 2981: | AA:1 |
| 2982: | AA:1 |
| 2983: | AA:1 |
| 2984: | AA:1 |
| 2985: | AA:1 |
| 2986: | AA:1 |
| 2987: | AA:1 |
| 2988: | AA:1 |
| 2989: | AA:1 |

TABLE II-continued

| SEQ ID NO. | Spatial Distribution |
|---|---|
| 2990: | AA:1 |
| 2991: | AA:1 |
| 2992: | AA:1 |
| 2993: | AA:1 |
| 2994: | AA:1 |
| 2995: | AA:1 |
| 2996: | AA:1 |
| 2997: | AA:1 |
| 2998: | AA:1 |
| 2999: | AA:1 |
| 3000: | AA:1 |
| 3001: | AA:1 |
| 3002: | AA:1 |
| 3003: | AA:1 |
| 3004: | AA:1 |
| 3005: | AA:1 |
| 3006: | AA:1 |
| 3007: | AA:1 |
| 3008: | AA:1 |
| 3009: | AA:1 |
| 3010: | AA:1 |
| 3011: | AA:1 |
| 3012: | AA:1 |
| 3013: | AA:1 |
| 3014: | AA:1 |
| 3015: | AA:1 |
| 3016: | AA:1 |
| 3017: | AA:1 |
| 3018: | AA:1 |
| 3019: | AA:1 |
| 3020: | AA:1 |
| 3021: | AA:1 |
| 3022: | AA:1 |
| 3023: | AA:1 |
| 3024: | AA:1 |
| 3025: | AA:1 |
| 3026: | AA:1 |
| 3027: | AA:1 |
| 3028: | AA:1 |
| 3029: | AA:1 |
| 3030: | AA:1 |
| 3031: | AA:1 |
| 3032: | AA:1 |
| 3033: | AA:1 |
| 3034: | AA:1 |
| 3035: | AA:1 |
| 3036: | AA:1 |
| 3037: | AA:1 |
| 3038: | AA:1 |
| 3039: | AA:1 |
| 3040: | AA:1 |
| 3041: | AA:1 |
| 3042: | AA:1 |
| 3043: | AA:1 |
| 3044: | AA:1 |
| 3045: | AA:1 |
| 3046: | AA:1 |
| 3047: | AA:1 |
| 3048: | AA:1 |
| 3049: | AA:1 |
| 3050: | AA:1 |
| 3051: | AA:1 |
| 3052: | AA:1 |
| 3053: | AA:1 |
| 3054: | AA:1 |
| 3055: | AA:1 |
| 3056: | AA:1 |
| 3057: | AA:1 |
| 3058: | AA:1 |
| 3059: | AA:1 |
| 3060: | AA:1 |
| 3061: | AA:1 |
| 3062: | AA:1 |
| 3063: | AA:1 |
| 3064: | AA:1 |
| 3065: | AA:1 |
| 3066: | AA:1 |
| 3067: | AA:1 |
| 3068: | AA:1 |
| 3069: | AA:1 |
| 3070: | AA:1 |
| 3071: | AA:1 |
| 3072: | AA:1 |
| 3073: | AA:1 |
| 3074: | AA:1 |
| 3075: | AA:1 |
| 3076: | AA:1 |
| 3077: | AA:1 |
| 3078: | AA:1 |
| 3079: | AA:1 |
| 3080: | AA:1 |
| 3081: | N:1 |
| 3082: | N:1 |
| 3083: | N:1 |
| 3084: | N:1 |
| 3085: | N:1 |
| 3086: | X:1 |
| 3087: | X:1 |
| 3088: | X:1 |
| 3089: | X:1 |
| 3090: | X:1 |
| 3091: | X:1 |
| 3092: | X:1 |
| 3093: | X:1 |
| 3094: | X:1 |
| 3095: | X:1 |
| 3096: | X:1 |
| 3097: | D:1 |
| 3098: | D:1 |
| 3099: | D:1 |
| 3100: | D:1 |
| 3101: | D:1 |
| 3102: | D:1 |
| 3103: | D:1 |
| 3104: | D:1 |
| 3105: | D:1 |
| 3106: | D:1 |
| 3107: | D:1 |
| 3108: | D:1 |
| 3109: | D:1 |
| 3110: | D:1 |
| 3111: | D:1 |
| 3112: | D:1 |
| 3113: | D:1 |
| 3114: | D:1 |
| 3115: | D:1 |
| 3116: | D:1 |
| 3117: | D:1 |
| 3118: | D:1 |
| 3119: | D:1 |
| 3120: | D:1 |
| 3121: | D:1 |
| 3122: | D:1 |
| 3123: | D:1 |
| 3124: | D:1 |
| 3125: | D:1 |
| 3126: | G:1 |
| 3127: | G:1 |
| 3128: | G:1 |
| 3129: | G:1 |
| 3130: | G:1 |
| 3131: | G:1 |
| 3132: | G:1 |
| 3133: | G:1 |
| 3134: | G:1 |
| 3135: | G:1 |
| 3136: | G:1 |
| 3137: | G:1 |
| 3138: | G:1 |
| 3139: | G:1 |
| 3140: | G:1 |
| 3141: | G:1 |
| 3142: | G:1 |
| 3143: | G:1 |

TABLE II-continued

| SEQ ID NO. | Spatial Distribution |
|---|---|
| 3144: | G:1 |
| 3145: | G:1 |
| 3146: | G:1 |
| 3147: | G:1 |
| 3148: | G:1 |
| 3149: | G:1 |
| 3150: | G:1 |
| 3151: | G:1 |
| 3152: | G:1 |
| 3153: | G:1 |
| 3154: | G:1 |
| 3155: | G:1 |
| 3156: | G:1 |
| 3157: | G:1 |
| 3158: | G:1 |
| 3159: | G:1 |
| 3160: | G:1 |
| 3161: | G:1 |
| 3162: | G:1 |
| 3163: | G:1 |
| 3164: | G:1 |
| 3165: | G:1 |
| 3166: | G:1 |
| 3167: | G:1 |
| 3168: | G:1 |
| 3169: | G:1 |
| 3170: | G:1 |
| 3171: | G:1 |
| 3172: | G:1 |
| 3173: | G:1 |
| 3174: | G:1 |
| 3175: | G:1 |
| 3176: | G:1 |
| 3177: | G:1 |
| 3178: | G:1 |
| 3179: | G:1 |
| 3180: | G:1 |
| 3181: | G:1 |
| 3182: | G:1 |
| 3183: | G:1 |
| 3184: | G:1 |
| 3185: | G:1 |
| 3186: | G:1 |
| 3187: | G:1 |
| 3188: | G:1 |
| 3189: | G:1 |
| 3190: | G:1 |
| 3191: | G:1 |
| 3192: | G:1 |
| 3193: | G:1 |
| 3194: | G:1 |
| 3195: | G:1 |
| 3196: | G:1 |
| 3197: | G:1 |
| 3198: | G:1 |
| 3199: | G:1 |
| 3200: | G:1 |
| 3201: | G:1 |
| 3202: | G:1 |
| 3203: | G:1 |
| 3204: | H:1 |
| 3205: | H:1 |
| 3206: | H:1 |
| 3207: | H:1 |
| 3208: | H:1 |
| 3209: | H:1 |
| 3210: | H:1 |
| 3211: | H:1 |
| 3212: | H:1 |
| 3213: | H:1 |
| 3214: | H:1 |
| 3215: | H:1 |
| 3216: | H:1 |
| 3217: | H:1 |
| 3218: | H:1 |
| 3219: | H:1 |
| 3220: | H:1 |
| 3221: | H:1 |
| 3222: | H:1 |
| 3223: | H:1 |
| 3224: | H:1 |
| 3225: | H:1 |
| 3226: | H:1 |
| 3227: | H:1 |
| 3228: | H:1 |
| 3229: | H:1 |
| 3230: | H:1 |
| 3231: | H:1 |
| 3232: | H:1 |
| 3233: | H:1 |
| 3234: | H:1 |
| 3235: | H:1 |
| 3236: | H:1 |
| 3237: | H:1 |
| 3238: | H:1 |
| 3239: | H:1 |
| 3240: | H:1 |
| 3241: | H:1 |
| 3242: | H:1 |
| 3243: | H:1 |
| 3244: | H:1 |
| 3245: | H:1 |
| 3246: | H:1 |
| 3247: | H:1 |
| 3248: | H:1 |
| 3249: | H:1 |
| 3250: | H:1 |
| 3251: | H:1 |
| 3252: | H:1 |
| 3253: | H:1 |
| 3254: | H:1 |
| 3255: | H:1 |
| 3256: | H:1 |
| 3257: | H:1 |
| 3258: | H:1 |
| 3259: | H:1 |
| 3260: | H:1 |
| 3261: | H:1 |
| 3262: | H:1 |
| 3263: | H:1 |
| 3264: | H:1 |
| 3265: | H:1 |
| 3266: | H:1 |
| 3267: | H:1 |
| 3268: | H:1 |
| 3269: | H:1 |
| 3270: | H:1 |
| 3271: | H:1 |
| 3272: | H:1 |
| 3273: | H:1 |
| 3274: | H:1 |
| 3275: | H:1 |
| 3276: | H:1 |
| 3277: | H:1 |
| 3278: | H:1 |
| 3279: | H:1 |
| 3280: | H:1 |
| 3281: | H:1 |
| 3282: | H:1 |
| 3283: | H:1 |
| 3284: | H:1 |
| 3285: | H:1 |
| 3286: | H:1 |
| 3287: | H:1 |
| 3288: | H:1 |
| 3289: | H:1 |
| 3290: | H:1 |
| 3291: | H:1 |
| 3292: | H:1 |
| 3293: | H:1 |
| 3294: | H:1 |
| 3295: | H:1 |
| 3296: | H:1 |
| 3297: | H:1 |

TABLE II-continued

| SEQ ID NO. | Spatial Distribution |
|---|---|
| 3298: | H:1 |
| 3299: | H:1 |
| 3300: | H:1 |
| 3301: | H:1 |
| 3302: | H:1 |
| 3303: | H:1 |
| 3304: | H:1 |
| 3305: | H:1 |
| 3306: | H:1 |
| 3307: | H:1 |
| 3308: | H:1 |
| 3309: | H:1 |
| 3310: | H:1 |
| 3311: | H:1 |
| 3312: | H:1 |
| 3313: | H:1 |
| 3314: | H:1 |
| 3315: | H:1 |
| 3316: | H:1 |
| 3317: | H:1 |
| 3318: | H:1 |
| 3319: | H:1 |
| 3320: | H:1 |
| 3321: | H:1 |
| 3322: | H:1 |
| 3323: | H:1 |
| 3324: | H:1 |
| 3325: | H:1 |
| 3326: | H:1 |
| 3327: | H:1 |
| 3328: | H:1 |
| 3329: | H:1 |
| 3330: | H:1 |
| 3331: | H:1 |
| 3332: | H:1 |
| 3333: | H:1 |
| 3334: | H:1 |
| 3335: | H:1 |
| 3336: | H:1 |
| 3337: | H:1 |
| 3338: | H:1 |
| 3339: | H:1 |
| 3340: | H:1 |
| 3341: | H:1 |
| 3342: | H:1 |
| 3343: | H:1 |
| 3344: | H:1 |
| 3345: | H:1 |
| 3346: | H:1 |
| 3347: | H:1 |
| 3348: | H:1 |
| 3349: | H:1 |
| 3350: | H:1 |
| 3351: | H:1 |
| 3352: | H:1 |
| 3353: | H:1 |
| 3354: | H:1 |
| 3355: | H:1 |
| 3356: | H:1 |
| 3357: | H:1 |
| 3358: | H:1 |
| 3359: | H:1 |
| 3360: | H:1 |
| 3361: | H:1 |
| 3362: | H:1 |
| 3363: | H:1 |
| 3364: | H:1 |
| 3365: | H:1 |
| 3366: | H:1 |
| 3367: | H:1 |
| 3368: | H:1 |
| 3369: | H:1 |
| 3370: | H:1 |
| 3371: | H:1 |
| 3372: | H:1 |
| 3373: | H:1 |
| 3374: | H:1 |
| 3375: | H:1 |
| 3376: | H:1 |
| 3377: | H:1 |
| 3378: | H:1 |
| 3379: | H:1 |
| 3380: | H:1 |
| 3381: | H:1 |
| 3382: | H:1 |
| 3383: | H:1 |
| 3384: | H:1 |
| 3385: | H:1 |
| 3386: | H:1 |
| 3387: | H:1 |
| 3388: | H:1 |
| 3389: | H:1 |
| 3390: | H:1 |
| 3391: | H:1 |
| 3392: | H:1 |
| 3393: | H:1 |
| 3394: | H:1 |
| 3395: | H:1 |
| 3396: | H:1 |
| 3397: | H:1 |
| 3398: | H:1 |
| 3399: | H:1 |
| 3400: | H:1 |
| 3401: | H:1 |
| 3402: | H:1 |
| 3403: | H:1 |
| 3404: | H:1 |
| 3405: | H:1 |
| 3406: | H:1 |
| 3407: | H:1 |
| 3408: | H:1 |
| 3409: | H:1 |
| 3410: | H:1 |
| 3411: | H:1 |
| 3412: | H:1 |
| 3413: | O:1 |
| 3414: | O:1 |
| 3415: | O:1 |
| 3416: | O:1 |
| 3417: | O:1 |
| 3418: | O:1 |
| 3419: | O:1 |
| 3420: | O:1 |
| 3421: | O:1 |
| 3422: | O:1 |
| 3423: | S:1 |
| 3424: | S:1 |
| 3425: | S:1 |
| 3426: | S:1 |
| 3427: | S:1 |
| 3428: | S:1 |
| 3429: | S:1 |
| 3430: | S:1 |
| 3431: | S:1 |
| 3432: | S:1 |
| 3433: | S:1 |
| 3434: | S:1 |
| 3435: | S:1 |
| 3436: | S:1 |
| 3437: | Z:1 |
| 3438: | Z:1 |
| 3439: | Z:1 |
| 3440: | Z:1 |
| 3441: | Z:1 |
| 3442: | Z:1 |
| 3443: | Z:1 |
| 3444: | Z:1 |
| 3445: | I:1 |
| 3446: | I:1 |
| 3447: | I:1 |
| 3448: | J:1 |
| 3449: | J:1 |
| 3450: | J:1 |
| 3451: | J:1 |

TABLE II-continued

| SEQ ID NO. | Spatial Distribution |
|---|---|
| 3452: | J:1 |
| 3453: | J:1 |
| 3454: | J:1 |
| 3455: | J:1 |
| 3456: | A:1 |
| 3457: | A:1 |
| 3458: | A:1 |
| 3459: | A:1 |
| 3460: | AD:1 |
| 3461: | AD:1 |
| 3462: | AD:1 |
| 3463: | AD:1 |
| 3464: | AD:1 |
| 3465: | AD:1 |
| 3466: | AD:1 |
| 3467: | AD:1 |
| 3468: | AD:1 |
| 3469: | AD:1 |
| 3470: | AD:1 |
| 3471: | AD:1 |
| 3472: | AD:1 |
| 3473: | AD:1 |
| 3474: | AD:1 |
| 3475: | AD:1 |
| 3476: | AD:1 |
| 3477: | AD:1 |
| 3478: | AD:1 |
| 3479: | AD:1 |
| 3480: | AD:1 |
| 3481: | AD:1 |
| 3482: | AD:1 |
| 3483: | AD:1 |
| 3484: | AD:1 |
| 3485: | AD:1 |
| 3486: | AD:1 |
| 3487: | C:1 |
| 3488: | C:1 |
| 3489: | C:1 |
| 3490: | C:1 |
| 3491: | C:1 |
| 3492: | C:1 |
| 3493: | C:1 |
| 3494: | C:1 |
| 3495: | C:1 |
| 3496: | C:1 |
| 3497: | C:1 |
| 3498: | C:1 |
| 3499: | C:1 |
| 3500: | C:1 |
| 3501: | C:1 |
| 3502: | C:1 |
| 3503: | C:1 |
| 3504: | C:1 |
| 3505: | C:1 |
| 3506: | C:1 |
| 3507: | C:1 |
| 3508: | C:1 |
| 3509: | C:1 |
| 3510: | C:1 |
| 3511: | C:1 |
| 3512: | C:1 |
| 3513: | C:1 |
| 3514: | C:1 |
| 3515: | C:1 |
| 3516: | C:1 |
| 3517: | C:1 |
| 3518: | C:1 |
| 3519: | C:1 |
| 3520: | C:1 |
| 3521: | C:1 |
| 3522: | C:1 |
| 3523: | C:1 |
| 3524: | C:1 |
| 3525: | C:1 |
| 3526: | C:1 |
| 3527: | C:1 |
| 3528: | C:1 |
| 3529: | C:1 |
| 3530: | C:1 |
| 3531: | C:1 |
| 3532: | C:1 |
| 3533: | C:1 |
| 3534: | C:1 |
| 3535: | C:1 |
| 3536: | C:1 |
| 3537: | C:1 |
| 3538: | C:1 |
| 3539: | C:1 |
| 3540: | C:1 |
| 3541: | C:1 |
| 3542: | C:1 |
| 3543: | C:1 |
| 3544: | C:1 |
| 3545: | C:1 |
| 3546: | C:1 |
| 3547: | C:1 |
| 3548: | K:1 |
| 3549: | K:1 |
| 3550: | K:1 |
| 3551: | K:1 |
| 3552: | K:1 |
| 3553: | K:1 |
| 3554: | K:1 |
| 3555: | K:1 |
| 3556: | K:1 |
| 3557: | K:1 |
| 3558: | K:1 |
| 3559: | K:1 |
| 3560: | K:1 |
| 3561: | K:1 |
| 3562: | K:1 |
| 3563: | K:1 |
| 3564: | K:1 |
| 3565: | K:1 |
| 3566: | K:1 |
| 3567: | K:1 |
| 3568: | K:1 |
| 3569: | K:1 |
| 3570: | K:1 |
| 3571: | K:1 |
| 3572: | K:1 |
| 3573: | K:1 |
| 3574: | K:1 |
| 3575: | K:1 |
| 3576: | K:1 |
| 3577: | K:1 |
| 3578: | K:1 |
| 3579: | K:1 |
| 3580: | K:1 |
| 3581: | K:1 |
| 3582: | S:1 |
| 3583: | S:1 |
| 3584: | S:1 |
| 3585: | S:1 |
| 3586: | S:1 |
| 3587: | S:1 |
| 3588: | S:1 |
| 3589: | S:1 |
| 3590: | S:1 |
| 3591: | S:1 |
| 3592: | S:1 |
| 3593: | S:1 |
| 3594: | S:1 |
| 3595: | S:1 |
| 3596: | S:1 |
| 3597: | S:1 |
| 3598: | S:1 |
| 3599: | S:1 |
| 3600: | S:1 |
| 3601: | S:1 |
| 3602: | S:1 |
| 3603: | S:1 |
| 3604: | S:1 |
| 3605: | S:1 |

TABLE II-continued

| SEQ ID NO. | Spatial Distribution |
|---|---|
| 3606: | S:1 |
| 3607: | S:1 |
| 3608: | S:1 |
| 3609: | S:1 |
| 3610: | S:1 |
| 3611: | S:1 |
| 3612: | S:1 |
| 3613: | S:1 |
| 3614: | S:1 |
| 3615: | S:1 |
| 3616: | S:1 |
| 3617: | S:1 |
| 3618: | S:1 |
| 3619: | S:1 |
| 3620: | S:1 |
| 3621: | S:1 |
| 3622: | S:1 |
| 3623: | S:1 |
| 3624: | S:1 |
| 3625: | S:1 |
| 3626: | S:1 |
| 3627: | S:1 |
| 3628: | S:1 |
| 3629: | S:1 |
| 3630: | S:1 |
| 3631: | S:1 |
| 3632: | S:1 |
| 3633: | S:1 |
| 3634: | S:1 |
| 3635: | S:1 |
| 3636: | S:1 |
| 3637: | S:1 |
| 3638: | S:1 |
| 3639: | S:1 |
| 3640: | S:1 |
| 3641: | S:1 |
| 3642: | S:1 |
| 3643: | S:1 |
| 3644: | S:1 |
| 3645: | S:1 |
| 3646: | S:1 |
| 3647: | S:1 |
| 3648: | S:1 |
| 3649: | S:1 |
| 3650: | S:1 |
| 3651: | S:1 |
| 3652: | S:1 |
| 3653: | S:1 |
| 3654: | S:1 |
| 3655: | S:1 |
| 3656: | S:1 |
| 3657: | S:1 |
| 3658: | S:1 |
| 3659: | S:1 |
| 3660: | S:1 |
| 3661: | S:1 |
| 3662: | S:1 |
| 3663: | S:1 |
| 3664: | S:1 |
| 3665: | S:1 |
| 3666: | S:1 |
| 3667: | S:1 |
| 3668: | S:1 |
| 3669: | S:1 |
| 3670: | S:1 |
| 3671: | S:1 |
| 3672: | S:1 |
| 3673: | S:1 |
| 3674: | S:1 |
| 3675: | S:1 |
| 3676: | S:1 |
| 3677: | S:1 |
| 3678: | S:1 |
| 3679: | AB:1 |
| 3680: | W:1 |
| 3681: | W:1 |
| 3682: | W:1 |
| 3683: | W:1 |
| 3684: | W:1 |
| 3685: | W:1 |
| 3686: | W:1 |
| 3687: | W:1 |
| 3688: | W:1 |
| 3689: | W:1 |
| 3690: | W:1 |
| 3691: | W:1 |
| 3692: | W:1 |
| 3693: | W:1 |
| 3694: | W:1 |
| 3695: | W:1 |
| 3696: | W:1 |
| 3697: | W:1 |
| 3698: | W:1 |
| 3699: | W:1 |
| 3700: | W:1 |
| 3701: | W:1 |
| 3702: | W:1 |
| 3703: | W:1 |
| 3704: | W:1 |
| 3705: | W:1 |
| 3706: | W:1 |
| 3707: | W:1 |
| 3708: | W:1 |
| 3709: | W:1 |
| 3710: | W:1 |
| 3711: | W:1 |
| 3712: | W:1 |
| 3713: | W:1 |
| 3714: | W:1 |
| 3715: | N:1 |
| 3716: | N:1 |
| 3717: | N:1 |
| 3718: | N:1 |
| 3719: | N:1 |
| 3720: | N:1 |
| 3721: | B:1 K:3 T:4 Z:1 AA:16 AC:1 AD:5 |
| 3722: | B:1 H:3 AA:3 AC:4 AD:1 |
| 3723: | I:1 N:1 O:3 S:1 Y:1 |
| 3724: | C:10 P:17 S:3 T:1 X:2 |
| 3725: | O:1 P:1 |
| 3726: | C:1 K:4 P:34 S:2 T:1 X:3 Y:1 AA:2 |
| 3727: | C:1 K:2 P:24 S:2 X:2 AA:1 |
| 3728: | P:10 S:1 T:1 AA:1 |
| 3729: | C:4 F:2 H:5 K:5 O:2 W:1 |
| 3730: | C:18 K:28 S:167 |
| 3731: | B:2 E:1 H:2 J:1 K:1 L:2 T:1 AC:2 |
| 3732: | G:3 H:5 |
| 3733: | B:9 G:2 H:9 J:3 K:1 O:1 R:5 S:2 Z:2 AA:1 AC:1 |
| 3734: | N:123 AA:5 |
| 3735: | A:3 B:2 C:13 H:2 K:6 O:6 P:5 R:1 S:10 T:4 V:4 W:3 X:1 Y:2 Z:5 AA:47 AD:2 |
| 3736: | B:193 S:4 W:125 Y:94 |
| 3737: | C:3 H:12 K:12 N:1 S:5 T:9 Y:2 |
| 3738: | C:86 K:39 S:129 |
| 3739: | B:18 C:5 E:4 F:1 G:14 H:2 J:5 K:1 N:9 O:1 P:2 R:1 S:1 T:2 U:3 Y:4 Z:1 AA:10 AC:1 |
| 3740: | B:7 C:6 E:1 F:2 G:1 H:8 J:2 K:3 N:2 P:1 R:1 S:8 T:10 U:3 Z:1 AA:1 |
| 3741: | V:150 |
| 3742: | A:31 C:1 D:1 G:1 H:5 J:2 K:2 O:9 P:14 Q:17 R:1 S:5 W:3 X:12 Z:1 AA:12 AC:4 AD:3 |
| 3743: | A:2 I:4 N:112 |
| 3744: | E:4 R:2 J:147 K:1 L:2 N:231 O:1 T:3 U:2 AA:11 |

TABLE II-continued

| SEQ ID NO. | Spatial Distribution |
|---|---|
| 3745: | I:26 N:5 |
| 3746: | B:2 C:1 G:1 J:1 S:1 T:3 Y:3 AA:1 AC:1 |
| 3747: | A:2 B:4 C:6 D:1 E:1 F:1 G:1 H:5 J:4 K:3 P:2 S:12 T:1 W:7 AA:11 AD:8 |
| 3748: | P:1 S:1 T:1 Y:1 AA:4 |
| 3749: | B:6 C:2 D:2 F:2 G:2 H:1 S:3 T:6 W:9 Y:3 AA:13 AC:1 |
| 3750: | B:16 H:3 J:2 K:1 O:2 S:1 T:2 U:6 V:1 W:3 X:1 Y:8 Z:3 AA:11 AC:15 |
| 3751: | B:19 D:1 H:2 J:2 K:1 O:2 S:1 T:2 U:6 V:1 W:5 X:1 Y:10 Z:3 AA:11 AC:15 |
| 3752: | B:26 D:1 H:4 J:4 K:2 O:4 S:3 T:4 U:11 V:2 W:5 X:3 Y:10 Z:6 AA:19 AC:30 |
| 3753: | C:5 E:6 H:12 S:3 T:5 W:2 |
| 3754: | C:6 H:3 K:2 W:2 Y:2 |
| 3755: | C:6 H:3 K:2 W:2 Y:2 |
| 3756: | C:4 S:4 T:1 |
| 3757: | B:7 C:4 G:1 H:8 K:5 N:4 O:3 Q:2 S:6 T:1 U:1 V:2 Y:3 AA:1 |
| 3758: | B:1 C:16 F:2 H:11 J:3 K:7 N:4 O:11 P:35 S:35 T:15 U:3 V:2 W:21 X:9 Y:4 Z:3 AA:26 AC:4 AD:2 |
| 3759: | B:2 C:4 H:1 S:1 Y:1 |
| 3760: | B:5 H:3 P:3 |
| 3761: | G:2 I:3 N:10 Q:2 Y:1 |
| 3762: | B:1 H:2 K:2 N:2 S:2 W:3 AD:2 |
| 3763: | H:2 |
| 3764: | B:6 C:3 G:2 H:3 K:4 Q:1 R:2 S:2 W:1 AC:4 |
| 3765: | H:4 S:3 |
| 3766: | A:4 B:18 C:13 G:5 H:7 J:2 K:6 L:2 N:7 O:5 P:17 Q:2 R:2 S:20 T:29 U:2 V:4 W:1 X:8 Z:4 AA:21 AC:7 AD:2 |
| 3767: | A:2 B:9 C:8 G:4 H:4 J:1 K:2 L:2 N:4 O:3 P:9 Q:1 R:2 S:13 T:16 U:1 V:4 W:1 X:5 Z:2 AA:16 AC:2 AD:2 |
| 3768: | C:10 G:2 H:12 K:2 R:2 S:6 T:3 V:4 W:2 X:2 Z:2 AC:4 |
| 3769: | C:8 G:1 H:7 K:1 R:1 S:3 T:2 V:3 W:1 X:2 Z:2 AC:2 |
| 3770: | C:10 G:1 H:8 K:1 R:1 S:3 T:2 V:3 W:1 X:3 Z:3 AC:2 |
| 3771: | A:1 B:3 C:8 D:2 E:1 G:4 H:4 K:2 L:2 N:1 P:1 R:2 S:5 T:2 X:1 Z:3 AA:7 AC:2 |
| 3772: | B:2 H:5 K:1 P:2 Q:1 S:1 Y:1 AC:1 |
| 3773: | H:3 I:2 |
| 3774: | B:4 C:4 D:3 H:1 S:2 V:1 AA:1 |
| 3775: | B:3 C:4 E:2 H:8 K:5 P:1 R:1 S:3 V:1 X:2 |
| 3776: | N:3 |
| 3777: | J:1 N:1 O:1 P:15 T:2 AA:3 |
| 3778: | B:3 G:2 S:1 |
| 3779: | AA:4 |
| 3780: | C:1 S:2 AA:6 |
| 3781: | B:16 H:2 W:2 X:1 Y:1 |
| 3782: | R:8 |
| 3783: | B:12 G:13 W:4 |
| 3784: | B:2 |
| 3785: | A:2 AA:33 |
| 3786: | B:4 C:2 G:2 H:12 K:1 L:2 S:3 T:1 U:2 V:1 Y:3 AA:1 AC:3 |
| 3787: | E:1 H:7 O:1 S:4 AA:9 |
| 3788: | B:1 G:1 W:1 AD:1 |
| 3789: | Q:1 |
| 3790: | J:1 |
| 3791: | T:1 |
| 3792: | R:1 |
| 3793: | F:1 |
| 3794: | O:1 |
| 3795: | O:1 |
| 3796: | B:1 |
| 3797: | B:1 |
| 3798: | P:1 |
| 3799: | AA:1 |
| 3800: | AA:1 |
| 3801: | G:1 |
| 3802: | H:1 |
| 3803: | H:1 |
| 3804: | H:1 |
| 3805: | H:1 |
| 3806: | H:1 |
| 3807: | S:1 |
| 3808: | S:1 |
| 3809: | J:1 |
| 3810: | C:1 |
| 3811: | W:1 |
| 3812: | B:13 C:36 E:7 F:7 G:25 H:56 J:5 K:21 L:3 N:4 O:14 P:17 Q:20 S:34 T:31 U:3 W:11 X:4 Y:6 Z:2 AA:25 AC:8 AD:22 |
| 3813: | B:2 G:1 O:3 |
| 3814: | B:14 C:51 D:5 E:6 F:6 G:8 H:15 J:1 K:18 L:1 N:4 O:3 P:18 Q:4 R:12 S:41 T:18 W:4 X:8 Y:5 Z:3 AA:20 AC:6 AD:13 |
| 3815: | A:4 B:7 C:6 D:2 E:2 G:6 H:13 J:6 K:2 N:2 P:4 R:3 S:6 T:1 W:2 Y:2 Z:6 AA:6 |
| 3816: | A:2 B:17 C:25 D:10 E:5 F:1 G:22 R:40 I:1 J:4 K:13 N:4 O:7 P:14 Q:3 R:4 S:43 T:3 V:1 W:4 X:3 Y:13 Z:2 AA:24 AB:1 AC:2 AD:27 |
| 3817: | A:2 D:15 C:20 D:9 E:2 G:16 H:30 I:1 J:4 K:9 N:3 O:8 P:13 Q:3 R:3 S:39 T:1 W:4 X:3 Y:13 Z:1 AA:20 AB:1 AC:2 AD:19 |
| 3818: | B:4 C:2 E:1 G:3 H:5 J:2 K:6 O:3 R:4 S:3 T:3 V:1 W:5 Y:3 Z:1 AA:2 AC:1 |
| 3819: | B:4 P:2 AA:1 |
| 3820: | B:5 C:1 F:1 G:2 H:2 K:2 O:4 S:2 T:2 W:1 Z:1 AA:1 AC:1 |
| 3821: | A:2 B:31 C:76 D:4 E:37 F:5 G:33 H:91 I:5 J:10 K:35 L:2 N:7 O:24 P:52 Q:14 R:11 S:41 T:29 U:3 V:4 W:16 X:10 Y:8 Z:17 AA:45 AC:29 AD:20 |
| 3822: | B:26 C:4 D:2 E:1 F:4 G:7 J:1 K:6 N:1 O:1 P:2 R:1 S:3 T:2 W:2 X:1 Y:1 Z:1 AA:1 AC:2 AD:1 |
| 3823: | A:2 B:3 Q:1 R:1 S:2 Z:1 AA:2 |
| 3824: | B:3 Y:1 |
| 3825: | B:4 E:2 G:2 H:8 I:2 K:2 P:1 Z:1 AA:5 |
| 3826: | B:3 H:1 O:1 T:1 Y:3 AC:1 |
| 3827: | B:14 C:3 E:5 F:2 G:9 H:4 J:1 K:3 O:11 P:3 Q:3 R:3 S:6 T:2 U:1 V:1 X:5 Y:2 AA:1 AC:2 |
| 3828: | E:4 H:4 O:1 X:1 AA:2 AC:1 |
| 3829: | B:100 G:1 W:2 Y:7 |
| 3830: | B:161 G:2 W:3 Y:9 |

TABLE II-continued

| SEQ ID NO. | Spatial Distribution |
|---|---|
| 3831: | A:1 B:4 C:3 E:3 F:2 H:3 K:9 O:4 P:2 Q:1 R:2 T:2 W:2 Z:2 AA:3 AD:2 |
| 3832: | S:1 AC:1 |
| 3833: | A:3 B:18 C:26 E:9 F:2 G:23 H:24 I:2 J:4 K:12 N:6 O:15 P:20 Q:9 R:10 S:24 T:11 U:1 V:6 W:2 X:2 Y:10 Z:4 AA:15 AC:2 AD:12 |
| 3834: | B:50 C:8 E:4 F:1 G:22 H:24 I:1 J:1 K:5 N:2 O:6 P:7 Q:7 R:8 S:10 T:2 W:3 X:4 Y:6 Z:2 AA:8 AC:6 |
| 3835: | B:54 C:8 E:4 F:1 G:26 H:26 I:1 J:1 K:5 N:2 G:6 P:7 Q:7 R:8 S:10 T:2 W:4 X:4 Y:6 Z:2 AA:8 AC:6 |
| 3836: | B:14 E:1 F:2 G:2 T:2 W:1 X:1 Y:1 |
| 3837: | A:1 B:57 C:59 D:7 E:24 F:4 G:38 H:63 I:2 J:14 K:26 N:16 O:8 P:51 Q:15 R:6 S:43 T:31 U:2 V:10 W:5 X:9 Y:17 Z:10 AA:53 AC:10 AD:31 |
| 3838: | A:1 B:56 C:56 D:7 E:24 F:4 G:37 H:59 I:2 J:12 K:25 N:16 O:7 P:51 Q:15 R:6 S:42 T:31 U:2 V:10 W:5 X:9 Y:17 Z:10 AA:49 AC:10 AD:31 |
| 3839: | B:1 C:1 G:4 H:3 K:1 P:1 S:1 AA:2 AC:1 |
| 3840: | B:1 C:3 G:1 H:2 S:1 T:1 AA:3 AD:2 |
| 3841: | C:2 K:5 N:2 O:5 P:59 S:21 T:1 X:5 AA:3 AD:1 |
| 3842: | C:2 K:5 N:2 O:5 P:59 S:21 T:1 X:5 AA:3 AD:1 |
| 3843: | B:2 H:4 P:2 S:3 T:2 Y:1 AD:2 |
| 3844: | B:9 C:2 G:2 H:3 J:1 P:1 Q:2 S:6 T:1 W:2 Z:2 AA:2 |
| 3845: | C:4 F:1 H:2 K:2 S:9 T:4 U:3 Y:1 AA:1 AC:1 AD:1 |
| 3846: | B:2 C:10 D:1 G:4 H:6 J:1 K:4 N:1 R:1 S:3 T:1 W:2 Y:4 Z:1 AA:4 AC:5 |
| 3847: | B:4 C:15 D:2 G:4 H:8 J:2 K:5 N:2 R:2 S:5 T:1 W:2 Y:6 Z:2 AA:6 AC:6 |
| 3848: | A:6 B:49 C:49 D:9 E:17 F:12 G:15 H:63 I:3 J:23 K:23 L:6 N:15 O:25 P:60 Q:5 R:7 S:55 T:61 U:2 V:12 W:12 X:19 Y:18 Z:11 AA:43 AC:22 AD:29 |
| 3849: | A:6 B:46 C:71 D:13 E:15 F:21 G:17 H:80 I:4 J:22 K:26 L:3 N:11 O:30 P:51 Q:5 R:13 S:65 T:44 U:4 V:8 W:10 X:16 Y:22 Z:9 AA:33 AC:17 AD:40 |
| 3850: | B:1 H:1 |
| 3851: | B:1 G:1 W:13 Y:6 |
| 3852: | B:11 C:8 E:1 G:1 H:4 K:1 O:3 P:2 S:3 V:2 X:1 AC:1 AD:1 |
| 3853: | A:3 B:31 C:44 D:7 E:6 F:1 G:13 H:77 I:2 J:2 K:29 N:4 O:8 P:28 Q:15 R:12 S:73 T:8 U:11 V:7 W:8 X:9 Y:17 Z:4 AA:40 AB:1 AC:11 AD:31 |
| 3854: | B:3 E:4 G:3 H:6 K:1 N:1 P:6 S:2 W:3 Y:2 AC:2 AD:1 |
| 3855: | B:2 C:2 E:1 G:3 H:6 O:2 P:3 Z:1 AA:2 |
| 3856: | B:9 C:10 E:4 F:1 G:13 H:13 I:2 J:2 K:6 O:10 P:11 Q:3 R:3 S:6 T:7 V:3 W:5 X:4 Z:6 AA:1 AC:6 |
| 3857: | B:9 C:9 E:4 F:1 G:12 H:13 I:2 J:2 K:6 O:10 P:11 Q:3 R:3 S:6 T:7 V:3 W:4 X:3 Z:5 AA:1 AC:6 |
| 3858: | B:4 G:7 H:1 S:2 Y:3 |
| 3859: | B:7 G:1 |
| 3860: | B:2 |
| 3861: | B:1 G:3 H:9 S:3 Y:1 Z:1 AA:22 |
| 3862: | B:1 G:3 H:9 S:2 Y:1 Z:1 AA:19 |
| 3863: | B:1 G:4 H:8 S:4 Y:1 Z:1 AA:21 |
| 3864: | B:28 C:51 D:4 E:11 F:4 G:22 H:256 I:4 J:7 K:22 L:3 N:3 O:18 P:37 Q:8 R:9 S:47 T:8 V:4 W:9 X:4 Y:17 Z:22 AA:149 AC:3 AD:23 |
| 3865: | B:11 C:25 D:1 E:4 F:1 G:7 H:156 I:1 J:5 K:13 L:1 O:10 P:16 Q:5 R:5 S:23 T:3 W:5 X:1 Y:9 Z:10 AA:97 AD:10 |
| 3866: | B:22 C:1 D:1 E:4 F:2 G:9 H:20 J:3 K:6 O:7 P:19 Q:2 R:6 S:18 T:5 W:2 X:3 Y:7 AA:8 AC:7 AD:3 |
| 3867: | B:2 C:2 F:3 G:2 H:11 K:3 O:2 P:2 S:8 T:1 W:2 Y:1 AA:3 AC:1 AD:1 |
| 3868: | A:6 B:24 C:55 D:2 F:4 G:11 H:11 J:5 K:25 N:2 O:11 P:2 Q:6 R:17 S:21 T:4 W:9 Y:13 Z:2 AA:16 AC:7 AD:13 |
| 3869: | H:1 W:1 |
| 3870: | B:4 F:1 K:2 O:1 P:1 R:1 S:2 Y:1 AA:4 AC:4 |
| 3871: | B:14 C:5 D:1 E:2 F:1 G:6 H:1 K:1 N:1 O:2 Q:1 R:3 T:9 V:2 W:1 Y:3 Z:2 AA:7 AC:1 AD:1 |
| 3872: | A:5 B:15 C:44 F:3 G:43 H:89 I:1 J:3 K:28 L:1 N:6 O:12 P:47 Q:13 R:12 S:52 T:6 U:5 W:2 X:11 Y:4 Z:1 AA:21 AC:9 AD:31 |
| 3873: | A:6 B:18 C:64 F:5 G:61 H:93 I:2 J:5 K:32 L:2 N:9 O:15 P:64 Q:15 R:13 S:60 T:12 U:7 W:4 X:13 Y:7 Z:2 AA:26 AC:10 AD:42 |
| 3874: | B:1 C:2 K:2 O:3 P:1 R:2 S:1 Y:3 AA:9 |
| 3875: | B:8 C:3 S:5 U:1 W:1 |
| 3876: | A:1 B:29 C:32 D:2 E:7 G:27 H:49 I:1 J:11 K:18 L:1 N:4 O:15 P:27 Q:13 R:5 S:31 T:6 U:3 V:3 W:6 X:10 Y:17 Z:13 AA:24 AC:7 AD:22 |
| 3877: | B:40 C:1 D:2 G:1 H:11 K:1 N:1 O:1 S:2 T:1 W:5 X:3 Y:12 Z:2 AA:4 AD:2 |
| 3878: | B:58 C:2 D:3 G:2 H:8 N:1 S:1 W:5 X:5 Y:13 AA:4 AD:2 |
| 3879: | C:4 F:1 AC:3 |
| 3880: | B:10 C:7 H:10 J:1 K:6 O:1 S:10 T:2 U:1 Y:2 AA:6 AC:7 AD:5 |
| 3881: | H:1 K:1 P:1 AA:2 |
| 3882: | A:3 B:22 C:74 D:6 E:4 F:6 G:55 H:45 J:7 K:36 L:1 N:10 O:16 P:27 Q:17 R:12 S:24 T:29 U:6 V:1 W:6 X:11 Y:2 Z:6 AA:17 AB:1 AC:8 AD:7 |

TABLE II-continued

| SEQ ID NO. | Spatial Distribution |
|---|---|
| 3883: | A:5 B:61 C:12 D:13 E:3 F:12 G:21 H:45 I:17 J:16 K:7 L:9 N:64 O:23 P:31 Q:3 R:25 S:35 T:60 V:3 W:36 X:5 Y:20 Z:20 AA:58 AB:1 AC:16 AD:13 |
| 3884: | A:5 B:60 C:12 D:12 E:3 F:12 G:21 H:45 I:17 J:16 K:7 L:9 N:67 O:25 P:31 Q:3 R:25 S:35 T:61 V:3 W:37 X:5 Y:19 Z:20 AA:60 AB:1 AC:16 AD:12 |
| 3885: | A:5 B:61 C:12 D:13 E:3 F:12 G:21 H:45 I:17 J:16 K:7 L:9 N:67 O:24 P:31 Q:3 R:25 S:35 T:61 V:3 W:37 X:5 Y:20 Z:21 AA:60 AB:1 AC:16 AD:12 |
| 3886: | B:3 C:1 D:1 G:2 K:2 O:1 W:4 Y:1 |
| 3887: | B:2 C:2 E:1 G:2 H:3 O:1 P:1 T:1 U:1 AA:1 |
| 3888: | C:3 E:1 G:1 H:7 K:1 N:2 O:1 P:2 S:1 W:1 AD:2 |
| 3889: | C:5 G:4 H:9 J:1 K:4 N:3 O:4 Q:1 T:3 W:2 AC:1 AD:1 |
| 3890: | B:17 C:4 D:5 F:3 H:4 J:9 K:2 P:2 R:39 S:6 T:2 V:1 W:28 Y:15 Z:1 AA:13 AC:7 AD:1 |
| 3891: | B:16 C:4 D:4 F:3 G:1 H:3 J:9 K:2 N:1 P:1 R:39 S:5 T:2 W:25 Y:12 Z:1 AA:12 AC:6 AD:1 |
| 3892: | B:8 C:1 D:4 F:2 H:3 J:2 K:2 R:21 S:1 T:1 W:9 Y:7 AA:6 AC:1 |
| 3893: | B:3 C:1 H:5 J:1 L:1 P:1 Q:1 S:1 X:1 AD:1 |
| 3894: | B:5 C:3 G:8 H:5 K:5 P:5 S:4 V:6 Y:3 Z:2 AA:5 |
| 3895: | B:9 C:10 E:2 G:4 H:23 I:1 K:8 N:5 P:3 R:1 S:11 T:1 U:2 W:1 Z:4 AC:4 AD:8 |
| 3896: | P:1 AD:1 |
| 3897: | B:1 C:1 G:3 K:2 O:2 X:3 |
| 3898: | A:1 B:55 C:103 D:11 E:21 F:2 G:75 H:150 I:5 3:10 K:55 N:7 O:31 P:72 Q:44 R:24 S:108 T:20 V:8 W:23 X:4 Y:16 Z:13 AA:60 AC:25 AD:41 |
| 3899: | B:2 H:2 O:1 T:2 |
| 3900: | B:3 C:1 G:1 K:3 S:2 |
| 3901: | B:3 H:5 K:1 N:1 O:4 S:1 T:2 |
| 3902: | B:6 C:7 G:3 H:10 I:2 K:1 O:2 P:8 Q:2 R:3 S:5 T:3 Y:5 Z:24 AA:1 AD:4 |
| 3903: | B:21 C:3 G:5 H:10 J:1 K:3 N:2 O:1 P:3 Q:1 R:1 S:4 T:4 V:3 W:3 X:1 AA:2 AC:1 |
| 3904: | B:4 C:9 G:2 H:5 K:1 N:1 O:4 P:2 S:2 T:4 W:2 Y:1 AC:3 |
| 3905: | F:207 R:59 S:1 AA:1 |
| 3906: | B:2 G:1 H:2 O:3 P:2 Q:1 S:1 X:1 Z:1 AA:2 |
| 3907: | S:3 |
| 3908: | C:1 H:2 T:1 V:1 |
| 3909: | B:1 C:2 O:1 P:2 |
| 3910: | B:3 E:2 G:1 H:3 K:2 R:2 T:3 Y:2 AA:3 |
| 3911: | B:2 C:3 D:1 G:4 H:1 J:1 K:2 L:2 O:3 P:1 Q:1 S:2 Y:1 AD:3 |
| 3912: | B:2 C:3 D:1 G:4 H:1 J:1 K:2 L:2 O:3 P:1 Q:1 S:2 Y:1 AD:3 |
| 3913: | B:3 H:3 K:3 N:1 O:1 S:2 W:1 Z:1 AC:1 |
| 3914: | H:1 K:1 Q:1 T:1 V:1 AA:1 AC:2 |
| 3915: | H:1 K:1 Q:1 T:1 V:1 AA:1 AC:2 |
| 3916: | B:66 C:8 G:23 H:22 I:1 J:1 K:5 L:1 O:5 P:2 Q:1 S:11 T:1 W:7 Y:5 AA:6 AD:1 |
| 3917: | B:65 C:9 E:1 G:20 H:21 I:1 J:1 K:5 L:1 O:3 P:2 Q:1 R:3 S:12 T:1 W:6 Y:4 AA:7 |
| 3918: | D:3 H:4 |
| 3919: | B:19 C:4 F:1 H:5 I:1 J:4 K:3 O:2 P:4 R:9 S:7 U:2 W:1 X:1 Y:7 AA:6 AC:1 AD:2 |
| 3920 | A:2 B:10 C:9 G:19 H:33 O:4 P:10 Q:2 R:8 S:10 W:4 X:4 Y:4 Z:2 AA:11 AC:7 AD:4 |
| 3921 | A:1 B:6 C:7 G:12 H:18 O:4 P:5 Q:1 R:5 S:7 W:2 X:3 Y:3 Z:1 AA:10 AC:5 AD:2 |
| 3922: | B:6 C:6 E:2 F:1 G:3 H:5 K:1 P:2 Q:2 V:1 W:1 Y:1 AC:2 |
| 3923: | B:4 C:1 G:5 H:3 J:2 K:1 O:1 P:3 V:1 Y:3 Z:1 AA:1 AC:1 |
| 3924: | B:7 C:1 G:8 H:5 J:2 K:2 O:2 P:3 V:1 Y:4 Z:2 AA:1 AC:2 |
| 3925: | B:4 C:4 G:1 H:5 J:1 K:2 O:2 T:2 Y:2 AA:3 AD:1 |
| 3926: | B:5 G:1 H:3 K:1 |
| 3927: | H:6 |
| 3928: | AA:4 |
| 3929: | A:1 B:14 C:53 E:2 F:7 G:15 H:22 I:3 J:4 K:20 N:1 O:7 P:19 Q:6 R:4 S:35 T:11 U:3 V:3 W:3 X:4 Y:3 Z:3 AA:13 AC:9 AD:15 |
| 3930: | B:5 E:1 K:3 P:1 S:3 V:2 |
| 3931: | B:15 C:46 D:5 E:2 F:5 G:14 H:31 I:2 J:12 K:10 L:1 N:5 O:5 P:27 Q:2 R:7 S:35 T:11 U:2 V:2 W:11 X:1 Y:8 Z:5 AA:21 AD:19 |
| 3932: | B:1 O:2 S:2 T:1 Y:1 AC:1 |
| 3933: | B:1 E:1 H:1 S:1 AA:1 AD:2 |
| 3934: | C:3 D:1 H:3 O:1 |
| 3935: | B:5 C:2 G:2 P:1 S:1 W:3 X:2 Y:2 AD:1 |
| 3936: | B:4 C:5 E:1 G:1 H:4 P:1 S:2 Y:1 |
| 3937: | B:14 C:7 E:1 F:2 G:5 H:4 J:3 O:1 P:1 R:1 S:1 U:1 Y:3 AA:1 |
| 3938: | B:2 C:5 D:1 H:6 K:4 O:1 S:9 T:1 V:1 W:1 AA:1 |
| 3939: | B:3 C:7 D:4 E:3 F:1 G:3 H:5 J:1 K:2 L:2 N:7 P:6 Q:4 S:10 T:19 Z:1 AA:2 AC:5 AD:7 |
| 3940: | B:4 E:1 T:1 V:1 W:2 Y:1 Z:1 |
| 3941: | B:9 D:3 G:3 H:9 K:3 P:7 Q:1 S:4 T:13 W:2 X:1 AA:1 AC:1 AD:1 |
| 3942: | A:2 C:1 N:1 AA:4 |
| 3943: | B:42 C:21 E:4 F:1 G:9 H:22 I:5 J:20 K:7 N:2 O:4 P:17 Q:2 R:8 S:19 T:19 U:1 V:3 W:14 X:3 Y:22 Z:4 AA:20 AC:7 AD:8 |
| 3944: | B:2 C:14 E:5 F:2 G:6 H:23 J:2 K:9 N:2 O:3 P:8 Q:10 S:16 T:9 W:5 X:2 Y:1 Z:3 AA:16 AC:1 AD:9 |
| 3945: | A:1 B:3 C:3 G:3 H:3 J:2 O:7 P:3 Q:2 R:2 S:1 T:2 U:2 X:1 Z:2 AA:2 AD:2 |
| 3946: | C:4 O:4 P:7 AA:1 |

TABLE II-continued

| SEQ ID NO. | Spatial Distribution |
|---|---|
| 3947: | B:17 C:4 E:2 G:3 H:3 J:1 O:5 Q:1 S:1 T:6 W:1 X:1 AA:2 AC:2 |
| 3948: | G:1 H:1 |
| 3949: | AA:114 |
| 3950: | A:6 B:15 C:38 D:3 E:8 G:32 H:74 I:1 J:1 K:55 N:4 O:5 P:24 Q:9 R:1 S:51 T:24 U:9 V:1 W:5 X:6 Y:2 Z:1 AA:14 AB:1 AC:10 AD:18 |
| 3951: | A:4 B:8 C:30 D:2 E:5 G:24 H:50 I:1 J:1 K:44 N:1 O:5 P:18 Q:6 R:1 S:37 T:19 U:7 W:3 X:5 Y:2 Z:1 AA:8 AB:1 AC:9 AD:11 |
| 3952: | S:2 AC:2 |
| 3953: | B:3 S:1 AA:1 |
| 3954: | E:1 G:4 H:4 Y:1 AA:2 |
| 3955: | B:4 C:15 E:2 H:4 K:1 N:1 S:5 T:1 W:2 Y:2 AA:5 |
| 3956: | H:2 J:1 K:1 O:1 |
| 3957: | B:3 G:2 S:2 Y:1 |
| 3958: | C:1 K:2 L:1 N:4 S:9 T:18 W:1 AA:7 AC:22 AD:2 |
| 3959: | B:3 H:6 |
| 3960: | B:6 C:12 D:1 E:1 G:9 H:14 I:3 K:1 O:2 P:21 Q:3 R:1 S:3 T:1 V:2 W:1 Y:11 Z:6 AA:14 AC:3 AD:1 |
| 3961: | B:2 D:2 G:15 W:2 Y:1 |
| 3962: | W:2 |
| 3963: | B:1 C:1 G:1 J:1 P:3 S:1 T:3 Y:1 AA:1 AC:1 |
| 3964: | B:7 C:9 E:4 F:1 H:9 I:3 J:1 K:2 N:4 O:4 R:1 S:6 T:2 W:3 X:1 Z:3 AA:9 AC:2 AD:2 |
| 3965: | B:4 C:2 P:1 H:3 K:4 Y:1 |
| 3966: | B:11 C:4 D:2 E:1 F:1 H:1 K:9 O:1 P:1 Q:1 R:7 S:3 Z:1 AA:2 AD:1 |
| 3967: | R:2 Y:2 |
| 3968: | U:2 |
| 3969: | B:4 G:1 H:6 |
| 3970: | H:3 V:1 |
| 3971: | H:2 K:1 |
| 3972: | B:27 C:7 D:6 E:5 F:2 G:6 H:46 I:2 J:2 K:9 N:4 O:5 P:8 Q:3 R:6 S:22 T:1 W:15 X:2 Y:4 Z:2 AA:23 AC:2 AD:1 |
| 3973: | C:5 E:1 G:3 H:4 K:1 N:2 Q:1 S:10 W:1 X:1 Z:1 AA:9 AD:5 |
| 3974: | B:1 C:1 Q:4 T:2 V:2 AA:2 |
| 3975: | B:6 C:4 E:1 H:5 K:2 P:3 S:4 T:2 AA:3 AD:2 |
| 3976: | A:2 B:6 C:1 F:1 G:5 H:1 O:1 P:1 R:3 X:1 AA:1 |
| 3977: | A:3 B:11 C:9 D:1 G:3 H:11 J:2 K:7 P:8 Q:1 S:5 T:8 W:7 X:3 Z:1 AA:10 AD:6 |
| 3978: | B:1 C:1 H:1 P:1 |
| 3979: | H:8 Z:2 AA:8 |
| 3980: | B:1 T:4 |
| 3981: | B:1 AA:1 |
| 3982: | A:2 B:18 C:5 D:1 F:1 G:2 H:4 K:2 N:1 O:1 P:1 S:6 T:2 V:1 W:4 Y:1 AA:4 AC:1 AD:1 |
| 3983: | A:1 B:5 C:5 D:3 G:3 H:10 O:5 R:2 S:2 T:1 W:2 Z:3 AA:5 AC:1 |
| 3984: | B:3 C:2 H:8 N:1 O:1 Q:1 S:5 Y:5 |
| 3985: | B:1 AA:1 |
| 3986: | F:2 H:3 R:4 Y:2 AC:4 |
| 3987: | B:4 S:2 |
| 3988: | K:4 O:1 S:1 V:1 Y:1 AC:4 AD:2 |
| 3989: | B:7 D:1 K:3 N:1 O:1 P:1 Q:2 T:2 U:1 V:3 W:2 Y:1 Z:1 |
| 3990: | H:2 O:1 |
| 3991: | B:2 H:2 N:3 O:2 T:2 AD:2 |
| 3992: | G:7 H:25 I:71 V:15 AC:7 |
| 3993: | B:1 G:2 H:1 O:2 S:2 Z:1 |
| 3994: | B:1 C:2 H:1 P:2 T:1 Y:1 |
| 3995: | B:1 C:2 H:1 P:2 T:1 Y:1 |
| 3996: | B:1 K:1 O:2 S:1 T:6 Y:2 |
| 3997: | C:2 G:1 Q:1 Z:1 |
| 3998: | H:1 Y:1 |
| 3999: | H:3 |
| 4000: | B:4 F:1 G:3 N:1 O:3 S:2 X:1 Z:1 AC:1 |
| 4001: | B:3 C:1 P:4 |
| 4002: | C:1 H:2 |
| 4003: | B:6 F:1 P:2 |
| 4004: | B:2 H:1 W:2 AA:3 |
| 4005: | B:1 G:1 H:2 J:2 O:1 Y:1 |
| 4006: | T:3 W:2 AA:4 |
| 4007: | B:1 P:1 U:2 Y:1 |
| 4008: | C:3 H:1 |
| 4009: | B:22 C:9 G:4 H:14 J:7 K:12 N:5 O:1 P:1 R:7 S:6 W:2 X:1 Y:9 Z:1 AA:1 AC:1 |
| 4010: | B:5 G:6 H:5 K:1 P:5 S:7 AA:6 AC:2 AD:2 |
| 4011: | B:2 C:5 K:5 L:1 S:2 T:3 AA:2 |
| 4012: | B:15 C:3 G:4 H:1 R:1 S:4 W:1 X:2 Y:1 AC:1 |
| 4013 | B:2 C:2 K:1 O:6 S:1 AA:1 |
| 4014 | B:2 C:4 G:1 K:2 O:5 S:2 AA:2 |
| 4015: | A:2 B:28 C:100 D:17 E:15 F:8 G:18 H:59 J:4 K:45 L:5 N:25 O:11 P:35 Q:4 R:5 S:64 T:27 U:1 V:6 W:6 X:4 Y:9 Z:11 AA:56 AB:2 AC:6 AD:17 |
| 4016: | A:2 B:28 C:102 D:18 E:15 F:7 G:21 R:60 J:4 K:45 L:5 N:25 O:12 P:37 Q:4 R:5 S:66 T:28 U:1 V:7 W:6 X:4 Y:9 Z:11 AA:57 AB:2 AC:6 AD:17 |
| 4017: | A:1 B:13 C:44 D:12 E:2 G:6 H:27 K:16 N:5 O:7 P:19 R:2 S:25 T:3 V:3 W:1 Y:3 AA:35 AC:3 AD:3 |
| 4018: | H:2 Y:2 |
| 4019: | B:2 F:1 G:2 K:1 T:1 |
| 4020: | B:10 C:8 E:4 G:1 H:6 K:3 L:2 R:4 S:3 T:2 U:3 X:2 AC:2 |
| 4021: | B:14 C:15 E:3 G:1 H:11 K:1 L:1 R:8 S:7 T:1 U:3 X:2 AC:3 |
| 4022: | C:3 E:2 F:1 H:1 |
| 4023: | N:1 Y:1 |
| 4024: | C:3 F:1 O:1 S:1 |
| 4025: | B:2 H:1 |
| 4026: | H:5 O:1 |
| 4027: | B:1 C:2 E:1 W:2 |
| 4028: | J:20 |
| 4029: | C:1 H:1 |
| 4030: | B:9 C:2 F:1 G:2 H:1 W:1 |
| 4031: | B:9 S:1 |
| 4032: | H:2 U:1 |
| 4033: | B:8 C:1 G:1 H:2 J:4 S:2 W:1 Y:1 AC:1 |
| 4034: | B:3 |
| 4035: | B:4 C:1 H:1 X:1 Y:1 AC:1 |
| 4036: | C:1 K:2 W:1 Y:1 AD:1 |
| 4037: | H:2 T:2 U:2 W:2 AC:1 |

TABLE II-continued

| SEQ ID NO. | Spatial Distribution |
|---|---|
| 4038: | B:2 C:1 F:2 G:1 H:4 J:1 N:1 S:8 T:1 Z:1 AD:3 |
| 4039: | B:4 G:1 P:1 V:1 W:2 AD:1 |
| 4040: | B:1 C:9 S:1 W:2 |
| 4041: | B:2 |
| 4042: | C:1 AA:1 |
| 4043: | B:1 C:1 G:3 W:3 |
| 4044: | H:1 S:1 |
| 4045: | C:1 H:4 S:3 |
| 4046: | B:2 E:1 F:1 G:2 K:1 O:1 |
| 4047: | B:9 D:4 E:2 F:2 J:5 N:2 O:1 R:1 T:2 X:2 Z:1 AA:1 |
| 4048: | H:2 O:1 |
| 4049: | C:2 AA:1 AC:2 |
| 4050: | B:1 X:1 AC:1 |
| 4051: | B:2 H:1 O:1 S:1 |
| 4052: | B:2 G:1 Y:1 AA:2 |
| 4053: | G:1 Y:1 |
| 4054: | X:1 |
| 4055: | X:1 |
| 4056: | O:1 |
| 4057: | O:1 |
| 4058: | B:1 |
| 4059: | B:1 |
| 4060: | B:1 |
| 4061: | B:1 |
| 4062: | B:1 |
| 4063: | B:1 |
| 4064: | B:1 |
| 4065: | B:1 |
| 4066: | AC:1 |
| 4067: | O:1 |
| 4068: | Y:1 |
| 4069: | P:1 |
| 4070: | P:1 |
| 4071: | P:1 |
| 4072: | AA:1 |
| 4073: | AA:1 |
| 4074: | AA:1 |
| 4075: | D:1 |
| 4076: | D:1 |
| 4077: | D:1 |
| 4078: | G:1 |
| 4079: | G:1 |
| 4080: | G:1 |
| 4081: | G:1 |
| 4082: | H:1 |
| 4083: | H:1 |
| 4084: | H:1 |
| 4085: | H:1 |
| 4086: | H:1 |
| 4087: | H:1 |
| 4088: | H:1 |
| 4089: | H:1 |
| 4090: | H:1 |
| 4091: | H:1 |
| 4092: | H:1 |
| 4093: | H:1 |
| 4094: | H:1 |
| 4095: | H:1 |
| 4096: | H:1 |
| 4097: | C:1 |
| 4098: | K:1 |
| 4099: | S:1 |
| 4100: | S:1 |
| 8178: | B:3 |
| 8179: | A:1 B:47 C:21 E:6 F:4 G:15 H:14 I:2 J:10 K:4 N:7 O:3 P:2 Q:1 R:14 S:13 V:3 W:3 Y:20 Z:4 AA:24 AB:2 AC:5 AD:1 |
| 8180: | A:1 B:58 C:26 E:6 F:4 G:17 H:18 I:3 J:10 K:7 N:7 O:4 P:4 Q:1 R:13 S:16 U:2 V:3 W:4 X:1 Y:23 Z:4 AA:25 AB:2 AC:8 AD:1 |
| 8181: | A:1 B:46 C:21 E:6 F:4 G:15 H:15 I:2 J:10 K:4 N:7 O:3 P:2 Q:1 R:16 S:13 V:3 W:3 Y:20 Z:4 AA:24 AB:2 AC:5 AD:1 |
| 8182: | A:1 B:45 C:18 E:5 F:4 G:14 H:12 I:2 J:9 K:4 N:7 O:3 P:2 Q:1 R:13 S:11 V:3 W:3 Y:17 Z:4 AA:23 AB:2 AC:5 AD:1 |
| 8183: | A:1 B:46 C:18 E:5 F:4 G:14 H:11 I:2 J:9 K:4 N:7 O:3 P:2 Q:1 R:11 S:11 V:3 W:3 Y:17 Z:4 AA:23 AB:2 AC:5 AD:1 |
| 8184: | A:1 B:57 C:23 E:5 F:4 G:16 H:15 I:3 J:9 K:7 N:7 O:4 P:4 Q:1 R:11 S:14 U:2 V:3 W:4 X:1 Y:20 Z:4 AA:24 AB:2 AC:8 AD:1 |
| 8185: | B:12 C:8 E:2 F:1 G:13 H:31 I:1 J:1 K:4 N:1 O:7 P:5 Q:4 R:4 S:11 T:10 U:1 V:2 W:2 X:1 Y:2 Z:2 AA:4 AC:3 AD:3 |
| 8186: | G:2 |
| 8187: | B:1 P:2 AD:1 |
| 8188: | B:2 Y:6 AA:2 AD:3 |
| 8189: | B:4 C:1 Y:1 |
| 8190: | B:1 G:2 |
| 8191: | A:6 B:44 C:12 D:19 E:3 F:12 G:20 H:60 I:19 J:16 K:7 L:9 N:75 O:29 P:31 Q:3 R:36 S:44 T:66 V:3 W:42 X:5 Y:22 Z:21 AA:62 AB:1 AC:17 AD:18 |
| 8192: | A:1 H:1 T:9 |
| 8193: | B:2 |
| 8194: | A:17 C:1 D:1 G:1 H:5 J:2 K:1 O:9 P:13 Q:15 R:1 S:5 W:2 X:11 Z:1 AA:6 AC:3 AD:2 |
| 8195: | A:2 I:4 N:103 |
| 8196: | T:2 AD:1 |
| 8197: | C:4 |
| 8198: | B:2 C:2 F:1 H:6 K:2 R:1 S:3 T:2 W:1 X:1 Y:2 AA:3 AC:1 |
| 8199: | B:1 H:1 AD:1 |
| 8200: | B:1 Y:1 |
| 8201: | B:26 G:1 J:1 S:1 W:6 |
| 8202: | B:46 G:2 J:2 S:1 W:11 |
| 8203: | N:1 S:1 T:1 AC:1 |
| 8204: | A:2 B:59 C:154 D:23 E:37 F:7 G:49 H:109 J:9 K:114 N:7 O:63 P:38 Q:39 R:10 S:87 T:5 U:7 V:4 W:2 X:17 Y:11 Z:10 AA:207 AB:2 AC:11 AD:147 |
| 8205: | H:1 O:1 X:1 |
| 8206: | B:3 H:2 K:2 O:2 P:7 S:3 W:3 X:1 AA:1 AC:2 |
| 8207: | G:3 |
| 8208: | H:1 S:1 AA:1 |
| 8209: | B:4 G:2 H:2 O:1 |
| 8210: | D:3 |
| 8211: | B:1 C:2 E:2 |
| 8212: | B:5 |
| 8213: | B:4 C:3 G:1 H:8 K:1 O:1 P:4 Q:1 S:3 T:1 W:1 Y:4 Z:13 AD:2 |
| 8214: | C:9 E:2 H:6 N:21 S:2 U:58 |
| 8215: | C:9 E:2 H:6 N:21 S:1 U:58 |
| 8216: | H:9 O:2 |
| 8217: | A:2 C:9 D:2 H:13 K:6 N:1 O:3 P:3 Q:2 R:5 S:9 T:1 W:3 Z:1 AA:6 AC:7 |
| 8218: | A:2 C:15 D:4 H:25 K:9 N:2 O:5 P:6 Q:3 R:5 S:13 T:4 W:5 Y:2 Z:1 AA:9 AC:15 |

TABLE II-continued

| SEQ ID NO. | Spatial Distribution |
|---|---|
| 8219: | V:37 |
| 8220: | K:2 |
| 8221: | C:2 H:1 V:1 |
| 8222: | H:19 |
| 8223: | B:2 |
| 8224: | AD:4 |
| 8225: | H:1 K:1 AC:3 |
| 8226: | AA:9 |
| 8227: | B:2 F:1 H:2 K:1 Y:1 AA:3 AC:1 |
| 8228: | B:8 G:4 Y:1 |
| 8229: | G:1 N:37 X:3 Y:4 Z:2 |
| 8230: | G:1 N:52 X:3 Y:6 Z:6 |
| 8231: | I:26 N:5 |
| 8232: | B:2 C:4 E:6 F:2 G:3 H:1 K:2 O:3 P:3 Q:1 S:1 T:8 U:1 X:1 Y:2 Z:1 AA:5 AD:3 |
| 8233: | K:2 P:6 S:7 T:3 W:1 X:5 Z:1 AA:6 |
| 8234: | H:2 S:1 |
| 8235: | F:1 H:2 S:3 W:2 |
| 8236: | B:3 C:5 D:5 F:9 G:3 H:11 K:1 O:3 P:2 S:4 T:10 V:1 W:14 Y:9 AC:21 AD:2 |
| 8237: | B:3 C:1 E:1 H:1 O:1 |
| 8238: | B:3 C:1 E:1 H:1 O:1 |
| 8239: | B:8 Z:1 |
| 8240: | B:9 Z:1 |
| 8241: | P:5 |
| 8242: | B:11 C:5 F:1 G:1 H:11 I:1 K:7 P:3 S:5 T:1 W:2 Y:7 |
| 8243: | C:7 P:19 S:4 T:1 X:3 |
| 8244: | T:2 |
| 8245: | B:4 C:5 E:3 G:1 H:12 K:4 L:3 O:6 Q:2 S:3 T:1 |
| 8246: | P:4 |
| 8247: | G:1 H:1 |
| 8248: | B:11 C:6 E:2 F:4 G:14 H:14 I:2 K:1 L:1 O:3 P:8 R:3 S:1 T:18 U:6 W:4 X:2 Y:4 AC:8 AD:9 |
| 8249: | C:1 K:3 P:29 S:2 X:4 Y:1 AA:2 |
| 8250: | C:1 K:2 P:30 S:2 T:1 X:5 Y:1 AA:2 |
| 8251: | C:1 K:3 P:29 S:2 X:4 Y:1 AA:1 |
| 8252: | B:2 |
| 8253: | B:2 C:3 F:5 G:6 H:4 I:3 J:4 K:2 P:5 R:5 T:1 Y:21 AA:6 AD:2 |
| 8254: | H:5 S:1 W:2 |
| 8255: | U:5 |
| 8256: | G:3 |
| 8257: | P:4 |
| 8258: | S:1 AD:1 |
| 8259: | B:1 C:2 D:1 E:13 F:12 G:4 J:2 L:21 N:21 O:29 Q:1 T:15 AA:1 |
| 8260: | B:1 C:2 D:1 E:13 F:12 G:3 J:2 L:22 N:24 O:29 Q:1 T:15 AA:1 |
| 8261: | H:2 AC:1 |
| 8262: | B:1 G:1 H:1 |
| 8263: | C:3 |
| 8264: | P:10 |
| 8265: | H:3 T:1 |
| 8266: | A:2 B:30 C:60 D:4 E:36 F:5 G:28 H:73 I:5 J:9 K:24 L:2 N:5 O:23 P:44 Q:14 R:7 S:33 T:26 U:3 V:4 W:12 X:10 Y:8 Z:16 AA:38 AC:25 AD:18 |
| 8267: | B:1 G:1 W:2 |
| 8268: | B:8 C:7 E:1 G:1 H:11 J:2 K:5 O:4 P:3 S:3 T:1 W:1 Y:1 AC:4 |
| 8269: | B:7 C:6 E:1 G:1 H:10 J:2 K:3 O:4 P:3 S:3 T:1 W:1 Y:1 AC:4 |
| 8270: | B:1 H:6 O:2 S:1 AA:11 |
| 8271: | B:2 C:2 P:1 AA:4 |
| 8272: | K:1 T:3 AC:2 |
| 8273: | E:1 S:1 |
| 8274: | A:4 B:49 C:148 D:1 E:24 F:5 G:74 H:83 I:4 J:10 K:68 L:1 N:15 O:19 P:48 Q:10 R:15 S:113 T:28 U:5 V:8 W:8 X:16 Y:14 Z:6 AA:20 AC:14 AD:41 |
| 8275: | C:3 G:1 O:1 P:1 X:2 |
| 8276: | T:1 AA:1 |
| 8277: | B:2 C:1 G:1 P:1 |
| 8278: | E:2 J:2 |
| 8279: | B:4 C:5 K:4 N:4 O:2 P:1 S:9 W:1 |
| 8280: | G:1 H:1 S:1 |
| 8281: | Z:2 |
| 8282: | B:5 D:2 H:1 K:1 N:2 O:7 P:2 S:3 T:13 W:1 Y:2 AD:3 |
| 8283: | B:5 G:1 H:5 K:1 O:1 P:4 S:3 W:2 Y:1 AA:3 |
| 8284: | B:5 G:1 H:8 K:1 O:1 P:4 S:1 W:1 Y:2 AA:4 |
| 8285: | B:1 AA:2 |
| 8286: | G:2 |
| 8287: | Y:2 |
| 8288: | C:1 H:1 N:1 W:4 Y:1 |
| 8289: | B:2 C:1 H:1 W:2 |
| 8290: | H:1 Y:1 |
| 8291: | AA:8 |
| 8292: | G:2 W:1 Y:8 AA:4 AC:2 |
| 8293: | B:1 H:1 S:1 |
| 8294: | B:4 C:2 K:2 |
| 8295: | H:1 P:2 S:3 AD:1 |
| 8296: | H:1 P:1 S:4 AD:1 |
| 8297: | AA:3 |
| 8298: | S:2 |
| 8299: | B:3 H:4 P:2 |
| 8300: | J:6 W:1 Y:2 |
| 8301: | V:3 |
| 8302: | H:1 U:2 |
| 8303: | C:1 S:1 |
| 8304: | C:3 H:2 S:1 |
| 8305: | P:1 Q:1 AA:1 |
| 8306: | P:1 Q:1 AA:1 |
| 8307: | B:8 G:2 W:1 Y:2 |
| 8308: | P:2 |
| 8309: | B:2 Y:1 |
| 8310: | A:1 B:3 C:3 F:4 G:5 H:5 K:2 O:6 P:2 R:1 S:8 T:2 W:2 AA:2 AC:1 |
| 8311: | C:21 K:38 S:186 |
| 8312: | C:1 P:1 R:1 U:3 Z:1 |
| 8313: | B:6 |
| 8314: | H:3 P:1 AC:1 |
| 8315: | H:1 X:1 |
| 8316: | G:1 S:4 |
| 8317: | Q:4 |
| 8318: | A:2 O:1 P:2 AA:1 |
| 8319: | B:2 |
| 8320: | C:2 H:11 P:3 S:2 V:4 W:1 AC:23 AD:3 |
| 8321: | B:3 F:2 |
| 8322: | D:11 |
| 8323: | O:2 P:12 X:2 AA:26 |
| 8324: | T:4 |
| 8325: | AA:3 |
| 8326: | H:3 W:1 |
| 8327: | P:2 |
| 8328: | B:1 AA:1 |
| 8329: | B:94 G:1 W:2 Y:5 |
| 8330: | B:72 G:1 W:2 Y:4 |
| 8331: | B:155 G:2 W:3 Y:7 |

TABLE II-continued

| SEQ ID NO. | Spatial Distribution |
|---|---|
| 8332: | B:155 G:2 W:3 Y:7 |
| 8333: | B:11 C:2 G:6 H:10 K:1 O:1 Q:1 S:2 T:2 V:1 W:2 X:2 Y:1 AA:1 AC:5 |
| 8334: | U:2 AA:5 |
| 8335: | B:4 |
| 8336: | AA:2 |
| 8337: | A:4 B:47 C:82 D:11 E:78 F:34 G:37 H:78 I:4 J:22 K:43 L:2 N:33 O:15 P:32 Q:11 R:14 S:56 T:118 U:2 V:6 W:6 X:10 Y:6 Z:12 AA:29 AB:2 AC:6 AD:32 |
| 8338: | A:4 B:44 C:76 D:10 E:73 F:34 G:37 H:75 I:4 J:22 K:43 L:2 N:32 O:14 P:32 Q:9 R:13 S:54 T:106 U:2 V:6 W:6 X:11 Y:6 Z:12 AA:27 AB:2 AC:7 AD:33 |
| 8339: | T:2 |
| 8340: | U:4 |
| 8341: | AD:3 |
| 8342: | B:3 |
| 8343: | A:2 B:2 C:4 E:3 F:1 H:2 K:3 O:3 P:1 Q:2 R:2 T:1 W:1 Z:1 AA:3 AD:1 |
| 8344: | AC:2 |
| 8345: | S:5 |
| 8346: | B:10 D:1 W:8 Y:2 |
| 8347: | B:15 D:1 W:10 Y:2 |
| 8348: | B:2 H:5 P:4 |
| 8349: | B:1 W:1 |
| 8350: | B:1 C:2 H:2 O:2 P:1 Q:1 S:2 W:2 AA:1 AC:3 AD:1 |
| 8351: | A:1 B:3 C:2 K:2 O:1 W:3 |
| 8352: | B:3 |
| 8353: | B:9 H:3 K:1 P:1 S:1 W:3 Y:4 |
| 8354: | A:3 B:9 C:11 G:1 H:4 J:1 K:4 L:2 N:4 O:5 P:11 Q:1 R:2 S:15 T:19 U:2 V:4 W:3 X:7 Z:2 AA:19 AC:5 AD:2 |
| 8355: | B:1 C:1 F:1 K:1 L:2 O:2 P:2 S:2 T:6 W:1 Z:1 AA:1 |
| 8356: | B:2 |
| 8357: | B:1 P:1 |
| 8358: | S:3 V:1 Y:1 AD:1 |
| 8359: | B:4 |
| 8360: | K:1 P:1 S:1 Y:1 |
| 8361: | C:7 G:1 H:5 K:1 R:1 S:3 T:2 V:3 W:1 X:2 Z:2 AC:2 |
| 8362: | B:4 H:1 |
| 8363: | H:2 U:108 |
| 8364: | Q:1 AA:1 |
| 8365: | A:2 B:12 C:18 D:3 E:7 F:2 G:14 H:30 K:7 O:6 P:2 R:2 S:17 T:2 W:3 Y:6 Z:6 AA:2 AC:1 |
| 8366: | B:3 C:1 G:1 H:1 S:3 T:4 W:1 |
| 8367: | B:1 I:1 |
| 8368: | P:2 |
| 8369: | B:4 C:1 L:1 N:1 O:1 |
| 8370: | C:1 G:1 Y:1 |
| 8371: | B:1 F:8 R:32 S:1 |
| 8372: | B:2 E:3 G:1 H:1 T:3 Y:1 |
| 8373: | B:2 E:3 G:1 H:1 T:2 Y:1 |
| 8374: | X:2 AC:2 |
| 8375: | AA:5 |
| 8376: | T:4 |
| 8377: | AA:4 |
| 8378: | Y:3 |
| 8379: | S:4 |
| 8380: | C:37 H:1 K:77 O:1 S:139 |
| 8381: | H:2 O:1 |
| 8382: | Y:2 |
| 8383: | B:19 C:2 E:1 F:2 G:21 H:13 J:1 K:4 O:9 P:5 S:1 T:4 V:6 W:1 Y:2 AA:2 AC:3 |
| 8384: | G:2 T:2 |
| 8385: | B:4 C:4 D:3 H:1 S:1 V:1 AA:1 |
| 8386: | AA:17 |
| 8387: | D:4 |
| 8388: | H:5 |
| 8389: | B:6 G:9 Y:1 |
| 8390: | C:5 H:4 N:1 O:3 S:1 AA:11 AC:6 |
| 8391: | V:7 |
| 8392: | B:6 H:2 |
| 8393: | I:2 |
| 8394: | A:2 K:1 O:6 |
| 8395: | Q:1 AC:1 |
| 8396: | B:11 G:3 H:10 J:2 K:1 O:1 R:4 S:2 Z:2 AA:1 AC:1 |
| 8397: | C:2 F:1 H:2 K:9 L:1 N:3 O:8 P:2 Q:2 R:2 S:4 V:1 W:1 Y:4 AA:14 AC:3 |
| 8398: | R:5 |
| 8399: | G:1 H:3 K:3 S:3 AD:1 |
| 8400: | O:3 |
| 8401: | B:7 H:1 |
| 8402: | AA:5 |
| 8403: | B:26 C:10 E:9 F:4 H:6 J:1 L:1 N:5 O:6 P:2 Q:4 R:3 S:4 T:16 V:5 W:2 X:5 Y:3 AA:1 |
| 8404: | B:24 C:10 E:9 F:4 H:6 J:1 L:1 N:5 O:6 P:2 Q:4 R:3 S:3 T:16 V:5 W:2 X:5 Y:3 AA:1 |
| 8405: | B:26 C:10 E:9 F:4 H:6 J:1 L:1 N:5 O:6 P:2 Q:4 R:3 S:4 T:16 V:5 W:2 X:5 Y:3 AA:1 |
| 8406: | G:2 |
| 8407: | V:2 |
| 8408: | C:2 K:9 O:18 |
| 8409: | B:2 |
| 8410: | T:3 Y:1 |
| 8411: | O:1 P:3 |
| 8412: | B:2 H:2 R:1 AA:3 |
| 8413: | B:1 C:1 Y:2 |
| 8414: | X:2 |
| 8415: | H:1 S:3 Z:1 |
| 8416: | C:1 G:1 T:1 |
| 8417: | AD:3 |
| 8418: | T:2 AA:2 |
| 8419: | B:5 C:11 D:3 F:11 G:1 H:7 J:6 L:1 N:10 O:2 P:3 R:7 S:8 T:10 V:2 W:3 Y:3 Z:1 AA:7 AC:8 AD:7 |
| 8420: | B:1 C:1 L:1 Y:1 |
| 8421: | C:1 K:1 |
| 8422: | B:2 H:3 O:2 AA:2 |
| 8423: | T:2 |
| 8424: | B:2 J:1 |
| 8425: | B:4 |
| 8426: | B:1 C:2 G:1 S:4 T:2 AA:1 AC:1 |
| 8427: | C:2 T:2 AA:1 |
| 8428: | B:1 K:1 N:1 V:1 W:4 Y:1 |
| 8429: | C:1 H:3 K:1 N:1 O:1 S:3 V:5 |
| 8430: | B:2 |
| 8431: | B:18 |
| 8432: | W:4 |
| 8433: | V:2 |
| 8434: | H:2 R:1 |
| 8435: | P:1 W:3 |
| 8436: | P:2 |
| 8437: | B:2 |
| 8438: | C:11 F:1 H:1 J:2 N:1 S:1 T:2 V:1 AC:2 |
| 8439: | A:2 B:24 C:68 D:13 E:12 F:8 G:10 H:41 J:2 K:34 L:2 N:16 O:9 P:28 Q:3 R:3 S:47 T:21 U:1 V:5 W:3 X:3 Y:5 Z:8 AA:47 AC:6 AD:11 |
| 8440: | B:2 |

TABLE II-continued

| SEQ ID NO. | Spatial Distribution |
|---|---|
| 8441: | B:2 |
| 8442: | B:1 G:1 |
| 8443: | P:2 |
| 8444: | H:1 J:1 |
| 8445: | B:3 W:1 |
| 8446: | B:2 E:1 G:4 W:1 |
| 8447: | B:2 E:2 G:4 W:1 |
| 8448: | B:2 E:1 G:3 W:1 |
| 8449: | H:1 O:1 Y:1 |
| 8450: | G:2 AC:2 |
| 8451: | B:2 G:1 |
| 8452: | L:1 N:1 S:1 AA:4 |
| 8453: | K:1 U:27 AA:2 |
| 8454: | G:1 O:1 P:1 |
| 8455: | D:1 S:2 |
| 8456: | B:2 |
| 8457: | G:1 O:1 P:1 AC:1 AD:2 |
| 8458: | H:5 |
| 8459: | B:1 L:1 |
| 8460: | Y:3 |
| 8461: | B:3 G:5 K:2 Y:4 AD:1 |
| 8462: | Q:1 W:3 |
| 8463: | B:2 C:2 E:1 G:3 H:3 O:2 S:3 Z:1 AA:3 |
| 8464: | O:1 V:3 |
| 8465: | B:20 C:6 F:8 G:3 H:12 K:5 P:1 S:12 X:2 Z:5 |
| 8466: | AA:8 |
| 8467: | T:2 |
| 8468: | B:4 C:5 D:3 K:1 L:1 P:3 R:1 S:1 W:1 Z:2 AC:1 |
| 8469: | S:3 |
| 8470: | F:1 X:1 |
| 8471: | H:1 S:2 AA:1 |
| 8472: | B:5 C:4 G:3 H:9 J:1 K:1 S:4 T:1 W:3 Z:1 AC:1 AD:3 |
| 8473: | B:1 T:1 |
| 8474: | F:5 J:2 R:1 |
| 8475: | H:2 |
| 8476: | C:6 U:23 |
| 8477: | Y:2 |
| 8478: | K:1 R:2 W:3 Z:1 |
| 8479: | B:2 C:1 H:4 Z:1 |
| 8480: | B:2 N:2 |
| 8481: | H:1 O:5 S:1 |
| 8482: | AD:3 |
| 8483: | B:1 E:2 H:3 P:1 S:2 AA:2 AD:1 |
| 8484: | Y:2 |
| 8485: | T:4 |
| 8486: | F:2 G:2 O:1 P:2 S:7 |
| 8487: | S:7 |
| 8488: | B:1 O:2 S:3 |
| 8489: | B:2 |
| 8490: | T:3 |
| 8491: | T:3 |
| 8492: | AC:2 |
| 8493: | B:1 C:1 H:1 S:1 AD:1 |
| 8494: | H:3 |
| 8495: | B:2 |
| 8496: | AA:3 |
| 8497: | B:1 S:1 |
| 8498: | H:4 S:1 |
| 8499: | S:3 |
| 8500: | S:2 |
| 8501: | B:1 T:1 |
| 8502: | H:1 O:1 V:1 |
| 8503: | P:2 X:4 |
| 8504: | B:1 H:1 |
| 8505: | B:2 F:2 G:2 O:2 T:4 Z:2 |
| 8506: | H:2 |
| 8507: | B:1 C:2 G:1 |
| 8508: | AA:3 |
| 8509: | R:1 AA:2 |
| 8510: | C:1 E:1 G:1 H:4 K:2 S:1 |
| 8511: | O:1 W:2 |
| 8512: | AA:3 |
| 8513: | B:3 G:1 |
| 8514: | G:1 S:1 |
| 8515: | P:2 |
| 8516: | B:2 AA:1 |
| 8517: | B:1 H:2 I:1 S:4 Z:1 AA:1 |
| 8518: | B:1 G:2 |
| 8519: | B:1 C:1 E:1 G:2 K:1 Q:1 T:1 V:1 Y:1 |
| 8520: | B:2 D:1 S:1 W:4 Y:3 |
| 8521: | O:1 W:2 |
| 8522: | B:3 G:2 |
| 8523: | B:5 G:2 |
| 8524: | J:2 |
| 8525: | T:3 |
| 8526: | P:2 S:2 |
| 8527: | S:1 T:3 |
| 8528: | S:1 T:2 |
| 8529: | B:6 |
| 8530: | B:2 |
| 8531: | AA:2 |
| 8532: | AA:6 |
| 8533: | H:1 S:1 |
| 8534: | B:1 G:1 Y:2 |
| 8535: | W:16 |
| 8536: | B:2 D:1 G:1 |
| 8537: | AA:2 |
| 8538: | B:3 |
| 8539: | I:1 N:1 |
| 8540: | P:1 T:1 |
| 8541: | H:1 AA:5 |
| 8542: | P:2 S:1 |
| 8543: | A:40 H:5 I:2 |
| 8544: | T:1 W:1 |
| 8545: | E:4 P:1 S:1 T:3 V:1 AC:2 |
| 8546: | F:1 P:2 AA:1 |
| 8547: | C:1 S:1 |
| 8548: | C:1 P:1 S:1 Z:1 AA:2 |
| 8549: | O:2 |
| 8550: | B:12 |
| 8551: | H:1 T:2 V:3 W:2 AA:1 |
| 8552: | B:2 |
| 8553: | Y:2 |
| 8554: | B:2 G:1 |
| 8555: | B:1 H:1 |
| 8556: | A:2 B:2 C:12 H:2 K:6 O:6 P:5 R:1 S:10 T:4 V:4 W:3 X:1 Y:2 Z:5 AA:45 AD:2 |
| 8557: | A:1 S:1 |
| 8558: | H:2 |
| 8559: | T:2 |
| 8560: | H:2 |
| 8561: | C:1 S:1 |
| 8562: | F:2 Y:1 |
| 8563: | B:2 |
| 8564: | P:2 |
| 8565: | A:1 B:26 C:9 D:1 E:3 G:3 H:1 J:2 K:4 L:1 N:4 O:4 Q:2 R:1 S:6 W:4 AA:4 AC:1 |
| 8566: | AA:2 |
| 8567: | B:1 H:1 T:1 |
| 8568: | C:1 AD:1 |
| 8569: | L:T O:1 |
| 8570: | S:2 |
| 8571: | AA:2 |
| 8572: | L:1 T:1 |
| 8573: | B:2 |
| 8574: | C:1 K:1 P:3 X:1 |
| 8575: | H:2 |
| 8576: | B:1 H:1 N:1 |
| 8577: | C:2 S:1 |
| 8578: | B:2 |
| 8579: | W:1 X:1 |
| 8580: | B:1 S:1 |
| 8581: | E:1 AC:1 |
| 8582: | X:1 AA:1 |
| 8583: | A:1 B:1 G:1 |
| 8584: | T:2 |

TABLE II-continued

| SEQ ID NO. | Spatial Distribution |
|---|---|
| 8585: | B:2 |
| 8586: | B:2 D:1 G:1 J:1 S:2 T:1 |
| 8587: | H:1 R:2 X:1 |
| 8588: | F:2 |
| 8589: | B:3 |
| 8590: | H:1 L:2 |
| 8591: | H:1 AA:1 |
| 8592: | H:1 S:1 |
| 8593: | J:1 V:1 AA:2 |
| 8594: | B:1 W:1 |
| 8595: | B:1 H:1 S:1 AA:1 |
| 8596: | B:1 C:1 G:2 H:1 V:1 |
| 8597: | B:1 C:1 G:2 H:1 V:1 |
| 8598: | K:2 |
| 8599: | Q:3 |
| 8600: | B:2 S:1 T:1 |
| 8601: | H:2 |
| 8602: | T:2 |
| 8603: | O:1 AA:1 |
| 8604: | E:3 |
| 8605: | G:1 H:1 |
| 8606: | K:4 R:3 W:1 Y:1 |
| 8607: | C:1 T:1 |
| 8608: | B:1 C:1 S:1 X:1 |
| 8609: | S:1 AA:1 |
| 8610: | T:2 |
| 8611: | B:1 G:1 |
| 8612: | T:2 |
| 8613: | G:2 |
| 8614: | B:2 G:1 AA:2 |
| 8615: | B:16 |
| 8616: | B:1 F:1 P:1 V:1 |
| 8617: | B:2 |
| 8618: | B:2 |
| 8619: | B:1 H:1 |
| 8620: | J:2 T:1 X:2 AA:1 |
| 8621: | T:2 |
| 8622: | S:2 |
| 8623: | P:1 AC:1 |
| 8624: | P:1 AA:1 |
| 8625: | N:3 |
| 8626: | B:19 G:5 H:1 Y:2 |
| 8627: | B:1 H:1 S:1 AA:1 |
| 8628: | E:1 G:1 W:1 |
| 8629: | B:4 C:2 F:1 H:3 P:1 W:2 Y:3 |
| 8630: | B:1 G:1 AC:1 |
| 8631: | H:1 Y:1 |
| 8632: | O:2 AA:1 |
| 8633: | C:1 AA:1 |
| 8634: | B:2 |
| 8635: | T:1 W:1 |
| 8636: | G:1 H:1 |
| 8637: | T:2 |
| 8638: | G:1 T:1 |
| 8639: | S:1 Z:1 |
| 8640: | I:2 |
| 8641: | B:2 W:1 |
| 8642: | B:1 W:1 |
| 8643: | R:1 Y:1 |
| 8644: | B:1 E:1 |
| 8645: | H:1 P:1 |
| 8646: | Q:2 |
| 8647: | T:2 |
| 8648: | C:1 S:1 |
| 8649: | T:2 |
| 8650: | C:6 K:8 S:15 |
| 8651: | C:1 H:2 K:1 Y:1 Z:1 |
| 8652: | B:1 C:1 G:2 H:1 K:1 S:2 W:1 X:3 AC:1 |
| 8653: | T:3 |
| 8654: | AA:4 |
| 8655: | B:1 H:1 |
| 8656: | B:28 C:45 D:3 E:12 F:4 G:18 H:179 I:4 J:9 K:18 L:2 N:4 O:15 P:36 Q:8 R:5 S:43 T:19 U:4 V:4 W:5 X:4 Y:14 Z:20 AA:125 AC:3 AD:18 |
| 8657: | B:28 C:56 D:4 E:11 F:3 G:20 H:212 I:4 J:8 K:28 L:3 N:3 O:19 P:38 Q:8 R:8 S:47 T:8 V:4 W:7 X:5 Y:19 Z:21 AA:135 AC:3 AD:27 |
| 8658: | B:26 C:41 D:3 E:11 F:3 G:18 H:174 I:4 J:7 K:17 L:2 N:3 O:15 P:37 Q:8 R:5 S:41 T:8 V:4 W:5 X:4 Y:14 Z:20 AA:124 AC:3 AD:18 |
| 8659: | B:2 C:7 E:1 F:1 H:5 J:2 K:1 N:1 S:2 T:11 U:5 AA:2 |
| 8660: | B:2 C:9 E:2 F:1 H:5 J:2 K:1 N:1 S:2 T:11 U:4 AA:2 |
| 8661: | V:132 |
| 8662: | AA:2 |
| 8663: | B:192 S:4 W:125 Y:94 |
| 8664: | B:15 C:4 F:1 G:2 H:2 K:3 Q:1 R:2 S:4 T:1 U:4 W:3 Y:1 AC:4 |
| 8665: | A:2 I:7 N:153 AA:5 |
| 8666: | A:1 I:6 N:149 AA:5 |
| 8667: | A:2 I:8 N:155 AA:5 |
| 8668: | A:2 I:11 N:185 AA:8 |
| 8669: | A:1 I:7 N:151 AA:5 |
| 8670: | B:2 C:6 D:1 F:10 H:5 J:2 K:15 L:7 N:3 O:4 P:24 S:20 T:21 V:2 W:8 X:6 Y:6 Z:7 AA:21 AC:2 AD:4 |
| 8671: | N:202 AA:9 |
| 8672: | B:30 C:11 E:4 F:1 G:12 H:27 I:3 J:3 K:5 N:5 O:7 P:11 Q:4 R:8 S:8 T:13 V:2 W:5 Y:1 Z:4 AA:15 AC:1 |
| 8673: | F:2 H:2 P:1 S:6 T:12 AC:1 |
| 8674: | B:6 E:1 F:2 P:2 T:4 Z:1 |
| 8675: | B:2 C:5 E:6 F:2 G:3 H:1 K:2 O:3 P:3 Q:1 S:2 T:8 U:2 X:2 Y:2 Z:1 AA:8 AD:3 |
| 8676: | V:1 |
| 8677: | V:1 |
| 8678: | V:1 |
| 8679: | V:1 |
| 8680: | V:1 |
| 8681: | B:1 |
| 8682: | B:1 |
| 8683: | B:1 |
| 8684: | B:1 |
| 8685: | B:1 |
| 8686: | B:1 |
| 8687: | B:1 |
| 8688: | B:1 |
| 8689: | B:1 |
| 8690: | U:1 |
| 8691: | U:1 |
| 8692: | U:1 |
| 8693: | U:1 |
| 8694: | U:1 |
| 8695: | X:1 |
| 8696: | X:1 |
| 8697: | X:1 |
| 8698: | X:1 |
| 8699: | X:1 |
| 8700: | X:1 |
| 8701: | X:1 |
| 8702: | X:1 |
| 8703: | X:1 |
| 8704: | X:1 |
| 8705: | X:1 |
| 8706: | X:1 |
| 8707: | X:1 |
| 8708: | X:1 |
| 8709: | X:1 |
| 8710: | X:1 |
| 8711: | X:1 |
| 8712: | X:1 |
| 8713: | X:1 |

TABLE II-continued

| SEQ ID NO. | Spatial Distribution |
|---|---|
| 8714: | X:1 |
| 8715: | X:1 |
| 8716: | X:1 |
| 8717: | X:1 |
| 8718: | X:1 |
| 8719: | L:1 |
| 8720: | L:1 |
| 8721: | L:1 |
| 8722: | L:1 |
| 8723: | L:1 |
| 8724: | L:1 |
| 8725: | L:1 |
| 8726: | L:1 |
| 8727: | L:1 |
| 8728: | L:1 |
| 8729: | L:1 |
| 8730: | L:1 |
| 8731: | L:1 |
| 8732: | N:1 |
| 8733: | N:1 |
| 8734: | N:1 |
| 8735: | N:1 |
| 8736: | N:1 |
| 8737: | N:1 |
| 8738: | N:1 |
| 8739: | N:1 |
| 8740: | N:1 |
| 8741: | E:1 |
| 8742: | E:1 |
| 8743: | E:1 |
| 8744: | E:1 |
| 8745: | E:1 |
| 8746: | E:1 |
| 8747: | E:1 |
| 8748: | E:1 |
| 8749: | E:1 |
| 8750: | E:1 |
| 8751: | E:1 |
| 8752: | E:1 |
| 8753: | E:1 |
| 8754: | E:1 |
| 8755: | E:1 |
| 8756: | E:1 |
| 8757: | E:1 |
| 8758: | Q:1 |
| 8759: | Q:1 |
| 8760: | Q:1 |
| 8761: | Q:1 |
| 8762: | Q:1 |
| 8763: | Q:1 |
| 8764: | J:1 |
| 8765: | J:1 |
| 8766: | J:1 |
| 8767: | J:1 |
| 8768: | J:1 |
| 8769: | J:1 |
| 8770: | J:1 |
| 8771: | J:1 |
| 8772: | J:1 |
| 8773: | J:1 |
| 8774: | J:1 |
| 8775: | J:1 |
| 8776: | J:1 |
| 8777: | J:1 |
| 8778: | J:1 |
| 8779: | J:1 |
| 8780: | J:1 |
| 8781: | J:1 |
| 8782: | J:1 |
| 8783: | J:1 |
| 8784: | J:1 |
| 8785: | J:1 |
| 8786: | J:1 |
| 8787: | J:1 |
| 8788: | T:1 |
| 8789: | T:1 |
| 8790: | T:1 |
| 8791: | T:1 |
| 8792: | T:1 |
| 8793: | T:1 |
| 8794: | T:1 |
| 8795: | T:1 |
| 8796: | T:1 |
| 8797: | T:1 |
| 8798: | T:1 |
| 8799: | T:1 |
| 8800: | T:1 |
| 8801: | T:1 |
| 8802: | T:1 |
| 8803: | T:1 |
| 8804: | T:1 |
| 8805: | T:1 |
| 8806: | T:1 |
| 8807: | T:1 |
| 8808: | T:1 |
| 8809: | T:1 |
| 8810: | T:1 |
| 8811: | T:1 |
| 8812: | T:1 |
| 8813: | T:1 |
| 8814: | T:1 |
| 8815: | T:1 |
| 8816: | T:1 |
| 8817: | T:1 |
| 8818: | T:1 |
| 8819: | T:1 |
| 8820: | T:1 |
| 8821: | T:1 |
| 8822: | T:1 |
| 8823: | T:1 |
| 8824: | T:1 |
| 8825: | T:1 |
| 8826: | T:1 |
| 8827: | T:1 |
| 8828: | T:1 |
| 8829: | T:1 |
| 8830: | T:1 |
| 8831: | T:1 |
| 8832: | T:1 |
| 8833: | T:1 |
| 8834: | T:1 |
| 8835: | T:1 |
| 8836: | T:1 |
| 8837: | T:1 |
| 8838: | T:1 |
| 8839: | T:1 |
| 8840: | T:1 |
| 8841: | T:1 |
| 8842: | T:1 |
| 8843: | T:1 |
| 8844: | T:1 |
| 8845: | T:1 |
| 8846: | T:1 |
| 8847: | T:1 |
| 8848: | T:1 |
| 8849: | T:1 |
| 8850: | T:1 |
| 8851: | T:1 |
| 8852: | T:1 |
| 8853: | T:1 |
| 8854: | T:1 |
| 8855: | T:1 |
| 8856: | T:1 |
| 8857: | T:1 |
| 8858: | T:1 |
| 8859: | T:1 |
| 8860: | T:1 |
| 8861: | T:1 |
| 8862: | T:1 |
| 8863: | T:1 |
| 8864: | T:1 |
| 8865: | T:1 |
| 8866: | T:1 |
| 8867: | T:1 |

TABLE II-continued

| SEQ ID NO. | Spatial Distribution |
|---|---|
| 8868: | T:1 |
| 8869: | T:1 |
| 8870: | T:1 |
| 8871: | T:1 |
| 8872: | T:1 |
| 8873: | T:1 |
| 8874: | T:1 |
| 8875: | T:1 |
| 8876: | T:1 |
| 8877: | T:1 |
| 8878: | T:1 |
| 8879: | T:1 |
| 8880: | T:1 |
| 8881: | T:1 |
| 8882: | T:1 |
| 8883: | T:1 |
| 8884: | T:1 |
| 8885: | T:1 |
| 8886: | T:1 |
| 8887: | T:1 |
| 8888: | T:1 |
| 8889: | T:1 |
| 8890: | T:1 |
| 8891: | T:1 |
| 8892: | T:1 |
| 8893: | T:1 |
| 8894: | T:1 |
| 8895: | T:1 |
| 8896: | T:1 |
| 8897: | T:1 |
| 8898: | T:1 |
| 8899: | T:1 |
| 8900: | T:1 |
| 8901: | T:1 |
| 8902: | T:1 |
| 8903: | T:1 |
| 8904: | T:1 |
| 8905: | T:1 |
| 8906: | T:1 |
| 8907: | T:1 |
| 8908: | T:1 |
| 8909: | T:1 |
| 8910: | T:1 |
| 8911: | T:1 |
| 8912: | T:1 |
| 8913: | T:1 |
| 8914: | T:1 |
| 8915: | T:1 |
| 8916: | T:1 |
| 8917: | T:1 |
| 8918: | T:1 |
| 8919: | T:1 |
| 8920: | T:1 |
| 8921: | T:1 |
| 8922: | T:1 |
| 8923: | T:1 |
| 8924: | T:1 |
| 8925: | T:1 |
| 8926: | T:1 |
| 8927: | T:1 |
| 8928: | T:1 |
| 8929: | T:1 |
| 8930: | T:1 |
| 8931: | T:1 |
| 8932: | T:1 |
| 8933: | T:1 |
| 8934: | T:1 |
| 8935: | T:1 |
| 8936: | T:1 |
| 8937: | T:1 |
| 8938: | T:1 |
| 8939: | T:1 |
| 8940: | T:1 |
| 8941: | T:1 |
| 8942: | T:1 |
| 8943: | T:1 |
| 8944: | T:1 |
| 8945: | T:1 |
| 8946: | T:1 |
| 8947: | T:1 |
| 8948: | T:1 |
| 8949: | T:1 |
| 8950: | T:1 |
| 8951: | T:1 |
| 8952: | T:1 |
| 8953: | T:1 |
| 8954: | T:1 |
| 8955: | T:1 |
| 8956: | T:1 |
| 8957: | T:1 |
| 8958: | T:1 |
| 8959: | T:1 |
| 8960: | T:1 |
| 8961: | T:1 |
| 8962: | T:1 |
| 8963: | T:1 |
| 8964: | T:1 |
| 8965: | T:1 |
| 8966: | T:1 |
| 8967: | T:1 |
| 8968: | T:1 |
| 8969: | T:1 |
| 8970: | T:1 |
| 8971: | T:1 |
| 8972: | T:1 |
| 8973: | T:1 |
| 8974: | T:1 |
| 8975: | T:1 |
| 8976: | T:1 |
| 8977: | T:1 |
| 8978: | T:1 |
| 8979: | T:1 |
| 8980: | T:1 |
| 8981: | T:1 |
| 8982: | T:1 |
| 8983: | T:1 |
| 8984: | T:1 |
| 8985: | T:1 |
| 8986: | T:1 |
| 8987: | T:1 |
| 8988: | T:1 |
| 8989: | T:1 |
| 8990: | T:1 |
| 8991: | T:1 |
| 8992: | T:1 |
| 8993: | T:1 |
| 8994: | T:1 |
| 8995: | T:1 |
| 8996: | T:1 |
| 8997: | T:1 |
| 8998: | T:1 |
| 8999: | T:1 |
| 9001: | T:1 |
| 9002: | T:1 |
| 9003: | T:1 |
| 9004: | T:1 |
| 9005: | T:1 |
| 9006: | T:1 |
| 9007: | T:1 |
| 9008: | T:1 |
| 9009: | T:1 |
| 9010: | R:1 |
| 9011: | R:1 |
| 9012: | R:1 |
| 9013: | R:1 |
| 9014: | R:1 |
| 9015: | R:1 |
| 9016: | R:1 |
| 9017: | R:1 |
| 9018: | R:1 |
| 9019: | R:1 |
| 9020: | R:1 |
| 9021: | R:1 |
| 9022: | R:1 |

TABLE II-continued

| SEQ ID NO. | Spatial Distribution |
|---|---|
| 9023: | R:1 |
| 9024: | R:1 |
| 9025: | R:1 |
| 9026: | R:1 |
| 9027: | R:1 |
| 9028: | R:1 |
| 9029: | F:1 |
| 9030: | F:1 |
| 9031: | F:1 |
| 9032: | F:1 |
| 9033: | F:1 |
| 9034: | F:1 |
| 9035: | F:1 |
| 9036: | F:1 |
| 9037: | F:1 |
| 9038: | F:1 |
| 9039: | F:1 |
| 9040: | F:1 |
| 9041: | F:1 |
| 9042: | F:1 |
| 9043: | F:1 |
| 9044: | F:1 |
| 9045: | F:1 |
| 9046: | F:1 |
| 9047: | F:1 |
| 9048: | F:1 |
| 9049: | F:1 |
| 9050: | F:1 |
| 9051: | F:1 |
| 9052: | F:1 |
| 9053: | F:1 |
| 9054: | F:1 |
| 9055: | F:1 |
| 9056: | F:1 |
| 9057: | F:1 |
| 9058: | F:1 |
| 9059: | F:1 |
| 9060: | F:1 |
| 9061: | F:1 |
| 9062: | F:1 |
| 9063: | F:1 |
| 9064: | F:1 |
| 9065: | F:1 |
| 9066: | F:1 |
| 9067: | F:1 |
| 9068: | F:1 |
| 9069: | F:1 |
| 9070: | F:1 |
| 9071: | F:1 |
| 9072: | O:1 |
| 9073: | O:1 |
| 9074: | O:1 |
| 9075: | O:1 |
| 9076: | O:1 |
| 9077: | O:1 |
| 9078: | O:1 |
| 9079: | O:1 |
| 9080: | O:1 |
| 9081: | O:1 |
| 9082: | O:1 |
| 9083: | O:1 |
| 9084: | O:1 |
| 9085: | O:1 |
| 9086: | O:1 |
| 9087: | O:1 |
| 9088: | O:1 |
| 9089: | O:1 |
| 9090: | O:1 |
| 9091: | O:1 |
| 9092: | O:1 |
| 9093: | O:1 |
| 9094: | O:1 |
| 9095: | O:1 |
| 9096: | O:1 |
| 9097: | O:1 |
| 9098: | O:1 |
| 9099: | O:1 |
| 9100: | O:1 |
| 9101: | O:1 |
| 9102: | O:1 |
| 9103: | O:1 |
| 9104: | O:1 |
| 9105: | O:1 |
| 9106: | O:1 |
| 9107: | O:1 |
| 9108: | O:1 |
| 9109: | O:1 |
| 9110: | O:1 |
| 9111: | O:1 |
| 9112: | O:1 |
| 9113: | O:1 |
| 9114: | O:1 |
| 9115: | O:1 |
| 9116: | O:1 |
| 9117: | V:1 |
| 9118: | V:1 |
| 9119: | V:1 |
| 9120: | V:1 |
| 9121: | V:1 |
| 9122: | B:1 |
| 9123: | B:1 |
| 9124: | B:1 |
| 9125: | B:1 |
| 9126: | B:1 |
| 9127: | B:1 |
| 9128: | B:1 |
| 9129: | B:1 |
| 9130: | B:1 |
| 9131: | B:1 |
| 9132: | B:1 |
| 9133: | B:1 |
| 9134: | B:1 |
| 9135: | B:1 |
| 9136: | B:1 |
| 9137: | B:1 |
| 9138: | B:1 |
| 9139: | B:1 |
| 9140: | B:1 |
| 9141: | B:1 |
| 9142: | B:1 |
| 9143: | B:1 |
| 9144: | B:1 |
| 9145: | B:1 |
| 9146: | B:1 |
| 9147: | B:1 |
| 9148: | B:1 |
| 9149: | B:1 |
| 9150: | B:1 |
| 9151: | B:1 |
| 9152: | B:1 |
| 9153: | B:1 |
| 9154: | B:1 |
| 9155: | B:1 |
| 9156: | B:1 |
| 9157: | B:1 |
| 9158: | B:1 |
| 9159: | B:1 |
| 9160: | B:1 |
| 9161: | B:1 |
| 9162: | B:1 |
| 9163: | B:1 |
| 9164: | B:1 |
| 9165: | B:1 |
| 9166: | B:1 |
| 9167: | B:1 |
| 9168: | B:1 |
| 9169: | B:1 |
| 9170: | B:1 |
| 9171: | B:1 |
| 9172: | B:1 |
| 9173: | B:1 |
| 9174: | B:1 |
| 9175: | B:1 |
| 9176: | B:1 |

TABLE II-continued

| SEQ ID NO. | Spatial Distribution |
|---|---|
| 9177: | B:1 |
| 9178: | B:1 |
| 9179: | B:1 |
| 9180: | B:1 |
| 9181: | B:1 |
| 9182: | B:1 |
| 9183: | B:1 |
| 9184: | B:1 |
| 9185: | B:1 |
| 9186: | B:1 |
| 9187: | B:1 |
| 9188: | B:1 |
| 9189: | B:1 |
| 9190: | B:1 |
| 9191: | B:1 |
| 9192: | B:1 |
| 9193: | B:1 |
| 9194: | B:1 |
| 9195: | B:1 |
| 9196: | B:1 |
| 9197: | B:1 |
| 9198: | B:1 |
| 9199: | B:1 |
| 9200: | B:1 |
| 9201: | B:1 |
| 9202: | B:1 |
| 9203: | B:1 |
| 9204: | B:1 |
| 9205: | B:1 |
| 9206: | B:1 |
| 9207: | B:1 |
| 9208: | B:1 |
| 9209: | B:1 |
| 9210: | B:1 |
| 9211: | B:1 |
| 9212: | B:1 |
| 9213: | B:1 |
| 9214: | B:1 |
| 9215: | B:1 |
| 9216: | B:1 |
| 9217: | B:1 |
| 9218: | B:1 |
| 9219: | B:1 |
| 9220: | B:1 |
| 9221: | B:1 |
| 9222: | B:1 |
| 9223: | B:1 |
| 9224: | B:1 |
| 9225: | B:1 |
| 9226: | B:1 |
| 9227: | B:1 |
| 9228: | B:1 |
| 9229: | B:1 |
| 9230: | B:1 |
| 9231: | B:1 |
| 9232: | B:1 |
| 9233: | B:1 |
| 9234: | B:1 |
| 9235: | B:1 |
| 9236: | B:1 |
| 9237: | B:1 |
| 9238: | B:1 |
| 9239: | B:1 |
| 9240: | B:1 |
| 9241: | B:1 |
| 9242: | B:1 |
| 9243: | B:1 |
| 9244: | B:1 |
| 9245: | B:1 |
| 9246: | B:1 |
| 9247: | B:1 |
| 9248: | B:1 |
| 9249: | B:1 |
| 9250: | B:1 |
| 9251: | B:1 |
| 9252: | B:1 |
| 9253: | B:1 |
| 9254: | B:1 |
| 9255: | B:1 |
| 9256: | B:1 |
| 9257: | B:1 |
| 9258: | B:1 |
| 9259: | B:1 |
| 9260: | B:1 |
| 9261: | B:1 |
| 9262: | B:1 |
| 9263: | B:1 |
| 9264: | B:1 |
| 9265: | B:1 |
| 9266: | B:1 |
| 9267: | B:1 |
| 9268: | B:1 |
| 9269: | B:1 |
| 9270: | B:1 |
| 9271: | B:1 |
| 9272: | B:1 |
| 9273: | AC:1 |
| 9274: | AC:1 |
| 9275: | AC:1 |
| 9276: | AC:1 |
| 9277: | AC:1 |
| 9278: | AC:1 |
| 9279: | AC:1 |
| 9280: | AC:1 |
| 9281: | AC:1 |
| 9282: | AC:1 |
| 9283: | AC:1 |
| 9284: | AC:1 |
| 9285: | AC:1 |
| 9286: | AC:1 |
| 9287: | AC:1 |
| 9288: | AC:1 |
| 9289: | AC:1 |
| 9290: | AC:1 |
| 9291: | AC:1 |
| 9292: | AC:1 |
| 9293: | AC:1 |
| 9294: | AC:1 |
| 9295: | AC:1 |
| 9296: | AC:1 |
| 9297: | AC:1 |
| 9298: | AC:1 |
| 9299: | AC:1 |
| 9300: | AC:1 |
| 9301: | AC:1 |
| 9302: | AC:1 |
| 9303: | AC:1 |
| 9304: | AC:1 |
| 9305: | AC:1 |
| 9306: | AC:1 |
| 9307: | AC:1 |
| 9308: | AC:1 |
| 9309: | AC:1 |
| 9310: | AC:1 |
| 9311: | AC:1 |
| 9312: | AC:1 |
| 9313: | AC:1 |
| 9314: | O:1 |
| 9315: | O:1 |
| 9316: | O:1 |
| 9317: | O:1 |
| 9318: | O:1 |
| 9319: | O:1 |
| 9320: | O:1 |
| 9321: | O:1 |
| 9322: | O:1 |
| 9323: | O:1 |
| 9324: | O:1 |
| 9325: | U:1 |
| 9326: | U:1 |
| 9327: | U:1 |
| 9328: | Y:1 |
| 9329: | Y:1 |
| 9330: | Y:1 |

TABLE II-continued

| SEQ ID NO. | Spatial Distribution |
|---|---|
| 9331: | Y:1 |
| 9332: | Y:1 |
| 9333: | Y:1 |
| 9334: | Y:1 |
| 9335: | Y:1 |
| 9336: | Y:1 |
| 9337: | Y:1 |
| 9338: | Y:1 |
| 9339: | Y:1 |
| 9340: | Y:1 |
| 9341: | Y:1 |
| 9342: | Y:1 |
| 9343: | Y:1 |
| 9344: | Y:1 |
| 9345: | Y:1 |
| 9346: | Y:1 |
| 9347: | Y:1 |
| 9348: | Y:1 |
| 9349: | Y:1 |
| 9350: | Y:1 |
| 9351: | Y:1 |
| 9352: | Y:1 |
| 9353: | Y:1 |
| 9354: | Y:1 |
| 9355: | Y:1 |
| 9356: | Y:1 |
| 9357: | Y:1 |
| 9358: | Y:1 |
| 9359: | Y:1 |
| 9360: | Y:1 |
| 9361: | Y:1 |
| 9362: | Y:1 |
| 9363: | Y:1 |
| 9364: | Y:1 |
| 9365: | Y:1 |
| 9366: | Y:1 |
| 9367: | Y:1 |
| 9368: | Y:1 |
| 9369: | Y:1 |
| 9370: | Y:1 |
| 9371: | Y:1 |
| 9372: | Y:1 |
| 9373: | Y:1 |
| 9374: | Y:1 |
| 9375: | Y:1 |
| 9376: | Y:1 |
| 9377: | Y:1 |
| 9378: | Y:1 |
| 9379: | Y:1 |
| 9380: | Y:1 |
| 9381: | Y:1 |
| 9382: | Y:1 |
| 9383: | Y:1 |
| 9384: | Y:1 |
| 9385: | Y:1 |
| 9386: | Y:1 |
| 9387: | Y:1 |
| 9388: | Y:1 |
| 9389: | Y:1 |
| 9390: | Y:1 |
| 9391: | Y:1 |
| 9392: | Y:1 |
| 9393: | Y:1 |
| 9394: | Y:1 |
| 9395: | Y:1 |
| 9396: | Y:1 |
| 9397: | Y:1 |
| 9398: | P:1 |
| 9399: | P:1 |
| 9400: | P:1 |
| 9401: | P:1 |
| 9402: | P:1 |
| 9403: | P:1 |
| 9404: | P:1 |
| 9405: | P:1 |
| 9406: | P:1 |
| 9407: | P:1 |
| 9408: | P:1 |
| 9409: | P:1 |
| 9410: | P:1 |
| 9411: | P:1 |
| 9412: | P:1 |
| 9413: | P:1 |
| 9414: | P:1 |
| 9415: | P:1 |
| 9416: | P:1 |
| 9417: | P:1 |
| 9418: | P:1 |
| 9419: | P:1 |
| 9420: | P:1 |
| 9421: | P:1 |
| 9422: | P:1 |
| 9423: | P:1 |
| 9424: | P:1 |
| 9425: | P:1 |
| 9426: | P:1 |
| 9427: | P:1 |
| 9428: | P:1 |
| 9429: | P:1 |
| 9430: | P:1 |
| 9431: | P:1 |
| 9432: | P:1 |
| 9433: | P:1 |
| 9434: | P:1 |
| 9435: | P:1 |
| 9436: | P:1 |
| 9437: | P:1 |
| 9438: | P:1 |
| 9439: | P:1 |
| 9440: | P:1 |
| 9441: | P:1 |
| 9442: | P:1 |
| 9443: | P:1 |
| 9444: | P:1 |
| 9445: | P:1 |
| 9446: | P:1 |
| 9447: | P:1 |
| 9448: | P:1 |
| 9449: | P:1 |
| 9450: | P:1 |
| 9451: | P:1 |
| 9452: | P:1 |
| 9453: | P:1 |
| 9454: | P:1 |
| 9455: | P:1 |
| 9456: | P:1 |
| 9457: | P:1 |
| 9458: | P:1 |
| 9459: | P:1 |
| 9460: | P:1 |
| 9461: | P:1 |
| 9462: | P:1 |
| 9463: | P:1 |
| 9464: | P:1 |
| 9465: | P:1 |
| 9466: | P:1 |
| 9467: | P:1 |
| 9468: | P:1 |
| 9469: | P:1 |
| 9470: | AA:1 |
| 9471: | AA:1 |
| 9472: | AA:1 |
| 9473: | AA:1 |
| 9474: | AA:1 |
| 9475: | AA:1 |
| 9476: | AA:1 |
| 9477: | AA:1 |
| 9478: | AA:1 |
| 9479: | AA:1 |
| 9480: | AA:1 |
| 9481: | AA:1 |
| 9482: | AA:1 |
| 9483: | AA:1 |
| 9484: | AA:1 |

TABLE II-continued

| SEQ ID NO. | Spatial Distribution |
|---|---|
| 9485: | AA:1 |
| 9486: | AA:1 |
| 9487: | AA:1 |
| 9488: | AA:1 |
| 9489: | AA:1 |
| 9490: | AA:1 |
| 9491: | AA:1 |
| 9492: | AA:1 |
| 9493: | AA:1 |
| 9494: | AA:1 |
| 9495: | AA:1 |
| 9496: | AA:1 |
| 9497: | AA:1 |
| 9498: | AA:1 |
| 9499: | AA:1 |
| 9500: | AA:1 |
| 9501: | AA:1 |
| 9502: | AA:1 |
| 9503: | AA:1 |
| 9504: | AA:1 |
| 9505: | AA:1 |
| 9506: | AA:1 |
| 9507: | AA:1 |
| 9508: | AA:1 |
| 9509: | AA:1 |
| 9510: | AA:1 |
| 9511: | AA:1 |
| 9512: | AA:1 |
| 9513: | AA:1 |
| 9514: | AA:1 |
| 9515: | AA:1 |
| 9516: | AA:1 |
| 9517: | AA:1 |
| 9518: | AA:1 |
| 9519: | AA:1 |
| 9520: | AA:1 |
| 9521: | AA:1 |
| 9522: | AA:1 |
| 9523: | AA:1 |
| 9524: | AA:1 |
| 9525: | AA:1 |
| 9526: | AA:1 |
| 9527: | AA:1 |
| 9528: | AA:1 |
| 9529: | AA:1 |
| 9530: | AA:1 |
| 9531: | AA:1 |
| 9532: | AA:1 |
| 9533: | AA:1 |
| 9534: | AA:1 |
| 9535: | AA:1 |
| 9536: | AA:1 |
| 9537: | AA:1 |
| 9538: | AA:1 |
| 9539: | AA:1 |
| 9540: | AA:1 |
| 9541: | AA:1 |
| 9542: | AA:1 |
| 9543: | AA:1 |
| 9544: | AA:1 |
| 9545: | AA:1 |
| 9546: | AA:1 |
| 9547: | AA:1 |
| 9548: | AA:1 |
| 9549: | AA:1 |
| 9550: | AA:1 |
| 9551: | AA:1 |
| 9552: | AA:1 |
| 9553: | AA:1 |
| 9554: | AA:1 |
| 9555: | AA:1 |
| 9556: | AA:1 |
| 9557: | AA:1 |
| 9558: | AA:1 |
| 9559: | AA:1 |
| 9560: | AA:1 |
| 9561: | AA:1 |
| 9562: | AA:1 |
| 9563: | AA:1 |
| 9564: | AA:1 |
| 9565: | AA:1 |
| 9566: | AA:1 |
| 9567: | AA:1 |
| 9568: | AA:1 |
| 9569: | AA:1 |
| 9570: | AA:1 |
| 9571: | AA:1 |
| 9572: | AA:1 |
| 9573: | AA:1 |
| 9574: | AA:1 |
| 9575: | AA:1 |
| 9576: | AA:1 |
| 9577: | AA:1 |
| 9578: | AA:1 |
| 9579: | AA:1 |
| 9580: | AA:1 |
| 9581: | AA:1 |
| 9582: | AA:1 |
| 9583: | AA:1 |
| 9584: | AA:1 |
| 9585: | AA:1 |
| 9586: | AA:1 |
| 9587: | AA:1 |
| 9588: | AA:1 |
| 9589: | AA:1 |
| 9590: | AA:1 |
| 9591: | N:1 |
| 9592: | N:1 |
| 9593: | N:1 |
| 9594: | N:1 |
| 9595: | N:1 |
| 9596: | X:1 |
| 9597: | X:1 |
| 9598: | X:1 |
| 9599: | X:1 |
| 9600: | X:1 |
| 9601: | X:1 |
| 9602: | X:1 |
| 9603: | X:1 |
| 9604: | D:1 |
| 9605: | D:1 |
| 9606: | D:1 |
| 9607: | D:1 |
| 9608: | D:1 |
| 9609: | D:1 |
| 9610: | D:1 |
| 9611: | D:1 |
| 9612: | D:1 |
| 9613: | D:1 |
| 9614: | D:1 |
| 9615: | D:1 |
| 9616: | D:1 |
| 9617: | D:1 |
| 9618: | D:1 |
| 9619: | D:1 |
| 9620: | D:1 |
| 9621: | D:1 |
| 9622: | D:1 |
| 9623: | D:1 |
| 9624: | D:1 |
| 9625: | D:1 |
| 9626: | D:1 |
| 9627: | D:1 |
| 9628: | D:1 |
| 9629: | D:1 |
| 9630: | D:1 |
| 9631: | D:1 |
| 9632: | D:1 |
| 9633: | D:1 |
| 9634: | D:1 |
| 9635: | D:1 |
| 9636: | D:1 |
| 9637: | D:1 |
| 9638: | G:1 |

TABLE II-continued

| SEQ ID NO. | Spatial Distribution |
|---|---|
| 9639: | G:1 |
| 9640: | G:1 |
| 9641: | G:1 |
| 9642: | G:1 |
| 9643: | G:1 |
| 9644: | G:1 |
| 9645; | G:1 |
| 9646: | G:1 |
| 9647: | G:1 |
| 9648: | G:1 |
| 9649: | G:1 |
| 9650: | G:1 |
| 9651: | G:1 |
| 9652: | G:1 |
| 9653: | G:1 |
| 9654: | G:1 |
| 9655: | G:1 |
| 9656: | G:1 |
| 9657: | G:1 |
| 9658: | G:1 |
| 9659: | G:1 |
| 9660: | G:1 |
| 9661: | G:1 |
| 9662: | G:1 |
| 9663: | G:1 |
| 9664: | G:1 |
| 9665: | G:1 |
| 9666: | G:1 |
| 9667: | G:1 |
| 9668: | G:1 |
| 9669: | G:1 |
| 9670: | G:1 |
| 9671: | G:1 |
| 9672: | G:1 |
| 9673: | G:1 |
| 9674: | G:1 |
| 9675: | G:1 |
| 9676: | G:1 |
| 9677: | G:1 |
| 9678: | G:1 |
| 9679: | G:1 |
| 9680: | G:1 |
| 9681: | G:1 |
| 9682: | G:1 |
| 9683: | G:1 |
| 9684: | G:1 |
| 9685: | G:1 |
| 9686: | G:1 |
| 9687: | G:1 |
| 9688: | G:1 |
| 9689: | G:1 |
| 9690: | G:1 |
| 9691: | G:1 |
| 9692: | G:1 |
| 9693: | G:1 |
| 9694: | G:1 |
| 9695: | G:1 |
| 9696: | G:1 |
| 9697: | G:1 |
| 9698: | G:1 |
| 9699: | G:1 |
| 9700: | G:1 |
| 9701: | G:1 |
| 9702: | G:1 |
| 9703: | G:1 |
| 9704: | G:1 |
| 9705: | G:1 |
| 9706: | G:1 |
| 9707: | G:1 |
| 9708: | G:1 |
| 9709: | G:1 |
| 9710: | G:1 |
| 9711: | G:1 |
| 9712: | G:1 |
| 9713: | G:1 |
| 9714: | G:1 |
| 9715: | G:1 |
| 9716: | G:1 |
| 9717: | H:1 |
| 9718: | H:1 |
| 9719: | H:1 |
| 9720: | H:1 |
| 9721: | H:1 |
| 9722: | H:1 |
| 9723: | H:1 |
| 9724: | H:1 |
| 9725: | H:1 |
| 9726: | H:1 |
| 9727: | H:1 |
| 9728: | H:1 |
| 9729: | H:1 |
| 9730: | H:1. |
| 9731: | H:1 |
| 9732: | H:1 |
| 9733: | H:1 |
| 9734: | H:1 |
| 9735: | H:1 |
| 9736: | H:1 |
| 9737: | H:1 |
| 9738: | H:1 |
| 9739: | H:1 |
| 9740: | H:1 |
| 9741: | H:1 |
| 9742: | H:1 |
| 9743: | H:1 |
| 9744: | H:1 |
| 9745: | H:1 |
| 9746: | H:1 |
| 9747: | H:1 |
| 9748: | H:1 |
| 9749: | H:1 |
| 9750: | H:1 |
| 9751: | H:1 |
| 9752: | H:1 |
| 9753: | H:1 |
| 9754: | H:1 |
| 9755: | H:1 |
| 9756: | H:1 |
| 9757: | H:1 |
| 9758: | H:1 |
| 9759: | H:1 |
| 9760: | H:1 |
| 9761: | H:1 |
| 9762: | H:1 |
| 9763: | H:1 |
| 9764: | H:1 |
| 9765: | H:1 |
| 9766: | H:1 |
| 9767: | H:1 |
| 9768: | H:1 |
| 9769: | H:1 |
| 9770: | H:1 |
| 9771: | H:1 |
| 9772: | H:1 |
| 9773: | H:1 |
| 9774: | H:1 |
| 9775: | H:1 |
| 9776: | H:1 |
| 9777: | H:1 |
| 9778: | H:1 |
| 9779: | H:1 |
| 9780: | H:1 |
| 9781: | H:1 |
| 9782: | H:1 |
| 9783: | H:1 |
| 9784: | H:1 |
| 9785: | H:1 |
| 9786: | H:1 |
| 9787: | H:1 |
| 9788: | H:1 |
| 9789: | H:1 |
| 9790: | H:1 |
| 9791: | H:1 |
| 9792: | H:1 |

TABLE II-continued

| SEQ ID NO. | Spatial Distribution |
|---|---|
| 9793: | H:1 |
| 9794: | H:1 |
| 9795: | H:1 |
| 9796: | H:1 |
| 9797: | H:1 |
| 9798: | H:1 |
| 9799: | H:1 |
| 9800: | H:1 |
| 9801: | H:1 |
| 9802: | H:1 |
| 9803: | H:1 |
| 9804: | H:1 |
| 9805: | H:1 |
| 9806: | H:1 |
| 9807: | H:1 |
| 9808: | H:1 |
| 9809: | H:1 |
| 9810: | H:1 |
| 9811: | H:1 |
| 9812: | H:1 |
| 9813: | H:1 |
| 9814: | H:1 |
| 9815: | H:1 |
| 9816: | H:1 |
| 9817: | H:1 |
| 9818: | H:1 |
| 9819: | H:1 |
| 9820: | H:1 |
| 9821: | H:1 |
| 9822: | H:1 |
| 9823: | H:1 |
| 9824: | H:1 |
| 9825: | H:1 |
| 9826: | H:1 |
| 9827: | H:1 |
| 9828: | H:1 |
| 9829: | H:1 |
| 9830: | H:1 |
| 9831: | H:1 |
| 9832: | H:1 |
| 9833: | H:1 |
| 9834: | H:1 |
| 9835: | H:1 |
| 9836: | H:1 |
| 9837: | H:1 |
| 9838: | H:1 |
| 9839: | H:1 |
| 9840: | H:1 |
| 9841: | H:1 |
| 9842: | H:1 |
| 9843: | H:1 |
| 9844: | H:1 |
| 9845: | H:1 |
| 9846: | H:1 |
| 9847: | H:1 |
| 9848: | H:1 |
| 9849: | H:1 |
| 9850: | H:1 |
| 9851: | H:1 |
| 9852: | H:1 |
| 9853: | H:1 |
| 9854: | H:1 |
| 9855: | H:1 |
| 9856: | H:1 |
| 9857: | H:1 |
| 9858: | H:1 |
| 9859: | H:1 |
| 9860: | H:1 |
| 9861: | H:1 |
| 9862: | H:1 |
| 9863: | H:1 |
| 9864: | H:1 |
| 9865: | H:1 |
| 9866: | H:1 |
| 9867: | H:1 |
| 9868: | H:1 |
| 9869: | H:1 |
| 9870: | H:1 |
| 9871: | H:1 |
| 9872: | H:1 |
| 9373: | H:1 |
| 9874: | H:1 |
| 9875: | H:1 |
| 9876: | H:1 |
| 9877: | H:1 |
| 9878: | H:1 |
| 9879: | H:1 |
| 9880: | H:1 |
| 9881: | H:1 |
| 9882: | H:1 |
| 9883: | H:1 |
| 9884: | H:1 |
| 9885: | H:1 |
| 9886: | H:1 |
| 9887: | H:1 |
| 9888: | H:1 |
| 9889: | H:1 |
| 9890: | H:1 |
| 9891: | H:1 |
| 9892: | H:1 |
| 9893: | H:1 |
| 9894: | H:1 |
| 9895: | H:1 |
| 9896: | H:1 |
| 9897: | H:1 |
| 9898: | H:1 |
| 9899: | H:1 |
| 9900: | H:1 |
| 9901: | H:1 |
| 9902: | H:1 |
| 9903: | H:1 |
| 9904: | H:1 |
| 9905: | H:1 |
| 9906: | H:1 |
| 9907: | H:1 |
| 9908: | H:1 |
| 9909: | H:1 |
| 9910: | H:1 |
| 9911: | H:1 |
| 9912: | H:1 |
| 9913: | H:1 |
| 9914: | H:1 |
| 9915: | H:1 |
| 9916: | H:1 |
| 9917: | H:1 |
| 9918: | H:1 |
| 9919: | H:1 |
| 9920: | H:1 |
| 9921: | H:1 |
| 9922: | H:1 |
| 9923: | H:1 |
| 9924: | H:1 |
| 9925: | H:1 |
| 9926: | H:1 |
| 9927: | H:1 |
| 9928: | H:1 |
| 9929: | H:1 |
| 9930: | H:1 |
| 9931: | H:1 |
| 9932: | H:1 |
| 9933: | H:1 |
| 9934: | H:1 |
| 9935: | H:1 |
| 9936: | H:1 |
| 9937: | H:1 |
| 9938: | H:1 |
| 9939: | H:1 |
| 9940: | H:1 |
| 9941: | H:1 |
| 9942: | H:1 |
| 9943: | H:1 |
| 9944: | O:1 |
| 9945: | O:1 |
| 9946: | O:1 |

TABLE II-continued

| SEQ ID NO. | Spatial Distribution |
|---|---|
| 9947: | O:1 |
| 9948: | O:1 |
| 9949: | O:1 |
| 9950: | O:1 |
| 9951: | O:1 |
| 9952: | O:1 |
| 9953: | O:1 |
| 9954: | O:1 |
| 9955: | S:1 |
| 9956: | S:1 |
| 9957: | S:1 |
| 9958: | S:1 |
| 9959: | S:1 |
| 9960: | S:1 |
| 9961: | S:1 |
| 9962: | S:1 |
| 9963: | S:1 |
| 9964: | S:1 |
| 9965: | S:1 |
| 9966: | S:1 |
| 9967: | S:1 |
| 9968: | S:1 |
| 9969: | S:1 |
| 9970: | S:1 |
| 9971: | S:1 |
| 9972: | S:1 |
| 9973: | Z:1 |
| 9974: | Z:1 |
| 9975: | Z:1 |
| 9976: | Z:1 |
| 9977: | I:1 |
| 9978: | I:1 |
| 9979: | I:1 |
| 9980: | I:1 |
| 9981: | J:1 |
| 9982: | J:1 |
| 9983: | J:1 |
| 9984: | J:1 |
| 9985: | J:1 |
| 9986: | J:1 |
| 9987: | J:1 |
| 9988: | A:1 |
| 9989: | A:1 |
| 9990: | A:1 |
| 9991: | A:1 |
| 9992: | A:1 |
| 9993: | A:1 |
| 9994: | A:1 |
| 9995: | AD:1 |
| 9996: | AD:1 |
| 9997: | AD:1 |
| 9998: | AD:1 |
| 9999: | AD:1 |
| 10000: | AD:1 |
| 10001: | AD:1 |
| 10002: | AD:1 |
| 10003: | AD:1 |
| 10004: | AD:1 |
| 10005: | AD:1 |
| 10006: | AD:1 |
| 10007: | AD:1 |
| 10008: | AD:1 |
| 10009: | AD:1 |
| 10010: | AD:1 |
| 10011: | AD:1 |
| 10012: | AD:1 |
| 10013: | AD:1 |
| 10014: | AD:1 |
| 10015: | AD:1 |
| 10016: | AD:1 |
| 10017: | AD:1 |
| 10018: | AD:1 |
| 10019: | AD:1 |
| 10020: | AD:1 |
| 10021: | AD:1 |
| 10022: | AD:1 |
| 10023: | AD:1 |
| 10024: | AD:1 |
| 10025: | AD:1 |
| 10026: | AD:1 |
| 10027: | AD:1 |
| 10028: | AD:1 |
| 10029: | AD:1 |
| 10030: | AD:1 |
| 10031: | AD:1 |
| 10032: | AD:1 |
| 10033: | AD:1 |
| 10034: | AD:1 |
| 10035: | C:1 |
| 10036: | C:1 |
| 10037: | C:1 |
| 10038: | C:1 |
| 10039: | C:1 |
| 10040: | C:1 |
| 10041: | C:1 |
| 10042: | C:1 |
| 10043: | C:1 |
| 10044: | C:1 |
| 10045: | C:1 |
| 10046: | C:1 |
| 10047: | C:1 |
| 10048: | C:1 |
| 10049: | C:1 |
| 10050: | C:1 |
| 10051: | C:1 |
| 10052: | C:1 |
| 10053: | C:1 |
| 10054: | C:1 |
| 10055: | C:1 |
| 10056: | C:1 |
| 10057: | C:1 |
| 10058: | C:1 |
| 10059: | C:1 |
| 10060: | C:1 |
| 10061: | C:1 |
| 10062: | C:1 |
| 10063: | C:1 |
| 10064: | C:1 |
| 10065: | C:1 |
| 10066: | C:1 |
| 10067: | C:1 |
| 10068: | C:1 |
| 10069: | C:1 |
| 10070: | C:1 |
| 10071: | C:1 |
| 10072: | C:1 |
| 10073: | C:1 |
| 10074: | C:1 |
| 10075: | C:1 |
| 10076: | K:1 |
| 10077: | K:1 |
| 10078: | K:1 |
| 10079: | K:1 |
| 10080: | K:1 |
| 10081: | K:1 |
| 10082: | K:1 |
| 10083: | K:1 |
| 10084: | K:1 |
| 10085: | K:1 |
| 10086: | K:1 |
| 10087: | K:1 |
| 10088: | K:1 |
| 10089: | K:1 |
| 10090: | K:1 |
| 10091: | K:1 |
| 10092: | K:1 |
| 10093: | S:1 |
| 10094: | S:1 |
| 10095: | S:1 |
| 10096: | S:1 |
| 10097: | S:1 |
| 10098: | S:1 |
| 10099: | S:1 |
| 10100: | S:1 |

TABLE II-continued

| SEQ ID NO. | Spatial Distribution |
|---|---|
| 10101: | S:1 |
| 10102: | S:1 |
| 10103: | S:1 |
| 10104: | S:1 |
| 10105: | S:1 |
| 10106: | S:1 |
| 10107: | S:1 |
| 10108: | S:1 |
| 10109: | S:1 |
| 10110: | S:1 |
| 10111: | S:1 |
| 10112: | S:1 |
| 10113: | S:1 |
| 10114: | S:1 |
| 10115: | S:1 |
| 10116: | S:1 |
| 10117: | S:1 |
| 10118: | S:1 |
| 10119: | S:1 |
| 10120: | S:1 |
| 10121: | S:1 |
| 10122: | S:1 |
| 10123: | S:1 |
| 10124: | S:1 |
| 10125: | S:1 |
| 10126: | S:1 |
| 10127: | S:1 |
| 10128: | S:1 |
| 10129: | S:1 |
| 10130: | S:1 |
| 10131: | S:1 |
| 10132: | S:1 |
| 10133: | S:1 |
| 10134: | S:1 |
| 10135: | S:1 |
| 10136: | S:1 |
| 10137: | S:1 |
| 10138: | S:1 |
| 10139: | S:1 |
| 10140: | S:1 |
| 10141: | S:1 |
| 10142: | S:1 |
| 10143: | S:1 |
| 10144: | S:1 |
| 10145: | S:1 |
| 10146: | S:1 |
| 10147: | S:1 |
| 10148: | S:1 |
| 10149: | S:1 |
| 10150: | S:1 |
| 10151: | S:1 |
| 10152: | S:1 |
| 10153: | AB:1 |
| 10154: | AB:1 |
| 10155: | W:1 |
| 10156: | W:1 |
| 10157: | W:1 |
| 10158: | W:1 |
| 10159: | W:1 |
| 10160: | W:1 |
| 10161: | W:1 |
| 10162: | W:1 |
| 10163: | W:1 |
| 10164: | W:1 |
| 10165: | W:1 |
| 10166: | W:1 |
| 10167: | W:1 |
| 10168: | W:1 |
| 10169: | W:1 |
| 10170: | W:1 |
| 10171: | W:1 |
| 10172: | W:1 |
| 10173: | W:1 |
| 10174: | W:1 |
| 10175: | W:1 |
| 10176: | W:1 |
| 10177: | W:1 |
| 10178: | W:1 |
| 10179: | W:1 |
| 10180: | W:1 |
| 10181: | W:1 |
| 10182: | W:1 |
| 10183: | W:1 |
| 10184: | W:1 |
| 10185: | W:1 |
| 10186: | W:1 |
| 10187: | W:1 |
| 10188: | W:1 |
| 10189: | W:1 |
| 10190: | W:1 |
| 10191: | W:1 |
| 10192: | W:1 |
| 10193: | W:1 |
| 10194: | W:1 |
| 10195: | W:1 |
| 10196: | W:1 |
| 10197: | W:1 |
| 10198: | W:1 |
| 10199: | W:1 |
| 10200: | W:1 |
| 10201: | W:1 |
| 10202: | W:1 |
| 10203: | W:1 |
| 10204: | W:1 |
| 10205: | W:1 |
| 10206: | W:1 |
| 10207: | W:1 |
| 10208: | N:1 |
| 10209: | N:1 |
| 10210: | N:1 |
| 10211: | N:1 |
| 10213: | N:1 |
| 10212: | N:1 |
| 10214: | N:1 |
| 10215: | N:1 |
| 10216: | N:1 |
| 10217: | N:1 |
| 10218: | N:1 |
| 10219: | B:1 E:1 G:3 Q:1 S:2 |
| 10220: | T:4 |
| 10221: | V:2 |
| 10222: | O:2 |
| 10223: | H:3 O:1 S:1 V:1 |
| 10224: | H:2 O:1 S:1 V:1 |
| 10225: | B:6 C:3 H:1 K:1 O:2 Q:2 S:3 T:4 V:3 |
| 10226: | B:7 C:2 H:1 K:1 O:3 Q:2 S:4 T:3 V:3 |
| 10227: | B:10 C:3 H:2 K:1 O:3 Q:1 S:6 T:5 V:3 |
| 10228: | B:10 C:3 H:2 K:1 O:3 Q:1 S:6 T:5 V:3 |
| 10229: | P:3 |
| 10230: | W:1 Y:1 |
| 10231: | B:3 D:10 E:3 F:1 G:3 H:3 N:2 O:2 T:2 X:1 AA:1 |
| 10232: | B:6 D:17 E:4 F:2 G:4 H:4 N:2 O:4 T:1 X:2 AA:2 |
| 10233: | B:3 D:10 E:3 F:1 G:2 H:2 N:2 O:2 T:2 X:1 AA:1 |
| 10234: | B:6 D:17 E:4 F:2 G:3 H:3 N:2 O:4 T:1 X:2 AA:2 |
| 10235: | W:7 |
| 10236: | Q:3 |
| 10237: | H:3 T:1 AA:1 |
| 10238: | B:1 H:1 |
| 10239: | S:2 |
| 10240: | C:2 K:2 S:2 |
| 10241: | S:3 |
| 10242: | T:4 |
| 10243: | X:1 Z:1 AA:1 |
| 10244: | P:2 |

TABLE II-continued

| SEQ ID NO. | Spatial Distribution |
|---|---|
| 10245: | B:2 C:1 E:2 F:7 H:9 K:2 N:2 O:2 P:4 R:1 S:5 T:5 W:4 Y:2 Z:1 AA:15 |
| 10246: | B:4 E:4 F:5 H:6 K:4 N:2 O:3 P:4 R:2 S:2 T:4 W:2 Y:1 Z:2 AA:13 |
| 10247: | B:4 E:4 F:5 H:6 K:4 N:2 O:3 P:4 R:2 S:2 T:4 W:2 Y:1 Z:2 AA:13 |
| 10248: | B:13 C:11 E:2 F:1 G:16 H:39 I:1 J:1 K:6 N:1 O:7 P:6 Q:5 R:5 S:17 T:10 U:1 V:2 W:4 X:2 Y:2 Z:2 AA:4 AC:3 AD:3 |
| 10249: | A:1 B:51 C:35 D:2 E:11 G:32 H:52 I:2 J:15 K:25 L:1 N:6 O:20 P:39 Q:24 R:6 S:34 T:6 U:6 V:6 W:10 X:13 Y:26 Z:18 AA:30 AC:8 AD:26 |
| 10250: | B:2 |
| 10251: | S:2 |
| 10252: | H:1 Y:1 |
| 10253: | AC:2 |
| 10254: | AA:8 |
| 10255: | B:40 C:1 D:2 G:1 H:10 K:1 N:1 O:1 S:2 T:1 W:5 X:2 Y:12 Z:2 AA:4 AD:2 |
| 10256: | B:20 D:1 H:5 K:2 T:4 W:2 X:1 Y:2 AA:2 AD:1 |
| 10257: | B:9 D:1 H:5 K:2 T:2 W:2 Y:2 AA:1 |
| 10258: | B:58 C:2 D:3 G:2 H:7 N:1 S:1 W:5 X:4 Y:13 Z:4 AA:4 AD:2 |
| 10259: | B:80 C:3 D:4 G:3 H:10 N:1 S:1 T:1 W:6 X:5 Y:17 Z:6 AA:5 AD:3 |
| 10260: | C:2 |
| 10261: | F:2 R:6 |
| 10262: | B:3 C:3 G:4 H:4 O:1 P:1 S:4 T:4 |
| 10263: | B:3 C:2 G:5 H:5 O:2 P:1 S:5 T:4 |
| 10264: | B:2 C:1 F:1 P:1 W:1 AC:1 |
| 10265: | B:2 |
| 10266: | B:2 |
| 10267: | H:1 W:1 |
| 10268: | H:1 Q:1 |
| 10269: | S:3 |
| 10270: | AA:3 |
| 10271: | B:2 |
| 10272: | B:6 C:2 H:9 K:4 O:1 S:4 T:1 U:1 Y:1 AA:2 AC:5 AD:4 |
| 10273: | B:9 C:7 H:5 J:1 K:5 O:1 S:6 T:2 U:1 Y:2 AA:3 AC:7 AD:1 |
| 10274: | B:2 C:1 AA:1 |
| 10275: | H:1 N:1 S:2 AC:3 AD:1 |
| 10276: | C:1 P:1 V:1 |
| 10277: | W:5 |
| 10278: | AA:2 |
| 10279: | W:6 |
| 10280: | E:1 G:2 |
| 10281: | S:1 T:2 |
| 10282: | B:2 G:1 |
| 10283: | B:2 |
| 10284: | B:1 C:10 E:3 F:3 G:7 H:16 I:2 J:4 K:5 N:1 O:3 P:6 S:25 T:8 U:1 V:7 W:3 X:1 Y:2 Z:2 AA:4 AC:5 AD:7 |
| 10285: | C:8 E:2 F:3 G:6 H:10 I:1 J:3 K:6 N:1 O:3 P:5 S:16 T:7 U:1 V:5 W:3 X:1 Y:1 Z:1 AA:3 AC:3 AD:4 |
| 10286: | C:6 E:2 F:3 G:4 H:9 I:1 J:3 K:6 N:1 O:2 P:4 S:15 T:7 U:1 V:5 W:1 X:1 Y:1 Z:1 AA:3 AC:3 AD:2 |
| 10287: | AA:2 |
| 10288: | AA:3 |
| 10289: | C:2 I:1 |
| 10290: | A:2 B:20 C:62 D:4 E:4 F:5 G:38 H:35 J:7 K:30 L:1 N:8 O:11 P:26 Q:15 R:11 S:21 T:26 U:3 V:1 W:4 X:11 Y:4 Z:6 AA:13 AB:1 AC:8 AD:6 |
| 10291: | A:3 B:37 C:121 D:8 E:7 F:9 G:75 H:75 J:15 K:61 L:2 N:13 O:24 P:50 Q:34 R:13 S:42 T:39 U:11 V:1 W:7 X:28 Y:6 Z:8 AA:29 AB:2 AC:17 AD:15 |
| 10292: | A:7 B:45 C:13 D:21 E:3 F:12 G:21 H:68 I:19 J:16 K:7 L:9 N:77 O:30 P:31 Q:3 R:36 S:44 T:66 V:3 W:43 X:5 Y:23 Z:21 AA:62 AB:1 AC:17 AD:18 |
| 10293: | A:4 B:38 C:107 D:7 E:8 F:10 G:71 H:65 J:13 K:52 L:2 N:16 O:21 P:49 Q:29 R:18 S:38 T:50 U:6 V:2 W:8 X:21 Y:6 Z:12 AA:21 AB:2 AC:14 AD:12 |
| 10294: | A:5 B:40 C:119 D:9 E:8 F:11 G:88 H:75 J:13 K:58 L:2 N:18 O:26 P:50 Q:31 R:19 S:41 T:53 U:9 V:2 W:8 X:21 Y:2 Z:12 AA:25 AB:2 AC:14 AD:13 |
| 10295: | A:4 B:24 C:84 D:7 E:4 F:8 G:66 H:58 J:9 K:44 L:1 N:11 O:18 P:27 Q:23 R:10 S:30 T:31 U:7 V:1 W:5 X:18 Y:4 Z:7 AA:22 AB:1 AC:10 AD:9 |
| 10296: | A:4 B:45 C:140 D:10 E:8 F:10 G:93 H:89 J:15 K:69 L:2 N:18 O:28 P:56 Q:39 R:19 S:50 T:54 U:11 V:2 W:9 X:29 Y:6 Z:12 AA:31 AB:2 AC:20 AD:17 |
| 10297: | O:3 |
| 10298: | N:2 |
| 10299: | AA:4 |
| 10300: | B:5 |
| 10301: | AD:2 |
| 10302: | B:1 W:3 Y:2 |
| 10303: | S:1 Z:1 |
| 10304: | B:11 C:6 K:2 S:4 Y:3 |
| 10305: | B:11 C:37 D:3 E:5 F:6 G:4 H:9 J:1 K:11 L:1 N:3 O:3 P:12 Q:3 R:10 S:28 T:17 W:3 X:5 Y:3 Z:3 AA:14 AC:4 AD:12 |
| 10306: | F:2 J:12 |
| 10307: | C:3 F:1 J:1 O:3 P:11 Q:1 S:7 V:1 W:3 X:2 Y:6 AA:4 |
| 10308: | AA:56 |
| 10309: | AA:75 |
| 10310: | V:22 |
| 10311: | B:3 |
| 10312: | T:3 |
| 10313: | H:3 P:2 |
| 10314: | B:2 G:4 S:1 Z:1 AA:2 |
| 10315: | B:2 D:2 O:1 W:2 |
| 10316: | G:1 O:1 S:1 Z:1 AA:29 |
| 10317: | G:1 O:2 S:2 Z:1 AA:20 |
| 10318: | B:2 |
| 10319: | C:2 G:1 W:1 |
| 10320: | S:1 AC:1 |
| 10321: | B:1 C:2 F:1 H:1 J:2 K:1 N:1 O:2 S:4 Y:1 AC:1 |

TABLE II-continued

| SEQ ID NO. | Spatial Distribution |
|---|---|
| 10322: | AA:2 |
| 10323: | P:2 AA:2 |
| 10324: | B:15 C:10 F:1 G:7 H:14 K:6 O:1 R:2 S:4 T:4 W:3 X:1 Y:4 Z:1 AB:2 AC:2 |
| 10325: | B:14 C:8 F:1 G:6 H:9 K:4 O:1 R:2 S:4 T:4 W:2 X:1 Y:4 Z:1 AB:1 AC:2 |
| 10326: | AA:2 |
| 10327: | H:2 O:3 AA:1 |
| 10328: | B:7 C:8 E:1 G:8 H:7 O:2 R:1 S:4 T:3 V:4 W:7 AA:2 |
| 10329: | T:2 |
| 10330: | B:13 |
| 10331: | T:4 |
| 10332: | H:4 |
| 10333: | P:2 |
| 10334: | C:2 P:1 S:1 AA:1 AC:1 |
| 10335: | C:1 P:1 S:1 AA:1 AC:1 |
| 10336: | T:1 AA:1 |
| 10337: | B:3 |
| 10338: | A:2 H:3 L:1 S:1 T:5 W:3 X:1 AA:2 AC:2 |
| 10339: | B:3 |
| 10340: | B:5 K:1 |
| 10341: | B:2 H:1 |
| 10342: | P:6 |
| 10343: | B:1 C:1 G:1 K:1 S:2 Y:6 Z:1 |
| 10344: | K:1 Y:1 |
| 10345: | B:2 |
| 10346: | AA:8 |
| 10347: | B:2 |
| 10348: | B:1 F:1 P:2 AC:2 |
| 10349: | B:2 S:1 Y:2 |
| 10350: | B:8 H:2 O:4 V:1 |
| 10351: | B:5 H:1 O:2 V:1 |
| 10352: | B:7 Y:4 |
| 10353: | G:1 H:1 |
| 10354: | C:1 O:1 |
| 10355: | A:33 C:2 D:1 G:1 H:7 J:4 K:3 O:16 P:24 Q:26 R:2 S:8 W:5 X:21 Z:1 AA:13 AC:7 AD:4 |
| 10356: | B:1 C:4 D:1 E:2 G:4 H:7 I:1 J:2 K:4 L:4 O:7 Q:1 S:1 T:8 W:2 AA:3 AC:1 AD:4 |
| 10357: | B:2 C:7 G:4 H:10 J:2 K:8 O:8 Q:1 R:2 S:2 T:2 W:2 AA:4 AC:4 AD:12 |
| 10358: | C:6 E:1 G:4 H:12 K:5 O:4 Q:1 S:1 W:1 AA:1 AC:3 AD:4 |
| 10359: | B:2 C:2 D:1 E:5 G:3 J:1 K:1 R:1 S:5 T:4 X:2 Z:1 |
| 10360: | B:2 G:3 N:1 P:5 |
| 10361: | D:11 V:1 W:1 |
| 10362: | B:4 C:2 E:2 F:1 G:1 H:2 J:1 K:1 P:1 S:1 T:3 W:1 Y:1 AC:4 |
| 10363: | A:1 I:3 N:100 |
| 10364: | A:1 I:3 N:99 |
| 10365: | G:1 H:1 |
| 10366: | H:1 AA:1 |
| 10367: | T:3 |
| 10368: | B:2 D:1 |
| 10369: | B:5 |
| 10370: | B:2 |
| 10371: | B:8 C:4 G:8 H:7 K:6 P:3 S:6 V:6 Y:4 Z:4 AA:6 |
| 10372: | B:7 G:2 H:5 J:1 O:3 S:1 T:1 AC:1 |
| 10373: | B:6 G:2 H:3 O:2 S:1 AC:1 |
| 10374: | T:10 |
| 10375: | A:3 B:23 C:59 D:5 E:3 F:14 G:20 H:49 J:7 K:22 L:2 N:29 O:13 P:8 Q:11 R:10 S:48 T:26 U:3 V:8 W:15 X:8 Y:2 Z:3 AA:46 AC:7 AD:12 |
| 10376: | A:3 B:23 C:59 D:5 E:3 F:14 G:20 H:49 J:7 K:22 L:2 N:29 O:13 P:8 Q:11 R:10 S:48 T:27 U:3 V:8 W:14 X:8 Y:2 Z:3 AA:46 AC:7 AD:12 |
| 10377: | A:2 B:19 C:47 D:3 E:3 F:11 G:18 H:38 J:5 K:16 L:2 N:23 O:12 P:6 Q:11 R:7 S:40 T:20 U:3 V:7 W:7 X:7 Y:1 Z:3 AA:29 AC:6 AD:10 |
| 10378: | A:2 B:19 C:50 D:4 E:3 F:11 G:18 H:40 J:5 K:17 L:2 N:23 O:13 P:6 Q:11 R:8 S:43 T:20 U:3 V:7 W:6 X:7 Y:1 Z:3 AA:29 AC:6 AD:12 |
| 10379: | A:5 B:42 C:90 D:7 E:5 F:23 G:36 H:76 J:12 K:35 L:4 N:48 O:22 P:14 Q:20 R:14 S:76 T:38 U:6 V:11 W:19 X:13 Y:3 Z:6 AA:66 AC:13 AD:17 |
| 10380: | A:5 B:42 C:90 D:7 E:5 F:23 G:36 H:76 J:12 K:35 L:4 N:48 O:22 P:14 Q:20 R:14 S:76 T:37 U:6 V:11 W:20 X:13 Y:3 Z:6 AA:66 AC:13 AD:17 |
| 10381: | B:8 C:3 E:1 F:1 G:2 H:9 J:2 K:1 N:3 P:1 AA:1 |
| 10382: | C:4 H:3 K:1 N:1 O:3 R:1 S:13 T:4 Y:5 AA:2 AD:2 |
| 10383: | Y:2 |
| 10384: | C:2 F:1 H:2 P:1 R:1 T:3 Y:1 AA:1 AD:1 |
| 10385: | C:2 F:1 H:2 P:1 R:1 T:3 Y:1 AA:1 AD:1 |
| 10386: | B:2 |
| 10387: | W:1 Y:1 |
| 10388: | P:4 |
| 10389: | B:7 C:8 N:1 O:1 P:2 S:5 |
| 10390: | P:2 S:1 AA:1 AD:1 |
| 10391: | P:2 S:1 AA:1 AD:1 |
| 10392: | B:2 E:1 K:1 |
| 10393: | N:3 |
| 10394: | B:8 C:10 E:1 G:3 H:22 I:1 K:8 N:5 P:3 R:1 S:8 T:1 U:2 W:1 Z:2 AC:4 AD:7 |
| 10395: | A:2 B:28 C:39 D:3 E:7 F:10 G:28 H:36 I:1 J:3 K:13 L:1 N:19 O:13 P:26 Q:10 R:18 S:29 T:14 U:9 V:11 W:10 X:9 Y:7 Z:22 AA:30 AC:11 AD:14 |
| 10396: | A:2 B:28 C:39 D:3 E:7 F:10 G:28 H:36 I:1 J:3 K:13 L:1 N:19 O:13 P:26 Q:10 R:17 S:29 T:14 U:9 V:11 W:9 X:9 Y:7 Z:22 AA:30 AC:11 AD:14 |
| 10397: | A:2 B:28 C:40 D:3 E:7 F:10 G:28 H:36 I:1 J:3 K:13 L:1 N:19 O:13 P:26 Q:10 R:17 S:29 T:14 U:9 V:11 W:10 X:9 Y:7 Z:21 AA:30 AC:11 AD:14 |
| 10398: | B:3 S:2 X:1 |
| 10399: | H:2 K:2 S:3 AC:1 |
| 10400: | AA:3 |
| 10401: | B:2 E:2 H:1 T:3 |
| 10402: | B:2 E:1 H:1 T:3 |
| 10403: | B:2 E:2 H:1 T:2 |
| 10404: | B:2 E:2 H:1 T:3 |
| 10405: | B:19 C:6 H:9 O:1 P:3 S:2 T:2 V:2 W:5 Y:2 Z:1 AA:2 AD:1 |
| 10406: | B:1 G:1 S:1 T:1 |

TABLE II-continued

| SEQ ID NO. | Spatial Distribution |
|---|---|
| 10407: | C:2 K:1 S:1 W:2 AC:1 |
| 10408: | B:1 G:1 |
| 10409: | H:1 J:4 O:1 X:5 |
| 10410: | AA:5 |
| 10411: | AA:2 |
| 10412: | T:3 |
| 10413: | AC:3 |
| 10414: | B:1 C:3 H:5 J:1 K:2 S:2 Y:1 Z:3 AA:3 AC:2 AD:4 |
| 10415: | X:5 |
| 10416: | N:1 P:1 S:2 |
| 10417: | B:64 G:1 K:1 W:6 Y:11 |
| 10418: | B:17 W:6 Y:7 |
| 10419: | B:29 G:1 Y:2 |
| 10420: | P:1 AC:3 AD:1 |
| 10421: | B:2 |
| 10422: | B:2 |
| 10423: | L:3 |
| 10424: | G:2 |
| 10425: | Y:2 |
| 10426: | C:2 Y:1 AD:1 |
| 10427: | S:2 |
| 10428: | K:1 R:1 |
| 10429: | AA:2 |
| 10430: | A:2 B:91 C:167 D:19 E:36 F:4 G:123 H:247 I:8 J:18 K:93 N:11 O:54 P:122 Q:76 R:37 S:178 T:29 V:14 W:36 X:7 Y:27 Z:22 AA:92 AC:38 AD:66 |
| 10431: | C:4 F:1 H:5 O:1 S:1 AC:1 |
| 10432: | AD:3 |
| 10433: | B:4 D:1 H:1 Y:1 AA:1 |
| 10434: | B:4 D:1 H:1 Y:1 AA:1 |
| 10435: | B:1 T:1 |
| 10436: | C:2 G:1 W:1 |
| 10437: | Y:5 |
| 10438: | AA:4 |
| 10439: | B:4 |
| 10440: | H:5 |
| 10441: | D:1 H:1 R:2 T:3 AA:1 |
| 10442: | A:4 B:50 C:99 D:12 E:7 F:10 G:80 H:55 I:1 J:14 K:38 L:1 N:9 O:11 P:37 Q:9 R:31 S:59 T:22 V:6 W:11 X:9 Y:22 Z:14 AA:60 AB:1 AC:9 AD:60 |
| 10443: | A:3 B:49 C:93 D:10 E:7 F:9 G:78 H:53 I:1 J:14 K:37 L:1 N:9 O:11 P:36 Q:8 R:31 S:59 T:22 V:6 W:11 X:8 Y:22 Z:12 AA:55 AB:1 AC:9 AD:59 |
| 10444: | A:3 B:49 C:93 D:10 E:7 F:9 G:78 H:53 I:1 J:14 K:37 L:1 N:9 O:11 P:36 Q:8 R:31 S:59 T:22 V:6 W:11 X:8 Y:22 Z:12 AA:55 AB:1 AC:9 AD:59 |
| 10445: | H:1 S:1 |
| 10446: | Y:2 |
| 10447: | B:3 |
| 10448: | AA:3 |
| 10449: | B:3 E:4 H:27 O:4 AC:2 |
| 10450: | D:1 G:1 H:2 K:1 N:1 T:1 |
| 10451: | T:2 |
| 10452: | O:4 R:3 Y:2 |
| 10453: | B:26 G:1 J:1 S:1 W:6 |
| 10454: | B:7 D:3 E:1 H:4 K:1 L:1 N:4 O:1 P:1 T:7 V:3 W:1 AA:1 |
| 10455: | H:2 AC:1 |
| 10456: | G:2 H:3 |
| 10457: | B:3 |
| 10458: | B:4 |
| 10459: | T:2 |
| 10460: | B:5 K:3 N:4 S:2 W:4 |
| 10461: | C:2 |
| 10462: | B:8 C:5 G:4 H:4 J:2 K:2 |
| 10463: | B:2 |
| 10464: | B:3 |
| 10465: | B:3 |
| 10466: | B:2 F:1 H:1 T:2 W:3 |
| 10467: | H:2 AA:3 |
| 10468: | D:3 |
| 10469: | G:3 |
| 10470: | F:2 |
| 10471: | H:2 |
| 10472: | K:1 P:1 Y:2 |
| 10473: | T:5 |
| 10474: | AD:2 |
| 10475: | G:1 H:3 W:5 |
| 10476: | G:3 |
| 10477: | H:1 P:1 S:1 Y:1 |
| 10478: | N:2 |
| 10479: | B:1 E:1 |
| 10480: | T:4 |
| 10481: | Y:1 AA:1 |
| 10482: | H:6 |
| 10483: | A:3 B:17 C:23 E:18 F:5 G:20 H:51 I:1 J:2 K:26 L:2 N:3 O:12 P:13 Q:25 R:2 S:11 T:41 V:4 W:6 X:4 Y:6 Z:7 AA:7 AC:11 AD:13 |
| 10484: | A:2 B:15 C:24 E:17 F:6 G:12 H:45 I:2 J:2 K:25 L:1 N:4 O:10 P:17 Q:28 R:1 S:12 T:24 V:5 W:5 X:4 Y:6 Z:5 AA:7 AC:13 AD:15 |
| 10485: | A:2 B:32 C:31 E:34 F:7 G:20 H:62 I:3 J:3 K:35 L:2 N:4 O:24 P:25 Q:43 R:2 S:23 T:55 V:11 W:6 X:7 Y:11 Z:10 AA:12 AC:25 AD:20 |
| 10486: | X:3 |
| 10487: | D:5 |
| 10488: | T:3 |
| 10489: | B:1 C:1 Y:4 |
| 10490: | D:2 |
| 10491: | T:2 |
| 10492: | X:4 |
| 10493: | P:2 |
| 10494: | T:2 |
| 10495: | B:7 G:1 S:1 Y:1 AA:1 AD:1 |
| 10496: | AA:2 |
| 10497: | B:1 C:1 E:1 G:3 H:4 K:9 P:3 W:3 X:1 Y:2 AA:1 |
| 10498: | G:1 P:1 |
| 10499: | B:2 H:3 Q:1 Y:2 |
| 10500: | C:1 S:2 W:1 |
| 10501: | S:2 |
| 10502: | F:1 H:1 K:2 N:1 S:1 T:1 AA:1 AC:1 AD:2 |
| 10503: | F:1 H:1 K:2 N:1 S:1 T:1 AA:1 AC:1 AD:2 |
| 10504: | B:1 G:1 H:2 S:2 W:2 AD:2 |
| 10505: | B:2 G:2 H:3 S:1 W:4 AD:2 |
| 10506: | W:2 |
| 10507: | B:1 H:2 O:1 P:4 R:2 S:1 X:6 AC:3 |
| 10508: | B:1 H:1 O:1 P:4 R:2 S:1 X:6 AC:3 |
| 10509: | E:2 K:2 N:2 O:2 |
| 10510: | C:2 O:1 AA:1 |
| 10511: | B:3 |
| 10512: | H:1 O:2 |
| 10513: | H:3 |
| 10514: | B:5 H:1 W:2 |
| 10515: | B:5 C:1 |
| 10516: | B:14 G:1 Y:3 |
| 10517: | G:2 |
| 10518: | B:1 G:1 |
| 10519: | B:4 |
| 10520: | AA:2 |
| 10521: | H:3 AA:2 |

TABLE II-continued

| SEQ ID NO. | Spatial Distribution |
|---|---|
| 10522: | X:2 |
| 10523: | X:2 |
| 10524: | B:1 C:1 K:2 S:1 W:2 Y:4 |
| 10525: | B:2 S:3 W:2 Y:1 AC:2 AD:1 |
| 10526: | B:1 S:1 W:1 Y:1 AC:1 AD:1 |
| 10527: | K:3 |
| 10528: | P:1 T:2 |
| 10529: | A:1 C:1 G:1 |
| 10530: | Y:1 AA:1 |
| 10531: | B:3 H:1 K:1 W:1 AA:16 AC:1 |
| 10532: | P:2 |
| 10533: | B:2 |
| 10534: | T:2 |
| 10535: | T:2 |
| 10536: | B:2 |
| 10537: | B:1 G:4 Q:3 |
| 10538: | AA:3 |
| 10539: | P:3 |
| 10540: | E:2 AC:1 |
| 10541: | AA:4 |
| 10542: | W:3 |
| 10543: | B:3 C:1 G:1 K:3 S:4 |
| 10544: | B:10 C:3 E:20 F:8 G:2 H:5 J:3 K:5 L:6 N:14 O:2 P:18 R:5 S:11 T:65 V:14 X:1 Y:2 Z:4 AA:2 AC:4 AD:5 |
| 10545: | B:1 E:1 |
| 10546: | H:3 |
| 10547: | H:4 |
| 10548: | B:1 H:10 K:2 O:7 S:8 W:1 AC:2 |
| 10549: | B:1 H:9 K:2 O:7 S:8 W:1 AC:2 |
| 10550: | B:1 H:8 K:2 O:7 S:7 W:1 AC:2 |
| 10551: | B:1 H:10 K:2 O:7 S:9 W:1 AC:4 |
| 10552: | B:1 H:8 K:2 O:8 S:7 W:1 AC:2 |
| 10553: | C:3 H:2 |
| 10554: | R:3 |
| 10555: | W:3 |
| 10556: | C:4 S:1 |
| 10557: | C:1 G:6 H:8 K:1 N:1 O:2 P:1 S:3 W:1 Z:1 AA:1 AC:5 AD:1 |
| 10558: | A:2 B:32 C:69 D:10 E:7 F:2 G:51 H:107 I:4 J:20 K:27 N:8 O:30 P:83 Q:23 R:17 S:90 T:26 U:1 V:5 W:14 X:32 Y:25 Z:15 AA:82 AC:31 AD:35 |
| 10559: | A:2 B:32 C:66 D:9 E:7 F:2 G:49 H:98 I:4 J:20 K:27 N:8 O:30 P:78 Q:23 R:16 S:90 T:25 U:1 V:5 W:12 X:31 Y:25 Z:14 AA:74 AC:30 AD:33 |
| 10560: | A:1 B:32 C:59 D:8 E:7 F:2 G:43 H:76 I:4 J:18 K:24 N:8 O:27 P:73 Q:22 R:12 S:77 T:23 U:1 V:4 W:11 X:30 Y:24 Z:13 AA:62 AC:26 AD:26 |
| 10561: | A:1 B:32 C:59 D:8 E:7 F:2 G:44 H:85 I:4 J:19 K:26 N:8 O:28 P:73 Q:22 R:13 S:80 T:23 U:1 V:4 W:11 X:31 Y:24 Z:13 AA:64 AC:26 AD:32 |
| 10562: | A:3 B:63 C:115 D:15 E:14 F:4 G:88 H:159 I:8 J:37 K:43 N:16 O:53 P:145 Q:44 R:26 S:152 T:46 U:2 V:9 W:21 X:60 Y:43 Z:20 AA:129 AC:50 AD:51 |
| 10563: | A:3 B:63 C:117 D:16 E:14 F:4 G:90 H:168 I:8 J:37 K:43 N:16 O:53 P:150 Q:45 R:27 S:153 T:47 U:2 V:9 W:23 X:61 Y:43 Z:21 AA:137 AC:51 AD:54 |
| 10564: | P:2 W:2 |
| 10565: | Q:4 |
| 10566: | B:1 O:1 U:1 Y:5 AA:1 |
| 10567: | B:1 S:1 AA:1 |
| 10568: | B:3 |
| 10569: | G:2 |
| 10570: | B:2 H:4 K:2 N:1 O:2 S:1 T:2 |
| 10571: | P:1 Q:1 |
| 10572: | AA:3 |
| 10573: | P:3 |
| 10574: | V:3 AA:2 |
| 10575: | G:1 H:1 S:3 |
| 10576: | H:2 S:1 |
| 10577: | AA:6 |
| 10578: | T:2 |
| 10579: | F:2 G:2 P:1 V:1 |
| 10580: | B:2 |
| 10581: | O:2 |
| 10582: | T:2 |
| 10583: | C:3 E:1 F:1 H:4 I:1 P:1 S:3 Y:1 |
| 10584: | C:3 E:1 F:1 H:4 I:2 P:1 S:5 Y:2 |
| 10585: | C:2 E:1 F:1 H:4 I:1 P:1 S:3 Y:1 |
| 10586: | C:2 E:2 F:2 H:5 I:1 P:2 S:7 Y:2 |
| 10587: | C:4 E:2 F:2 H:4 I:2 P:1 S:4 Y:2 |
| 10588: | C:3 E:1 F:1 H:5 I:2 P:1 S:4 Y:1 |
| 10589: | C:3 E:1 F:1 H:5 I:2 P:1 S:6 Y:2 |
| 10590: | B:6 C:7 G:3 H:10 I:2 K:1 O:2 P:8 Q:2 R:3 S:5 T:3 Y:5 Z:24 AA:1 AD:4 |
| 10591: | B:5 C:6 G:3 H:10 I:2 K:1 O:2 P:8 Q:2 R:2 S:3 T:2 Y:5 Z:22 AA:1 AD:4 |
| 10592: | B:8 C:1 |
| 10593: | A:1 B:1 E:1 H:1 K:2 O:1 P:1 S:2 T:2 W:1 Y:1 AA:4 |
| 10594: | H:1 K:1 S:5 |
| 10595: | B:3 G:1 S:1 |
| 10596: | B:5 |
| 10597: | B:2 |
| 10598: | X:3 |
| 10599: | C:1 S:2 |
| 10600: | O:5 |
| 10601: | B:22 C:3 G:5 H:11 J:1 K:3 N:2 O:1 P:3 Q:1 R:1 S:4 T:4 V:2 W:3 X:1 AA:2 AC:1 |
| 10602: | B:5 C:1 H:5 O:1 P:2 W:3 |
| 10603: | F:4 |
| 10604: | B:1 F:1 G:1 H:1 O:1 R:1 S:2 T:2 AA:1 |
| 10605: | B:1 F:1 G:1 H:1 O:1 R:1 S:2 T:2 AA:1 |
| 10606: | B:4 C:7 G:2 H:3 K:1 N:1 O:2 P:1 S:2 T:4 W:2 Y:1 AC:1 |
| 10607: | K:2 |
| 10608: | B:7 |
| 10609: | Y:1 AC:1 |
| 10610: | A:1 C:1 R:1 |
| 10611: | AD:3 |
| 10612: | C:2 F:1 W:1 |
| 10613: | C:2 F:1 W:1 |
| 10614: | AA:4 |
| 10615: | H:3 T:4 |
| 10616: | F:190 R:58 S:1 AA:1 |

TABLE II-continued

| SEQ ID NO. | Spatial Distribution |
|---|---|
| 10617: | B:1 G:1 H:1 O:1 P:1 Q:1 S:1 X:1 Z:1 AA:1 |
| 10618: | B:1 G:2 S:1 |
| 10619: | P:3 |
| 10620: | B:11 C:1 G:8 H:4 K:1 U:2 V:1 Z:1 |
| 10621: | G:2 |
| 10622: | Q:2 |
| 10623: | G:2 |
| 10624: | X:2 |
| 10625: | W:3 |
| 10626: | B:2 G:2 T:1 Z:2 |
| 10627: | B:7 |
| 10628: | B:3 G:5 |
| 10629: | B:2 |
| 10630: | B:1 C:1 |
| 10631: | X:2 |
| 10632: | Y:4 |
| 10633: | AA:2 |
| 10634: | H:3 |
| 10635: | H:4 |
| 10636: | H:1 O:1 |
| 10637: | AA:2 |
| 10638: | T:2 |
| 10639: | Y:3 |
| 10640: | B:1 S:1 Y:2 AA:1 |
| 10641: | B:4 H:2 |
| 10642: | F:2 H:3 S:2 |
| 10643: | R:3 |
| 10644: | R:3 |
| 10645: | AA:5 |
| 10646: | G:1 H:3 O:1 R:1 T:4 V:4 |
| 10647: | G:1 P:1 S:1 W:2 AA:3 |
| 10648: | G:3 P:1 S:1 W:4 AA:3 |
| 10649: | C:1 O:2 |
| 10650: | N:2 |
| 10651: | H:1 AC:1 |
| 10652: | B:2 |
| 10653: | B:3 C:3 F:1 G:2 H:4 J:1 K:1 P:3 S:1 V:1 |
| 10654: | O:1 Q:1 T:4 AA:1 |
| 10655: | O:1 Q:1 T:5 AA:1 |
| 10656: | H:2 Y:2 |
| 10657: | Y:2 |
| 10658: | B:1 G:1 H:1 Z:1 |
| 10659: | B:4 G:3 |
| 10660: | F:1 J:1 T:3 |
| 10661: | H:2 |
| 10662: | R:2 |
| 10663: | B:6 C:1 S:3 |
| 10664: | T:2 |
| 10665: | O:2 |
| 10666: | T:2 |
| 10667: | G:1 H:3 T:3 AC:1 |
| 10668: | G:1 H:3 T:3 AC:1 |
| 10669: | B:9 T:2 |
| 10670: | B:10 C:10 G:1 H:1 J:1 P:2 R:1 S:1 V:1 |
| 10671: | V:2 |
| 10672: | P:2 |
| 10673: | B:7 C:3 F:1 G:1 H:1 K:4 O:2 Q:1 R:1 S:1 T:3 Y:3 Z:2 AA:1 AC:1 AD:1 |
| 10674: | B:11 C:6 G:2 H:2 K:9 O:4 Q:2 R:3 S:2 T:6 Y:5 Z:2 AA:2 AC:1 AD:2 |
| 10675: | B:12 C:6 G:2 H:2 K:7 O:2 Q:2 R:2 S:2 T:6 Y:6 Z:1 AA:2 AC:2 AD:2 |
| 10676: | B:6 C:4 G:1 H:2 K:6 O:4 Q:1 R:2 S:1 T:3 Y:4 Z:2 AA:2 AC:1 AD:2 |
| 10677: | S:3 |
| 10678: | B:4 |
| 10679: | T:2 |
| 10680: | B:3 C:2 G:2 H:1 K:1 N:4 S:2 Y:3 Z:2 |
| 10681: | Y:4 |
| 10682: | S:2 AA:2 |
| 10683: | G:2 |
| 10684: | T:2 |
| 10685: | Q:1 T:1 |
| 10686: | B:2 |
| 10687: | B:3 |
| 10688: | G:1 H:1 K:1 AA:2 |
| 10689: | G:1 H:1 K:1 AA:1 |
| 10690: | C:2 J:2 K:5 O:2 P:2 S:4 T:2 |
| 10691: | C:1 J:1 K:4 O:1 P:3 S:4 T:3 |
| 10692: | N:1 AD:1 |
| 10693: | AA:4 |
| 10694: | D:5 |
| 10695: | B:1 S:1 |
| 10696: | K:1 Y:2 AA:2 |
| 10697: | V:4 |
| 10698: | I:3 |
| 10699: | B:1 O:1 S:2 Y:1 |
| 10700: | B:1 O:1 S:2 Y:1 |
| 10701: | B:2 C:4 G:1 H:4 K:1 Y:2 Z:3 |
| 10702: | B:2 C:6 G:1 H:2 Y:2 Z:2 |
| 10703: | B:2 AC:1 |
| 10704: | H:3 L:1 R:1 U:2 AA:3 |
| 10705: | T:2 |
| 10706: | S:1 AD:1 |
| 10707: | B:1 H:2 K:1 O:1 |
| 10708: | R:1 W:2 Z:1 AA:1 |
| 10709: | U:3 |
| 10710: | B:4 C:3 H:3 O:1 U:1 |
| 10711: | C:1 W:1 |
| 10712: | B:37 G:12 Y:2 |
| 10713: | T:4 |
| 10714: | S:3 |
| 10715: | U:5 |
| 10716: | H:1 S:1 |
| 10717: | H:3 |
| 10718: | T:2 |
| 10719: | B:2 C:1 H:1 J:2 O:1 S:1 X:2 |
| 10720: | C:11 |
| 10721: | W:2 |
| 10722: | B:1 C:2 J:2 O:2 |
| 10723: | P:3 |
| 10724: | Y:2 AC:1 AD:2 |
| 10725: | T:4 |
| 10726: | D:18 |
| 10727: | B:1 C:3 G:1 H:8 O:1 S:6 T:12 Y:1 AA:1 C:2 |
| 10728: | N:2 |
| 10729: | C:1 K:2 AA:1 D:1 |
| 10730: | B:1 G:1 H:1 |
| 10731: | X:2 |
| 10732: | T:2 |
| 10733: | X:2 |
| 10734: | AD:3 |
| 10735: | H:1 O:3 S:1 W:1 AA:1 |
| 10736: | B:2 |
| 10737: | N:43 X:3 Y:6 Z:4 |
| 10738: | G:1 N:41 Y:4 Z:4 |
| 10739: | A:2 B:3 C:36 E:6 F:1 G:22 H:24 I:3 J:5 K:9 N:15 O:6 P:43 Q:2 R:3 S:39 T:12 V:4 X:1 Y:4 Z:8 AA:9 AC:6 AD:8 |
| 10740: | A:2 B:3 C:36 E:6 F:1 G:20 H:24 I:3 J:5 K:9 N:15 O:6 P:42 Q:2 R:3 S:37 T:12 V:4 X:1 Y:4 Z:8 AA:8 AC:6 AD:8 |
| 10741: | B:2 |
| 10742: | S:1 T:1 W:3 AA:3 AC:2 |
| 10743: | J:1 S:2 T:1 W:3 AA:4 AC:2 |
| 10744: | G:1 H:1 |
| 10745: | B:4 C:1 G:4 S:1 T:1 |
| 10746: | B:5 C:1 G:2 H:1 V:1 |
| 10747: | E:3 G:2 H:3 K:2 N:1 P:1 Y:2 |
| 10748: | E:3 G:2 H:4 K:2 N:1 P:1 Y:1 |

TABLE II-continued

| SEQ ID NO. | Spatial Distribution |
|---|---|
| 10749: | AC:2 |
| 10750: | B:2 S:3 T:1 AC:1 |
| 10751: | B:2 S:2 T:1 AC:1 |
| 10752: | B:4 S:2 T:2 AC:1 |
| 10753: | B:1 V:1 |
| 10754: | V:2 |
| 10755: | B:3 |
| 10756: | B:9 C:11 E:1 G:7 H:16 J:1 K:28 O:3 P:3 Q:2 R:5 S:4 W:2 Y:3 Z:2 AA:1 AC:1 AD:1 |
| 10757: | B:21 C:15 E:2 G:12 H:23 J:2 K:46 O:6 P:3 Q:5 R:8 S:8 W:1 Y:3 Z:4 AA:2 AC:2 AD:2 |
| 10758: | B:1 D:2 F:1 H:1 O:2 Q:1 S:1 AA:1 AC:1 |
| 10759: | W:1 AA:1 |
| 10760: | H:4 |
| 10761: | H:2 AC:1 |
| 10762: | B:1 W:2 Y:1 |
| 10763: | T:3 |
| 10764: | AA:3 |
| 10765: | T:2 |
| 10766: | B:1 H:1 |
| 10767: | B:1 T:3 |
| 10768: | B:5 E:1 F:1 H:3 J:1 K:3 L:1 O:2 Q:2 T:3 U:2 AC:1 AD:1 |
| 10769: | B:5 E:1 F:1 H:3 J:1 K:1 L:1 O:2 Q:2 T:3 U:2 AC:1 AD:1 |
| 10770: | B:4 E:1 F:1 H:2 J:1 K:1 L:1 O:2 Q:2 T:2 U:2 AC:1 AD:1 |
| 10771: | B:9 E:1 F:1 H:4 J:1 K:1 L:1 O:2 Q:5 T:3 U:2 AC:1 AD:1 |
| 10772: | B:8 G:2 H:3 O:1 T:1 V:1 |
| 10773: | R:3 |
| 10774: | AA:2 |
| 10775: | B:12 E:3 G:10 H:12 Q:4 S:9 T:4 Y:4 AA:6 |
| 10776: | B:11 P:2 Y:7 |
| 10777: | B:1 C:6 F:1 G:3 H:11 K:3 O:1 R:1 S:5 W:2 AA:1 |
| 10778: | B:1 C:4 G:5 H:8 K:3 N:1 O:1 S:6 T:1 AA:1 |
| 10779: | P:2 |
| 10780: | S:2 |
| 10781: | C:2 H:2 I:1 R:2 AD:1 |
| 10782: | B:8 O:1 P:4 R:3 AA:2 AC:2 |
| 10783: | B:5 O:1 P:5 R:3 AA:1 AC:1 |
| 10784: | B:5 O:1 P:5 R:3 AA:1 AC:1 |
| 10785: | AA:5 |
| 10786: | T:2 |
| 10787: | P:2 |
| 10788: | B:2 C:1 F:1 K:2 L:3 N:3 T:1 W:1 Y:3 |
| 10789: | B:2 F:1 Y:1 AC:1 |
| 10790: | B:2 F:1 Y:1 AC:1 |
| 10791: | Y:1 AA:1 |
| 10792: | C:2 P:2 AA:2 |
| 10793: | C:1 P:1 AA:1 |
| 10794: | W:2 |
| 10795: | B:1 C:1 G:1 H:1 P:3 S:1 AD:3 |
| 10796: | B:1 C:1 G:1 H:1 P:1 S:1 AD:1 |
| 10797: | B:3 |
| 10798: | H:3 |
| 10799: | C:2 H:1 J:7 K:6 P:2 R:5 S:2 AA:1 AC:2 AD:1 |
| 10800: | B:3 |
| 10801: | A:29 D:1 H:3 J:1 L:1 N:11 O:5 P:2 R:2 T:4 AA:5 AC:5 |
| 10802: | A:60 D:3 H:5 J:2 L:1 N:15 O:9 P:2 R:3 T:6 AA:10 AC:7 |
| 10803: | B:1 S:1 |
| 10804: | C:3 |
| 10805: | B:2 S:1 |
| 10806: | B:4 |
| 10807: | O:2 |
| 10808: | AA:2 |
| 10809: | W:4 |
| 10810: | B:1 C:1 F:1 H:3 K:7 O:4 S:6 W:1 AA:1 AC:7 AD:2 |
| 10811: | S:2 AA:4 |
| 10812: | C:1 Z:1 |
| 10813: | B:3 E:1 G:1 H:2 O:2 T:2 |
| 10814: | B:3 E:1 G:2 H:1 O:4 T:2 |
| 10815: | AA:3 |
| 10816: | H:2 J:1 O:10 P:2 R:2 T:1 X:1 AA:2 AD:2 |
| 10817: | B:2 W:1 |
| 10818: | AA:4 |
| 10819: | P:2 |
| 10820: | B:2 H:1 L:1 N:1 Y:1 AA:3 |
| 10821: | AA:3 |
| 10822: | T:3 |
| 10823: | B:2 C:1 D:3 G:1 H:2 P:2 AA:2 |
| 10824: | B:2 C:1 T:2 |
| 10825: | B:59 C:4 G:9 H:11 I:1 K:6 L:1 N:1 O:4 P:2 Q:1 S:6 T:1 V:5 W:1 Y:1 Z:1 AA:4 |
| 10826: | B:7 F:2 G:3 H:3 K:3 O:1 T:3 AA:1 |
| 10827: | B:4 F:2 H:3 O:1 T:3 AA:1 |
| 10828: | B:4 F:2 H:3 O:1 T:3 AA:1 |
| 10829: | B:4 F:2 H:3 O:1 T:3 AA:1 |
| 10830: | G:2 AA:1 |
| 10831: | AA:1 |
| 10832: | B:3 |
| 10833: | A:1 B:9 C:10 D:1 E:2 G:10 H:33 K:1 N:1 O:2 P:4 Q:3 R:1 S:13 T:6 V:2 W:3 Y:5 Z:1 AA:3 AC:1 AD:1 |
| 10834: | A:1 B:12 C:14 D:1 E:4 G:12 H:40 K:2 O:3 P:6 Q:3 R:2 S:21 T:8 V:4 W:2 Y:8 Z:1 AA:5 AD:1 |
| 10835: | A:1 B:12 C:14 D:1 E:4 G:12 H:40 K:2 O:3 P:6 Q:3 R:2 S:21 T:8 V:4 W:2 Y:8 Z:1 AA:5 AD:1 |
| 10836: | B:7 |
| 10837: | H:2 P:2 X:1 Z:1 |
| 10838: | B:3 |
| 10839: | AA:3 |
| 10840: | B:2 |
| 10841: | N:2 Y:1 |
| 10842: | AA:5 |
| 10843: | C:3 |
| 10844: | B:6 C:5 E:6 F:2 G:5 H:2 J:1 N:2 O:2 S:6 T:6 U:1 W:1 Y:3 Z:3 AA:2 AC:2 AD:2 |
| 10845: | A:1 B:13 C:27 E:1 G:19 H:23 I:3 J:1 K:9 N:2 O:3 P:2 Q:1 R:1 S:32 T:7 U:2 W:8 X:3 Y:8 Z:1 AA:6 AC:2 AD:12 |
| 10846: | B:7 H:3 O:3 S:2 T:1 W:1 AC:1 |
| 10847: | W:4 |
| 10848: | AA:3 |
| 10849: | B:3 C:1 H:5 K:1 Y:1 |
| 10850: | H:1 AA:2 |
| 10851: | A:1 B:9 C:11 F:4 G:2 H:8 J:1 K:8 N:3 O:1 P:1 Q:4 S:1 W:4 Z:8 AA:19 AC:2 AD:4 |
| 10852: | A:1 B:7 C:11 F:2 G:3 H:5 J:1 K:6 N:4 O:1 P:2 Q:6 S:2 W:3 Z:5 AA:29 AC:2 AD:4 |
| 10853: | A:2 |
| 10854: | AD:3 |
| 10855: | AA:2 |
| 10856: | T:3 |

TABLE II-continued

| SEQ ID NO. | Spatial Distribution |
|---|---|
| 10857: | H:1 J:1 |
| 10858: | B:3 |
| 10859: | AA:6 |
| 10860: | B:1 S:2 |
| 10861: | N:3 |
| 10862: | P:3 |
| 10863: | B:1 P:1 T:2 W:1 |
| 10864: | B:2 C:2 |
| 10865: | P:2 S:1 |
| 10866: | B:3 C:1 E:1 F:2 N:1 O:1 Q:5 R:1 S:1 X:1 AA:1 |
| 10867: | B:3 C:1 E:1 F:2 N:1 O:1 Q:4 R:1 S:1 X:1 AA:1 |
| 10868: | B:4 C:1 D:1 G:1 K:1 P:2 S:3 W:2 AC:1 |
| 10869: | B:4 C:2 D:2 G:2 K:1 P:1 S:1 W:3 AC:2 |
| 10870: | B:17 C:6 E:1 F:1 G:6 H:7 J:2 N:3 O:4 P:4 R:12 S:3 U:1 W:6 Y:8 AA:1 AC:1 AD:2 |
| 10871: | B:16 C:6 E:1 F:1 G:5 H:5 J:2 N:3 O:4 P:3 R:8 S:3 U:1 W:4 Y:7 AA:1 AC:1 AD:2 |
| 10872: | B:2 |
| 10873: | X:2 |
| 10874: | B:3 |
| 10875: | AD:5 |
| 10876: | B:2 K:1 |
| 10877: | K:2 |
| 10878: | T:2 |
| 10879: | AA:2 |
| 10880: | S:2 |
| 10881: | B:1 T:1 W:1 |
| 10882: | H:1 T:1 AA:2 AD:2 |
| 10883: | B:1 G:1 |
| 10884: | B:19 C:4 F:1 H:5 I:1 J:4 K:3 O:2 P:4 R:7 S:6 U:2 W:1 X:1 Y:7 AA:6 AC:1 AD:2 |
| 10885: | C:4 P:1 AC:1 |
| 10886: | C:3 O:1 P:1 AC:2 |
| 10887: | AA:3 |
| 10888: | B:2 Y:1 |
| 10889: | T:2 |
| 10890: | B:4 C:1 H:2 S:1 Y:1 |
| 10891: | F:1 H:4 S:3 W:2 |
| 10892: | H:4 |
| 10893: | AD:3 |
| 11894: | B:1 H:2 P:1 S:5 |
| 10895: | W:1 AD:2 |
| 10896: | H:1 X:1 |
| 10897: | G:2 |
| 10898: | AA:4 |
| 10899: | S:17 |
| 10900: | X:3 |
| 10901: | B:2 |
| 10902: | K:2 |
| 10903: | S:3 |
| 10904: | H:1 AA:2 |
| 10905: | B:6 C:1 H:3 O:1 R:1 S:2 W:1 Y:1 AC:1 |
| 10906: | B:2 C:1 O:1 R:1 S:2 W:1 Y:1 AC:1 |
| 10907: | A:1 B:4 C:3 G:11 H:12 O:1 P:5 Q:1 R:3 S:4 W:2 X:1 Y:1 Z:1 AA:2 AC:2 AD:2 |
| 10908: | C:1 AA:2 |
| 10909: | B:2 |
| 10910: | B:1 C:1 G:2 H:3 R:1 Z:1 AD:2 |
| 10911: | B:1 C:1 G:2 H:2 R:1 Z:1 AD:2 |
| 10912: | Q:2 |
| 10913: | G:1 S:1 |
| 10914: | V:2 |
| 10915: | B:2 |
| 10916: | B:1 F:1 AA:1 |
| 10917: | S:3 |
| 10918: | T:2 |
| 10919: | X:1 AD:2 |
| 10920: | R:2 |
| 10921: | B:2 |
| 10922: | R:4 |
| 10923: | B:1 H:1 |
| 10924: | S:4 |
| 10925: | B:5 G:1 S:1 Y:1 AA:4 |
| 10926: | W:2 |
| 10927: | AA:3 |
| 10928: | C:17 K:1 S:17 |
| 10929: | B:2 E:1 G:2 H:2 J:1 K:1 O:1 S:5 T:4 W:5 AA:1 AC:1 |
| 10930: | B:4 C:1 F:1 G:1 H:2 K:2 O:4 S:1 T:1 W:1 Z:1 AA:1 AC:1 |
| 10931: | AA:4 |
| 10932: | D:5 |
| 10933: | N:1 P:2 Z:1 |
| 10934: | C:3 |
| 10935: | G:3 |
| 10936: | B:3 O:1 W:1 AC:1 |
| 10937: | G:1 N:1 S:3 AC:2 |
| 10938: | B:1 H:1 |
| 10939: | S:2 |
| 10940: | C:3 |
| 10941: | B:7 C:3 E:3 F:1 G:1 H:3 K:1 P:2 V:2 W:1 Y:1 AC:1 |
| 10942: | B:2 C:2 K:1 |
| 10943: | B:1 H:3 K:1 O:1 S:1 |
| 10944: | E:1 P:1 |
| 10945: | B:1 H:2 S:1 |
| 10946: | X:2 |
| 10947: | J:2 |
| 10948: | B:5 |
| 10949: | AD:3 |
| 10950: | B:4 |
| 10951: | AA:6 |
| 10952: | K:1 O:1 S:1 |
| 10953: | T:2 |
| 10954: | B:2 C:3 G:1 H:4 O:1 Y:1 AA:3 AD:1 |
| 10955: | B:4 O:2 P:1 T:3 |
| 10956: | B:5 O:2 P:2 T:6 |
| 10957: | O:2 |
| 10958: | B:2 |
| 10959: | F:2 N:4 P:3 S:5 AA:2 AC:2 |
| 10960: | F:2 N:8 P:4 S:4 AA:2 AC:2 |
| 10961: | K:1 P:1 |
| 10962: | B:2 |
| 10963: | AA:2 |
| 10964: | T:5 |
| 10965: | K:401 |
| 10966: | B:16 C:6 F:2 G:1 H:17 I:1 K:12 P:6 S:9 T:2 W:3 Y:13 |
| 10967: | B:3 G:1 H:1 |
| 10968: | C:13 K:17 S:12 |
| 10969: | C:7 K:16 S:8 |
| 10970: | G:1 T:1 |
| 10971: | G:2 H:11 P:3 Q:1 S:1 V:1 AA:1 |
| 10972: | G:2 H:12 P:3 Q:1 S:1 V:1 AA:1 |
| 10973: | B:2 H:4 |
| 10974: | B:1 E:1 |
| 10975: | P:1 |
| 10976: | C:7 P:23 S:2 T:1 X:4 |
| 10977: | B:4 Q:4 |
| 10978: | P:1 S:1 T:1 Y:1 AA:1 |
| 10979: | P:1 AA:2 |
| 10980: | AA:2 |
| 10981: | B:2 G:3 O:1 AA:1 |
| 10982: | B:3 G:6 H:4 S:1 |
| 10983: | B:2 H:2 N:1 O:1 P:1 S:2 V:1 AA:2 AC:1 |
| 10984: | P:2 S:1 AA:2 |
| 10985: | B:3 K:1 S:1 |
| 10986: | B:3 K:1 S:1 |
| 10987: | D:1 O:1 |

TABLE II-continued

| SEQ ID NO. | Spatial Distribution |
|---|---|
| 10988: | P:2 X:2 |
| 10989: | B:3 C:2 G:1 H:36 J:4 K:2 N:2 O:5 P:11 S:15 U:1 V:2 Z:1 AC:2 AD:2 |
| 10990: | B:3 C:5 E:3 G:1 H:10 K:4 L:3 O:4 Q:1 S:2 T:1 |
| 10991: | AA:3 |
| 10992: | T:6 |
| 10993: | A:3 B:1 G:3 H:5 N:1 P:1 S:2 W:3 Y:1 AA:2 |
| 10994: | A:1 B:3 G:3 H:5 N:3 P:1 S:4 W:5 Y:2 AA:4 |
| 10995: | A:2 B:1 G:3 H:5 N:1 P:1 S:2 W:3 Y:1 AA:2 |
| 10996: | B:2 |
| 10997: | B:23 C:12 D:3 E:4 G:26 H:9 K:3 N:1 O:5 P:7 Q:9 R:2 S:7 U:1 W:1 X:1 Y:4 Z:2 AA:5 AC:4 |
| 10998: | B:30 C:16 D:3 E:12 G:37 H:14 K:7 N:1 O:5 P:14 Q:23 R:2 S:14 U:3 W:3 X:3 Y:12 Z:3 AA:5 AC:11 |
| 10999: | Y:3 |
| 11000: | P:2 |
| 11001: | A:2 B:33 C:19 E:2 G:30 H:16 I:4 J:6 K:9 N:4 O:4 P:4 Q:5 R:12 S:27 T:6 W:4 Y:15 Z:9 AA:27 AC:10 AD:2 |
| 11002: | A:2 B:33 C:19 E:2 G:30 H:16 I:4 J:6 K:9 N:4 O:4 P:4 Q:5 R:12 S:27 T:6 W:4 Y:15 Z:9 AA:27 AC:10 AD:2 |
| 11003: | A:1 B:18 C:12 E:1 G:19 H:9 I:3 J:4 K:5 N:3 O:2 P:2 Q:3 R:6 S:16 T:3 W:3 Y:9 Z:6 AA:15 AC:6 AD:1 |
| 11004: | A:1 B:18 C:12 E:1 G:19 H:9 I:3 J:4 K:5 N:3 O:2 P:2 Q:3 R:6 S:16 T:3 W:3 Y:9 Z:6 AA:15 AC:6 AD:1 |
| 11005: | A:2 B:27 C:11 E:1 G:22 H:10 I:4 J:3 K:7 N:3 O:3 P:3 Q:4 R:8 S:18 T:4 W:3 Y:10 Z:6 AA:13 AC:8 AD:2 |
| 11006: | A:2 B:27 C:11 E:1 G:22 H:10 I:4 J:3 K:7 N:3 O:3 P:3 Q:4 R:8 S:18 T:4 W:3 Y:10 Z:6 AA:13 AC:8 AD:2 |
| 11007: | B:1 K:1 |
| 11008: | AA:4 |
| 11009: | B:5 |
| 11010: | G:2 |
| 11011: | A:1 B:12 C:39 E:2 F:5 G:11 H:22 I:3 J:1 K:18 N:1 O:7 P:18 Q:3 R:4 S:30 T:10 U:2 V:1 W:3 X:4 Y:3 Z:3 AA:13 AC:7 AD:13 |
| 11012: | T:2 |
| 11013: | C:1 Y:1 |
| 11014: | K:2 |
| 11015: | B:6 C:2 D:1 F:2 G:1 H:1 S:2 T:6 W:4 Y:1 AA:9 AC:1 |
| 11016: | W:4 |
| 11017: | B:3 H:2 |
| 11018: | B:2 H:1 |
| 11019: | B:4 |
| 11020: | C:4 S:2 |
| 11021: | X:4 |
| 11022: | J:3 |
| 11023: | S:2 |
| 11024: | AD:2 |
| 11025: | B:2 H:1 |
| 11026: | K:2 T:2 |
| 11027: | B:1 Y:1 AA:1 |
| 11028: | AA:4 |
| 11029: | B:5 |
| 11030: | Y:4 |
| 11031: | B:11 C:6 E:1 F:4 G:12 H:14 I:2 K:1 L:1 O:3 P:8 R:3 S:1 T:16 U:9 W:4 X:2 Y:4 AC:8 AD:9 |
| 11032: | G:2 H:1 |
| 11033: | S:8 |
| 11034: | B:3 G:1 T:1 X:2 AA:1 |
| 11035: | K:2 |
| 11036: | B:2 O:2 R:2 Y:1 AA:6 AD:4 |
| 11037: | B:4 O:1 |
| 11038: | K:2 AA:10 |
| 11039: | K:1 AA:8 |
| 11040: | AA:16 |
| 11041: | AA:16 |
| 11042: | AA:25 |
| 11043: | H:1 I:3 T:1 AC:4 |
| 11044: | H:1 P:2 |
| 11045: | H:1 T:3 |
| 11046: | AA:3 |
| 11047: | B:2 D:2 G:2 N:2 O:2 Q:3 S:2 Z:1 AA:2 |
| 11048: | B:3 D:4 G:1 N:2 O:2 Q:1 S:2 Z:2 AA:1 |
| 11049: | B:1 D:3 G:2 N:2 O:3 Q:4 S:3 Z:2 AA:1 |
| 11050: | T:2 |
| 11051: | K:1 P:2 |
| 11052: | B:40 C:64 D:6 E:1 F:2 G:26 H:53 I:1 J:3 K:15 N:4 O:13 P:32 Q:10 R:7 S:34 T:1 U:1 W:13 X:2 Y:21 Z:7 AA:20 AB:2 AC:7 AD:3 |
| 11053: | H:4 |
| 11054: | O:2 |
| 11055: | C:1 O:3 AC:1 |
| 11056: | AA:4 |
| 11057: | B:2 H:2 N:1 |
| 11058: | B:2 H:2 N:1 |
| 11059: | B:8 C:1 D:2 E:2 H:2 T:1 Y:2 |
| 11060: | B:5 C:4 D:3 E:4 H:4 T:1 Y:2 |
| 11061: | T:3 V:1 AA:1 |
| 11062: | B:3 E:1 T:1 |
| 11063: | AA:3 |
| 11064: | AA:2 |
| 11065: | W:2 |
| 11066: | F:1 Y:1 |
| 11067: | B:2 |
| 11068: | B:5 E:1 K:3 P:1 S:3 V:2 |
| 11069: | A:2 L:1 N:2 T:2 |
| 11070: | B:2 |
| 11071: | AA:3 |
| 11072: | J:1 K:2 N:1 T:2 AA:2 AB:1 |
| 11073: | H:2 |
| 11074: | C:1 K:1 S:8 |
| 11075: | B:2 |
| 11076: | T:2 |
| 11077: | X:4 |
| 11078: | O:2 |
| 11079: | G:3 |
| 11080: | H:3 O:1 P:2 R:1 W:1 |
| 11081: | B:2 W:1 Y:5 |
| 11082: | B:2 AA:1 |
| 11083: | AA:3 |
| 11084: | B:25 C:72 D:8 E:4 F:9 G:23 H:44 I:4 J:22 K:18 L:1 N:9 O:10 P:44 Q:4 R:9 S:50 T:17 U:3 V:3 W:11 X:2 Y:13 Z:8 AA:27 AD:29 |
| 11085: | B:14 C:32 D:4 E:2 F:5 G:12 H:24 I:2 J:10 K:11 L:1 N:4 O:5 P:23 Q:2 R:6 S:21 T:10 U:2 V:1 W:6 X:1 Y:7 Z:6 AA:18 AD:14 |
| 11086: | B:2 C:1 I:2 AC:1 |
| 11087: | P:44 |
| 11088: | E:2 |

TABLE II-continued

| SEQ ID NO. | Spatial Distribution |
|---|---|
| 11089: | B:4 |
| 11090: | B:1 C:2 F:4 G:4 H:3 I:2 J:2 K:1 P:3 R:4 T:2 Y:14 AA:4 AD:1 |
| 11091: | T:2 |
| 11092: | C:1 P:1 T:1 AA:2 |
| 11093: | AA:2 |
| 11094: | B:2 |
| 11095: | AA:2 |
| 11096: | C:1 S:4 |
| 11097: | E:1 O:1 |
| 11098: | O:2 S:1 AC:1 |
| 11099: | B:1 C:4 G:3 H:3 J:3 K:1 N:2 O:2 P:2 Q:1 R:1 S:2 U:3 Z:4 AA:5 AD:2 |
| 11100: | B:1 C:4 G:3 H:4 J:3 K:1 N:2 O:2 P:2 Q:2 R:1 S:5 U:3 Z:4 AA:5 AD:2 |
| 11101: | T:3 |
| 11102: | G:1 H:3 K:1 L:1 W:1 Z:1 AA:2 AC:1 |
| 11103: | B:2 H:1 |
| 11104: | P:2 |
| 11105: | AA:2 |
| 11106: | P:2 |
| 11107: | P:2 |
| 11108: | B:2 K:2 |
| 11109: | B:1 C:3 G:1 H:8 K:2 O:1 P:2 S:2 T:4 AA:2 |
| 11110: | B:1 C:3 G:1 H:5 K:2 O:1 P:2 S:2 T:4 AA:1 |
| 11111: | B:3 C:9 G:2 H:11 K:6 O:2 P:3 S:6 T:7 AA:3 |
| 11112: | AA:3 |
| 11113: | B:3 |
| 11114: | B:1 C:2 D:1 E:13 F:12 G:3 J:2 L:22 N:24 O:29 Q:1 T:15 AA:1 |
| 11115: | B:1 C:1 D:1 E:13 F:11 G:2 J:2 L:21 N:20 O:29 Q:1 T:12 AA:1 |
| 11116: | B:2 C:1 D:2 E:24 F:21 G:5 J:4 L:39 N:40 O:56 Q:2 T:26 AA:1 |
| 11117: | C:1 E:3 F:4 L:1 T:3 W:2 AA:2 |
| 11118: | C:2 E:4 F:3 L:2 T:2 W:3 AA:2 |
| 11119: | C:1 E:3 F:3 L:1 T:3 W:2 AA:2 |
| 11120: | O:2 AA:1 |
| 11121: | O:1 S:1 V:1 |
| 11122: | P:3 Y:1 AA:1 |
| 11123: | H:2 K:18 |
| 11124: | O:3 S:1 |
| 11125: | F:2 G:2 |
| 11126: | H:3 W:1 AC:2 |
| 11127: | AA:4 |
| 11128: | C:1 G:1 H:1 |
| 11129: | B:3 |
| 11130: | B:2 C:4 S:3 T:2 |
| 11131: | U:3 |
| 11132: | B:6 C:1 G:8 H:16 R:1 S:4 V:1 |
| 11133: | B:5 C:1 G:5 H:8 R:1 S:2 V:1 |
| 11134: | B:5 C:2 G:6 H:9 R:1 S:2 V:1 |
| 11135: | B:9 C:1 G:10 H:22 R:2 S:4 V:2 |
| 11136: | B:1 H:1 S:2 Y:2 |
| 11137: | B:2 G:2 Q:1 S:1 V:1 AA:1 |
| 11138: | Q:5 |
| 11139: | T:1 U:1 |
| 11140: | W:1 Y:3 |
| 11141: | B:5 H:4 S:8 W:1 Y:1 AC:2 |
| 11142: | B:5 H:4 S:8 W:1 Y:1 AC:2 |
| 11143: | AA:3 |
| 11144: | AA:2 |

| SEQ ID NO. | Spatial Distribution |
|---|---|
| 11145: | C:1 O:2 W:1 |
| 11146: | C:1 AA:1 |
| 11147: | H:3 AA:1 |
| 11148: | G:1 W:1 |
| 11149: | T:3 |
| 11150: | B:8 P:1 |
| 11151: | AD:2 |
| 11152: | P:1 W:1 Y:1 |
| 11153: | B:4 C:1 E:1 H:2 T:3 AC:2 |
| 11154: | B:4 C:1 E:1 H:3 T:3 AC:2 |
| 11155: | B:4 C:1 E:1 H:3 T:3 AC:3 |
| 11156: | B:1 C:1 H:1 P:3 |
| 11157: | Q:1 S:1 X:1 |
| 11158: | B:5 C:2 G:1 H:2 I:1 K:2 N:2 R:1 S:1 U:1 W:1 Y:3 Z:1 AA:1 AB:1 AC:1 |
| 11159: | J:1 T:1 |
| 11160: | H:1 AA:1 |
| 11161: | F:3 J:1 N:1 P:2 T:2 AA:2 AC:1 |
| 11162: | Y:2 |
| 11163: | B:3 T:2 Y:1 |
| 11164: | B:8 C:4 G:5 H:9 J:2 K:4 N:1 O:6 P:6 Q:2 R:3 S:8 T:5 W:1 X:2 Y:1 AA:6 AD:2 |
| 11165: | B:7 C:4 G:4 H:9 J:2 K:4 N:1 O:6 P:6 Q:2 R:3 S:8 T:5 W:1 X:2 Y:1 AA:6 AD:2 |
| 11166: | B:10 C:4 G:5 H:10 J:2 K:5 N:1 O:7 P:8 Q:3 R:3 S:8 T:5 W:1 X:3 Y:1 AA:8 AD:1 |
| 11167: | B:9 C:4 G:5 H:9 J:2 K:5 N:1 O:6 P:6 Q:2 R:2 S:7 T:5 W:1 X:3 Y:1 AA:3 AD:1 |
| 11168: | H:3 |
| 11169: | G:7 |
| 11170: | B:1 S:1 |
| 11171: | X:2 |
| 11172: | B:18 C:52 D:8 E:20 F:2 G:39 H:60 I:4 J:6 K:31 N:4 O:10 P:14 Q:4 R:7 S:59 T:47 U:2 W:4 Y:12 Z:9 AA:11 AC:20 AD:7 |
| 11173: | B:17 C:49 D:8 E:17 F:2 G:36 H:55 I:4 J:5 K:27 N:4 O:8 P:14 Q:4 R:5 S:57 T:44 U:2 W:3 Y:12 Z:10 AA:10 AC:20 AD:5 |
| 11174: | B:21 C:50 D:9 E:18 F:2 G:35 H:64 I:4 J:4 K:35 N:4 O:10 P:1 Q:2 R:9 S:62 T:45 U:3 W:4 Y:14 Z:8 AA:12 AC:24 AD:8 |
| 11175: | B:18 C:52 D:8 E:18 F:2 G:37 H:60 I:4 J:5 K:31 N:4 O:8 P:14 Q:4 R:7 S:61 T:47 U:2 W:4 Y:12 Z:10 AA:10 AC:20 AD:7 |
| 11176: | B:21 C:55 D:10 E:17 F:2 G:37 H:73 I:5 J:6 K:33 N:4 O:10 P:15 Q:3 R:7 S:69 T:47 U:3 W:3 Y:16 Z:9 AA:13 AC:23 AD:8 |
| 11177: | B:17 C:45 D:8 E:17 F:2 G:32 H:54 I:4 J:5 K:29 N:4 O:8 P:14 Q:3 R:6 S:56 T:43 U:2 W:3 Y:12 Z:9 AA:10 AC:18 AD:5 |
| 11178: | B:18 C:47 D:8 E:18 F:2 G:33 H:59 I:4 J:5 K:32 N:4 O:8 P:14 Q:3 R:8 S:59 T:45 U:2 W:4 Y:12 Z:9 AA:10 AC:18 AD:7 |
| 11179: | B:16 C:45 D:6 E:12 F:1 G:28 H:53 I:3 J:4 K:23 N:2 O:9 P:8 Q:2 R:5 S:46 T:34 U:2 |

TABLE II-continued

| SEQ ID NO. | Spatial Distribution |
|---|---|
| | W:2 Y:10 Z:7 AA:9 AC:17 AD:7 |
| 11180: | B:12 C:36 D:4 E:12 F:1 G:22 H:34 I:2 J:3 K:19 N:2 O:7 P:7 Q:2 R:4 S:33 T:29 U:1 W:2 Y:6 Z:7 AA:6 AC:12 AD:4 |
| 11181: | B:13 C:38 D:4 E:13 F:1 G:23 H:41 I:2 J:3 K:23 N:2 O:7 P:7 Q:2 R:6 S:36 T:31 U:1 W:3 Y:6 Z:7 AA:7 AC:12 AD:6 |
| 11182: | H:1 O:1 S:2 |
| 11183: | H:1 AD:1 |
| 11184: | B:1 Y:1 AA:1 |
| 11185: | B:24 C:68 D:1 E:16 F:8 G:20 H:46 I:2 J:6 K:26 N:2 O:12 P:44 Q:4 R:9 S:41 T:45 U:2 V:5 W:11 X:9 Y:10 Z:10 AA:18 AC:8 AD:23 |
| 11186: | B:23 C:63 D:1 E:16 F:8 G:20 H:47 I:2 J:6 K:26 N:2 O:12 P:43 Q:4 R:10 S:39 T:44 U:2 V:5 W:11 X:9 Y:10 Z:10 AA:16 AC:8 AD:24 |
| 11187: | B:23 C:69 D:1 E:15 F:8 G:18 H:44 I:2 J:6 K:26 N:2 O:12 P:42 Q:4 R:9 S:38 T:43 U:2 V:5 W:11 X:9 Y:10 Z:10 AA:15 AC:8 AD:23 |
| 11188: | B:23 C:67 D:1 E:15 F:8 G:19 H:44 I:2 J:5 K:25 N:2 O:12 P:44 Q:4 R:8 S:38 T:43 U:2 V:5 W:11 X:9 Y:10 Z:10 AA:16 AC:8 AD:23 |
| 11189: | AD:3 |
| 11190: | B:2 |
| 11191: | B:5 G:2 W:1 |
| 11192: | A:2 B:30 C:74 D:4 E:37 F:5 G:32 H:88 I:5 J:10 K:35 L:2 N:7 O:24 P:50 Q:14 R:11 S:37 T:29 U:3 V:4 W:16 X:10 Y:8 Z:17 AA:43 AC:28 AD:20 |
| 11193: | A:2 B:30 C:54 D:4 E:35 F:5 G:27 H:70 I:5 J:9 K:21 L:2 N:5 O:22 P:41 Q:14 R:7 S:32 T:26 U:3 V:4 W:12 X:10 Y:8 Z:14 AA:36 AC:25 AD:17 |
| 11194: | B:4 G:2 K:1 |
| 11195: | B:2 |
| 11196: | AA:5 |
| 11197: | AA:2 |
| 11198: | B:1 H:1 S:1 |
| 11199: | C:1 K:1 O:5 Q:1 S:1 X:1 AA:4 |
| 11200: | AD:2 |
| 11201: | H:1 J:1 |
| 11202: | B:4 C:2 H:3 K:2 S:2 Z:2 AA:3 AD:1 |
| 11203: | P:4 |
| 11204: | B:2 F:1 G:1 H:3 AC:1 AD:1 |
| 11205: | W:6 |
| 11206: | G:1 H:5 R:1 U:1 |
| 11207: | F:1 R:3 |
| 11208: | T:2 |
| 11209: | D:3 |
| 11210: | AA:2 |
| 11211: | B:3 C:2 G:6 H:5 N:3 S:5 W:3 Y:3 |
| 11212: | O:2 |
| 11213: | T:2 |
| 11214: | B:2 C:2 |
| 11215: | O:2 |
| 11216: | C:2 |
| 11217: | B:3 |
| 11218: | B:1 P:1 W:3 Y:1 |
| 11219: | B:1 Y:1 |
| 11220: | D:5 |
| 11221: | B:1 C:2 H:4 R:1 S:1 T:1 W:2 Y:1 AA:2 AC:1 |
| 11222: | B:2 C:4 H:7 R:2 S:2 T:1 W:4 Y:2 AA:4 AC:2 |
| 11223: | B:2 |
| 11224: | B:2 |
| 11225: | B:2 P:1 U:3 W:1 AD:1 |
| 11226: | B:2 H:2 Q:1 |
| 11227: | W:4 |
| 11228: | K:1 W:1 |
| 11229: | P:3 |
| 11230: | W:2 |
| 11231: | E:1 H:3 |
| 11232: | AA:2 |
| 11233: | B:2 W:1 |
| 11234: | AA:3 |
| 11235: | AA:2 |
| 11236: | B:2 |
| 11237: | U:8 |
| 11238: | AA:3 |
| 11239: | C:3 Z:1 |
| 11240: | J:1 S:1 AA:1 |
| 11241: | AA:4 |
| 11242: | B:5 C:2 G:2 P:1 S:1 W:3 X:2 Y:2 AD:1 |
| 11243: | A:4 B:51 C:155 D:2 E:24 F:5 G:77 H:90 I:4 J:10 K:70 L:1 N:15 O:19 P:52 Q:10 R:16 S:118 T:29 U:5 V:8 W:9 X:16 Y:14 Z:6 AA:22 AC:14 AD:45 |
| 11244: | A:4 B:49 C:140 D:1 E:24 F:5 G:71 H:80 I:4 J:10 K:63 L:1 N:15 O:19 P:46 Q:9 R:15 S:101 T:28 U:5 V:8 W:8 X:16 Y:14 Z:6 AA:19 AC:14 AD:38 |
| 11245: | A:4 B:49 C:148 D:1 E:24 F:5 G:74 H:83 I:4 J:10 K:68 L:1 N:15 O:19 P:49 Q:10 R:15 S:113 T:28 U:5 V:8 W:8 X:16 Y:14 Z:6 AA:20 AC:14 AD:42 |
| 11246: | Z:1 AC:1 |
| 11247: | F:1 O:1 Q:1 V:2 X:2 AA:3 |
| 11248: | F:1 O:1 Q:1 V:2 X:1 AA:3 |
| 11249: | F:1 G:1 L:1 O:1 AC:3 |
| 11250: | F:2 G:3 L:1 O:2 AC:1 |
| 11251: | B:1 E:1 |
| 11252: | C:2 H:4 S:1 Y:4 AC:1 |
| 11253: | B:1 O:1 |
| 11254: | K:5 |
| 11255: | B:4 |
| 11256: | B:2 D:2 G:4 H:4 T:2 X:2 Y:1 |
| 11257: | I:1 P:2 |
| 11258: | B:2 |
| 11259: | Z:2 |
| 11260: | T:3 |
| 11261: | X:2 |
| 11262: | T:3 |
| 11263: | G:3 |
| 11264: | B:2 W:1 |
| 11265: | W:3 |
| 11266: | C:1 K:1 |
| 11267: | R:4 |
| 11268: | A:1 B:62 C:99 D:5 E:20 F:5 G:104 H:91 I:2 J:23 K:34 N:14 O:20 P:104 Q:37 R:30 S:71 T:17 U:2 V:7 W:21 X:18 Y:26 Z:22 AA:82 AB:1 AC:25 AD:43 |
| 11269: | A:1 B:62 C:99 D:5 E:20 F:5 G:105 H:91 I:2 J:23 K:34 N:14 O:20 P:104 Q:37 R:30 S:71 T:17 U:2 V:7 W:21 |

TABLE II-continued

| SEQ ID NO. | Spatial Distribution |
|---|---|
| | X:18 Y:26 Z:22 AA:82 AB:1 AC:25 AD:43 |
| 11270: | A:1 B:62 C:99 D:5 E:20 F:5 G:106 H:91 I:2 J:23 K:34 N:14 O:20 P:104 Q:37 R:30 S:71 T:17 U:2 V:7 W:21 X:18 Y:26 Z:22 AA:82 AB:1 AC:25 AD:43 |
| 11271: | A:1 B:62 C:93 D:6 E:22 F:5 G:100 H:73 I:2 J:22 K:35 N:12 O:19 P:93 Q:36 R:26 S:63 T:18 U:2 V:6 W:16 X:17 Y:25 Z:19 AA:79 AB:1 AC:24 AD:36 |
| 11272: | A:1 B:62 C:93 D:6 E:21 F:5 G:100 H:72 I:2 J:22 K:35 N:12 O:21 P:94 Q:36 R:26 S:63 T:18 U:2 V:6 W:16 X:17 Y:25 Z:19 AA:79 AB:1 AC:24 AD:36 |
| 11273: | A:1 B:60 C:92 D:5 E:19 F:5 G:96 H:78 I:2 J:20 K:36 N:11 O:17 P:91 Q:36 R:26 S:64 T:16 U:2 V:7 W:17 X:18 Y:25 Z:20 AA:76 AB:1 AC:24 AD:38 |
| 11274: | A:1 B:60 C:92 D:5 E:18 F:5 G:96 H:78 I:2 J:20 K:36 N:11 O:19 P:91 Q:36 R:26 S:64 T:16 U:2 V:7 W:17 X:18 Y:25 Z:20 AA:76 AB:1 AC:24 AD:38 |
| 11275: | G:1 S:1 Z:1 AD:1 |
| 11276: | B:3 G:1 T:1 AA:2 |
| 11277: | B:4 |
| 11278: | B:2 |
| 11279: | AA:4 |
| 11280: | C:4 H:4 K:1 O:2 P:1 R:1 S:2 V:4 W:2 Z:1 AC:1 |
| 11281: | AC:2 |
| 11282: | C:1 F:1 AC:1 |
| 11283: | O:1 AC:2 |
| 11284: | AA:4 |
| 11285: | AA:2 |
| 11286: | AA:3 |
| 11287: | AA:2 |
| 11288: | AA:2 |
| 11289: | T:2 |
| 11290: | AA:3 |
| 11291: | A:2 B:32 C:27 D:7 E:3 F:5 G:36 H:39 I:3 J:2 K:4 N:3 O:3 P:13 Q:10 R:7 S:15 T:1 V:2 W:2 X:2 Y:1 Z:6 AA:8 AC:2 AD:7 |
| 11292: | A:2 B:29 C:27 D:7 E:3 F:5 G:35 H:39 I:3 J:2 K:4 N:3 O:3 P:13 Q:10 R:7 S:15 T:1 V:2 W:2 X:2 Y:1 Z:6 AA:8 AC:2 AD:7 |
| 11293: | B:3 C:5 E:1 G:1 H:4 P:1 S:1 Y:1 |
| 11294: | B:15 C:19 D:2 E:8 F:13 G:11 H:34 J:2 K:12 L:1 N:2 O:7 P:22 Q:6 S:11 T:23 W:1 X:15 Y:4 Z:2 AA:21 AC:7 AD:10 |
| 11295: | B:15 C:19 D:2 E:8 F:13 G:11 H:34 J:2 K:12 L:1 N:2 O:7 P:22 Q:6 S:11 T:23 W:1 X:15 Y:4 Z:2 AA:21 AC:7 AD:10 |
| 11296: | B:15 C:19 D:2 E:8 F:13 G:11 H:34 J:2 K:12 L:1 N:2 O:7 P:22 Q:6 S:12 T:23 W:1 X:15 Y:5 Z:2 AA:21 AC:7 AD:10 |
| 11297: | B:19 C:27 D:3 E:13 F:19 G:14 H:51 J:2 K:17 L:2 N:3 O:11 P:31 Q:10 S:16 T:38 W:2 X:19 Y:5 Z:4 AA:33 AC:10 AD:19 |
| 11298: | B:19 C:27 D:3 E:13 F:19 G:14 H:51 J:2 K:17 L:2 N:3 O:11 P:31 Q:10 S:16 T:38 W:2 X:19 Y:5 Z:4 AA:33 AC:10 AD:19 |
| 11299: | B:19 C:27 D:3 E:13 F:19 G:14 H:51 J:2 K:17 L:2 N:3 O:11 P:31 Q:10 S:17 T:38 W:2 X:19 Y:6 Z:4 AA:33 AC:10 AD:19 |
| 11300: | B:1 C:1 Y:1 |
| 11301: | F:2 |
| 11302: | B:26 C:11 E:3 F:6 G:10 H:9 J:6 O:3 P:3 R:3 S:3 U:3 Y:6 AA:3 |
| 11303: | B:25 C:3 D:1 E:1 F:3 G:6 J:1 K:5 N:1 O:1 P:2 R:1 S:2 T:2 W:2 X:1 Y:1 Z:1 AA:1 AC:2 AD:1 |
| 11304: | B:25 C:3 D:1 E:1 F:3 G:6 J:1 K:5 N:1 O:1 P:2 R:1 S:2 T:2 W:2 X:1 Y:1 Z:1 AA:1 AC:2 AD:1 |
| 11305: | B:3 |
| 11306: | H:3 S:2 |
| 11307: | B:2 C:2 K:2 N:3 O:2 P:1 S:5 W:1 |
| 11308: | AA:9 |
| 11309: | G:5 H:3 P:1 Q:2 S:3 |
| 11310: | P:3 |
| 11311: | S:2 |
| 11312: | G:1 Y:2 |
| 11313: | P:3 |
| 11314: | F:1 AA:1 |
| 11315: | B:1 S:2 |
| 11316: | H:6 AA:1 |
| 11317: | B:2 |
| 11318: | D:2 G:1 W:2 |
| 11319: | H:1 AD:1 |
| 11320: | B:100 W:1 |
| 11321: | B:2 AA:1 |
| 11322: | B:1 G:2 S:1 AA:1 |
| 11323: | B:2 |
| 11324: | B:11 C:7 D:4 E:3 F:3 G:6 H:3 I:1 J:1 N:1 O:3 P:6 Q:2 R:10 S:2 T:3 V:1 W:5 X:1 Y:10 AA:3 AC:1 AD:2 |
| 11325: | R:4 |
| 11326: | K:1 Y:1 |
| 11327: | T:3 |
| 11328: | B:1 W:3 Y:1 |
| 11329: | C:1 G:1 |
| 11330: | H:1 N:1 W:2 |
| 11331: | B:3 E:1 T:1 V:1 W:2 Y:3 Z:1 |
| 11332: | B:2 E:1 T:1 V:1 W:2 Y:1 Z:1 |
| 11333: | B:2 |
| 11334: | C:1 AA:1 |
| 11335: | G:4 H:1 |
| 11336: | X:3 |
| 11337: | B:2 Y:1 |
| 11338: | AA:2 |
| 11339: | B:4 |
| 11340: | B:6 C:2 O:2 S:2 AA:1 |
| 11341: | B:1 N:2 P:2 R:1 S:1 |
| 11342: | B:1 Y:5 |
| 11343: | B:5 C:3 F:1 G:4 H:2 K:1 N:1 S:2 W:1 X:1 |
| 11344: | T:4 |
| 11345: | B:59 C:235 D:7 E:6 F:8 G:84 H:162 I:6 J:23 K:215 N:13 O:33 P:71 Q:22 R:22 S:213 T:36 U:24 V:5 W:21 X:16 |

TABLE II-continued

| SEQ ID NO. | Spatial Distribution |
|---|---|
| | Y:22 Z:14 AA:93 AB:2 AC:33 AD:91 |
| 11346: | B:49 C:195 D:7 E:6 F:4 G:65 H:124 I:3 J:14 K:178 N:9 O:27 P:51 Q:15 R:18 S:179 T:23 U:16 V:4 W:20 X:13 Y:15 Z:10 AA:76 AB:2 AC:20 AD:73 |
| 11347: | B:48 C:196 D:7 E:6 F:5 G:66 H:122 I:3 J:14 K:178 N:9 O:27 P:52 Q:14 R:18 S:181 T:24 U:16 V:4 W:21 X:13 Y:15 Z:10 AA:76 AB:2 AC:20 AD:73 |
| 11348: | B:60 C:236 D:7 E:6 F:7 G:84 H:163 I:6 J:23 K:215 N:13 O:33 P:71 Q:23 R:22 S:211 T:34 U:24 V:5 W:20 X:16 Y:22 Z:14 AA:93 AB:2 AC:33 AD:91 |
| 11349: | C:2 G:4 K:6 S:1 Y:1 Z:1 AA:4 |
| 11350: | C:2 G:4 K:6 S:1 Y:2 Z:2 AA:4 |
| 11351: | B:4 F:1 G:2 W:1 |
| 11352: | B:3 |
| 11353: | T:4 |
| 11354: | H:2 AA:58 |
| 11355: | B:9 D:3 G:2 H:8 K:3 P:7 Q:1 S:3 T:13 W:2 X:1 AA:1 AC:1 |
| 11356: | B:15 D:5 G:3 H:7 K:5 P:11 Q:2 S:5 T:17 W:2 X:2 AA:2 AC:2 |
| 11357: | B:3 |
| 11358: | T:3 |
| 11359: | B:2 |
| 11360: | H:3 |
| 11361: | W:2 |
| 11362: | L:2 S:2 |
| 11363: | V:4 |
| 11364: | B:8 C:6 G:5 H:5 Q:1 S:4 T:1 X:2 |
| 11365: | B:42 C:16 E:4 F:1 G:8 H:16 I:4 J:16 K:7 N:1 O:4 P:15 Q:2 R:6 S:16 T:13 U:1 V:2 W:11 X:3 Y:21 Z:3 AA:16 AC:6 AD:7 |
| 11366: | T:2 |
| 11367: | K:2 |
| 11368: | G:1 O:1 |
| 11369: | T:4 |
| 11370: | H:2 S:2 |
| 11371: | B:2 C:14 E:5 F:2 G:6 H:19 J:2 K:9 N:2 O:3 P:8 Q:9 S:15 T:9 W:5 X:2 Y:1 Z:3 AA:15 AC:1 AD:9 |
| 11372: | B:2 C:11 E:5 F:2 G:3 H:14 J:1 K:5 N:2 O:2 P:7 Q:9 S:14 T:8 W:3 X:2 Y:1 Z:2 AA:14 AC:1 AD:6 |
| 11373: | A:2 B:4 G:3 H:4 I:1 K:2 O:4 P:3 Q:1 T:1 W:1 X:3 Y:7 AA:6 AC:2 AD:5 |
| 11374: | A:1 B:4 G:3 H:3 I:1 K:2 O:3 P:2 Q:1 T:1 W:1 X:2 Y:7 AA:5 AC:2 AD:4 |
| 11375: | B:1 E:1 F:1 O:1 |
| 11376: | B:3 |
| 11377: | B:2 |
| 11378: | A:1 B:2 C:1 G:2 H:2 J:1 O:2 P:3 Q:1 S:1 T:2 X:1 Z:1 AA:2 |
| 11379: | A:1 B:3 C:3 G:3 H:3 J:2 O:7 P:1 Q:2 R:2 S:1 T:2 U:2 Z:2 AA:1 AD:2 |
| 11380: | X:2 |
| 11381: | AA:2 |
| 11382: | T:3 |
| 11383: | T:2 W:1 |
| 11384: | B:1 S:2 T:1 AC:1 |
| 11385: | B:1 S:1 T:1 AC:2 |
| 11386: | B:3 H:1 O:1 W:1 AC:2 AD:1 |
| 11387: | B:3 H:1 O:1 W:1 AC:2 AD:1 |
| 11388: | B:3 H:1 O:1 W:1 AC:3 AD:1 |
| 11389: | S:3 |
| 11390: | B:7 S:3 T:1 Y:1 AA:2 AD:3 |
| 11391: | B:3 G:2 O:1 X:1 AA:1 |
| 11392: | Y:2 |
| 11393: | I:1 O:4 U:1 |
| 11394: | N:1 O:1 |
| 11395: | B:2 G:3 H:2 R:1 S:1 W:1 |
| 11396: | G:2 |
| 11397: | T:3 |
| 11398: | T:2 |
| 11399: | G:1 R:2 AC:1 |
| 11400: | S:2 |
| 11401: | S:2 |
| 11402: | S:2 |
| 11403: | T:2 |
| 11404: | N:4 |
| 11405: | B:1 C:6 H:1 I:2 P:1 Y:1 AA:3 |
| 11406: | W:2 |
| 11407: | H:6 |
| 11408: | K:1 AA:3 |
| 11409: | U:3 |
| 11410: | B:3 Y:1 |
| 11411: | O:1 Q:1 |
| 11412: | F:2 Y:1 |
| 11413: | T:2 |
| 11414: | H:2 Q:1 S:2 |
| 11415: | K:1 T:1 |
| 11416: | B:6 C:8 H:1 J:1 K:1 O:1 P:1 Q:3 S:7 Y:1 |
| 11417: | B:4 |
| 11418: | C:1 H:2 R:1 Y:2 |
| 11419: | B:1 D:2 Y:2 |
| 11420: | X:3 |
| 11421: | A:3 B:14 C:31 D:2 E:8 G:21 H:50 I:1 J:1 K:37 N:2 O:3 P:16 Q:7 S:37 T:19 U:8 V:1 W:3 X:6 Y:1 AA:12 AB:1 AC:8 AD:9 |
| 11422: | T:4 |
| 11423: | AA:5 |
| 11424: | B:2 |
| 11425: | F:2 |
| 11426: | W:3 Y:1 |
| 11427: | B:3 |
| 11428: | S:1 AA:1 |
| 11429: | AA:2 |
| 11430: | B:1 W:1 |
| 11431: | B:1 C:1 X:1 AC:1 |
| 11432: | B:5 C:1 K:2 |
| 11433: | Y:3 |
| 11434: | T:2 |
| 11435: | B:3 H:2 Y:1 |
| 11436: | A:4 G:1 J:1 X:4 AA:4 |
| 11437: | A:4 G:1 J:1 X:4 AA:4 |
| 11438: | B:1 C:2 H:5 W:1 AD:1 |
| 11439: | B:1 F:1 H:3 P:1 T:3 |
| 11440: | C:1 W:3 |
| 11441: | G:1 X:1 |
| 11442: | H:1 S:1 |
| 11443: | H:3 K:1 N:1 T:2 AA:2 |
| 11444: | H:2 K:1 N:1 T:2 AA:1 |
| 11445: | H:4 K:1 N:1 T:2 AA:1 |
| 11446: | W:3 |
| 11447: | B:2 C:2 F:3 G:6 H:3 K:3 N:2 O:4 P:3 Q:16 R:2 S:2 T:8 X:4 Y:6 AA:3 |

TABLE II-continued

| SEQ ID NO. | Spatial Distribution |
|---|---|
| 11448: | B:2 C:1 F:4 G:6 H:3 K:2 N:2 O:2 P:3 Q:10 R:3 S:2 T:7 X:2 Y:3 AA:3 |
| 11449: | B:1 C:2 F:4 G:7 H:4 K:3 N:2 O:4 P:3 Q:17 R:3 S:3 T:7 X:4 Y:6 AA:3 |
| 11450: | J:1 X:1 |
| 11451: | T:3 |
| 11452: | B:2 V:1 |
| 11453: | B:2 C:1 H:2 O:2 S:2 T:2 Y:2 AA:1 AC:1 |
| 11454: | P:8 |
| 11455: | H:1 K:1 |
| 11456: | Y:23 |
| 11457: | B:1 S:2 |
| 11458: | AD:3 |
| 11459: | P:2 |
| 11460: | G:3 |
| 11461: | B:3 H:3 W:2 |
| 11462: | AA:3 |
| 11463: | T:2 |
| 11464: | B:11 C:2 E:1 H:7 K:2 N:3 S:1 T:9 W:1 AA:29 AC:1 |
| 11465: | B:11 C:3 E:1 H:7 K:2 N:3 S:1 T:9 W:1 AA:29 AC:1 |
| 11466: | T:2 |
| 11467: | X:2 Y:1 AA:1 AD:1 |
| 11468: | X:2 Y:1 AA:1 AD:1 |
| 11469: | G:1 AA:2 |
| 11470: | B:1 Y:3 Z:1 |
| 11471: | C:5 E:2 H:2 J:2 P:1 Y:3 AA:4 |
| 11472: | C:4 E:2 H:2 J:2 P:2 Y:3 AA:5 |
| 11473: | G:3 |
| 11474: | U:2 AA:1 AD:1 |
| 11475: | C:1 H:2 K:1 S:6 |
| 11476: | G:1 H:3 K:2 N:1 P:1 T:2 Y:1 AA:1 |
| 11477: | H:2 Z:2 |
| 11478: | H:2 |
| 11479: | O:3 |
| 11480: | G:6 |
| 11481: | H:1 I:1 T:2 |
| 11482: | AA:2 |
| 11483: | C:4 H:2 K:2 P:2 W:1 AA:2 |
| 11484: | AA:5 |
| 11485: | B:2 Y:3 |
| 11486: | B:9 C:4 E:1 G:4 H:10 Q:2 S:1 X:1 AA:1 AC:1 |
| 11487: | C:2 E:1 J:4 O:1 R:10 V:4 AC:1 |
| 11488: | C:2 E:1 J:2 O:1 R:7 V:4 AC:1 |
| 11489: | T:2 |
| 11490: | B:3 E:1 G:2 H:4 I:2 K:1 P:1 Z:1 AA:4 |
| 11491: | B:1 E:1 G:2 J:1 K:1 N:1 P:2 R:2 S:1 V:1 |
| 11492: | H:3 I:1 T:3 W:1 AC:1 |
| 11493: | A:1 B:6 H:5 J:2 O:2 P:1 Q:2 R:1 S:7 T:1 Y:2 |
| 11494: | AA:3 |
| 11495: | H:1 N:1 O:1 |
| 11496: | E:6 F:5 G:3 H:9 K:5 L:2 N:2 O:8 R:1 S:3 W:2 |
| 11497: | K:1 P:4 R:1 |
| 11498: | B:2 C:2 E:2 H:6 J:2 K:2 O:2 Y:2 AA:3 |
| 11499: | D:2 |
| 11500: | B:6 G:4 Y:1 |
| 11501: | B:6 G:4 Y:1 |
| 11502: | B:1 C:1 S:3 |
| 11503: | B:1 C:1 S:2 |
| 11504: | D:1 K:1 |
| 11505: | G:1 K:1 |
| 11506: | AA:4 |
| 11507: | H:2 K:2 V:1 |
| 11508: | K:1 Q:1 Y:1 |
| 11509: | B:2 |
| 11510: | U:2 |
| 11511: | B:3 |
| 11512: | S:2 |
| 11513: | K:1 V:2 |
| 11514: | B:1 C:1 S:1 |
| 11515: | W:3 |
| 11516: | G:1 W:2 |
| 11517: | AA:17 |
| 11518: | B:5 C:10 E:1 H:3 K:1 S:5 T:1 W:1 Y:2 AA:4 |
| 11519: | AA:5 |
| 11520: | AC:3 AD:1 |
| 11521: | T:1 AC:2 AD:1 |
| 11522: | T:1 AC:3 AD:1 |
| 11523: | G:2 H:1 Z:1 |
| 11524: | D:3 |
| 11525: | C:3 H:2 K:1 S:2 W:1 |
| 11526: | W:2 Y:3 |
| 11527: | B:2 |
| 11528: | S:2 T:1 AC:1 |
| 11529: | H:2 P:1 R:4 AD:1 |
| 11530: | C:1 F:1 G:1 N:1 P:2 S:3 Y:2 AA:1 |
| 11531: | C:1 F:1 G:1 N:1 P:1 S:3 Y:2 AA:1 |
| 11532: | L:3 |
| 11533: | S:1 W:2 |
| 11534: | B:29 C:11 E:3 F:1 G:11 H:25 I:3 J:3 K:5 N:5 O:7 P:10 Q:4 R:6 S:7 T:11 V:1 W:5 Y:1 Z:4 AA:16 AC:1 |
| 11535: | B:18 C:9 E:2 F:1 G:8 H:18 I:2 J:3 K:4 N:3 O:4 P:9 Q:2 R:5 S:7 T:8 V:1 W:2 Y:1 Z:3 AA:8 AC:1 |
| 11536: | B:20 C:10 E:2 F:1 G:11 H:22 I:2 J:3 K:4 N:3 O:4 P:8 Q:2 R:6 S:7 T:8 V:2 W:4 Y:1 Z:3 AA:12 AC:1 |
| 11537: | B:17 C:9 E:2 F:1 G:8 H:18 I:2 J:3 K:4 N:3 O:4 P:9 Q:2 R:5 S:7 T:8 V:1 W:2 Y:1 Z:3 AA:8 AC:1 |
| 11538: | B:20 C:9 E:2 F:1 G:7 H:20 I:2 J:3 K:4 N:3 O:4 P:7 Q:3 R:5 S:6 T:8 V:1 W:3 Y:1 Z:3 AA:9 AC:1 |
| 11539: | T:4 |
| 11540: | B:1 C:1 H:2 J:1 Z:1 |
| 11541: | S:3 AA:1 |
| 11542: | B:1 F:1 H:2 U:2 |
| 11543: | AA:4 |
| 11544: | B:1 G:1 |
| 11545: | B:4 G:1 |
| 11546: | AA:5 |
| 11547: | B:2 T:1 W:1 |
| 11548: | B:3 |
| 11549: | H:3 |
| 11550: | AA:2 |
| 11551: | AA:4 |
| 11552: | A:1 T:1 |
| 11553: | G:1 Y:1 |
| 11554: | O:1 S:1 T:1 |
| 11555: | Y:2 |
| 11556: | B:1 C:1 E:1 G:1 H:3 J:1 S:3 T:2 V:4 W:4 X:1 Z:1 AC:1 AD:1 |
| 11557: | AA:4 |
| 11558: | B:16 G:4 W:11 Y:15 |
| 11559: | B:14 G:4 W:7 Y:8 |
| 11560: | B:14 G:4 W:8 Y:8 |
| 11561: | B:3 |
| 11562: | B:1 W:1 |
| 11563: | B:3 C:2 G:1 |

TABLE II-continued

| SEQ ID NO. | Spatial Distribution |
|---|---|
| 11564: | B:1 C:1 H:1 P:1 T:2 |
| 11565: | B:4 H:1 O:1 S:2 Y:1 AC:1 |
| 11566: | K:1 T:2 X:4 |
| 11567: | I:2 |
| 11568: | A:4 |
| 11569: | B:2 |
| 11570: | N:2 |
| 11571: | T:3 |
| 11572: | H:2 AA:1 |
| 11573: | B:2 C:1 |
| 11574: | G:2 T:1 |
| 11575: | R:3 |
| 11576: | B:26 C:14 D:3 E:4 F:4 G:4 H:22 K:4 N:5 O:4 P:1 Q:15 R:3 S:13 T:2 U:10 W:2 X:2 Z:1 AA:5 AC:4 AD:2 |
| 11577: | B:6 D:2 W:1 |
| 11578: | A:1 B:1 J:1 L:3 O:2 T:1 X:3 AD:1 |
| 11579: | T:2 AA:3 |
| 11580: | S:3 AD:3 |
| 11581: | P:3 |
| 11582: | Z:2 |
| 11583: | C:2 H:2 |
| 11584: | B:3 G:1 |
| 11585: | B:2 |
| 11586: | B:4 H:1 Y:2 |
| 11587: | N:4 |
| 11588: | P:1 S:1 T:1 AC:1 |
| 11589: | R:3 |
| 11590: | B:3 |
| 11591: | B:1 U:2 |
| 11592: | K:5 |
| 11593: | C:1 AC:2 |
| 11594: | C:1 E:1 F:1 G:1 H:3 K:1 S:1 T:1 |
| 11595: | T:3 |
| 11596: | T:2 |
| 11597: | P:2 |
| 11598: | C:1 S:2 |
| 11599: | B:17 G:1 Y:2 |
| 11600: | B:14 G:1 Y:2 |
| 11601: | E:1 T:1 |
| 11602: | H:1 K:1 V:1 |
| 11603: | T:5 |
| 11604: | B:4 C:1 E:2 F:1 G:2 H:5 L:2 O:4 P:6 S:3 T:6 V:2 W:8 X:2 AA:4 AC:2 |
| 11605: | B:6 C:2 E:3 F:1 G:4 H:9 L:2 O:6 P:9 S:5 T:8 V:2 W:8 X:3 AA:3 AC:3 |
| 11606: | B:5 C:1 E:1 F:2 G:4 H:10 L:1 O:5 P:3 S:5 T:9 V:4 W:6 X:1 AA:3 AC:2 |
| 11607: | C:1 G:1 |
| 11608: | C:3 D:2 H:6 J:1 S:2 V:1 X:1 |
| 11609: | C:2 AD:1 |
| 11610: | Y:2 |
| 11611: | B:1 C:1 K:3 |
| 11612: | N:1 O:2 |
| 11613: | B:3 H:6 |
| 11614: | B:3 W:1 |
| 11615: | B:3 |
| 11616: | T:2 |
| 11617: | B:2 |
| 11618: | B:6 C:9 D:1 E:1 G:5 H:11 I:2 K:1 O:2 P:17 Q:3 R:1 S:3 T:1 V:2 W:1 Y:10 Z:4 AA:9 AC:3 |
| 11619: | G:2 |
| 11620: | C:1 H:2 P:3 AD:2 |
| 11621: | N:1 P:1 |
| 11622: | H:1 V:2 |
| 11623: | P:2 |
| 11624: | W:1 |
| 11625: | B:1 G:1 H:4 P:2 S:2 U:3 W:1 Y:1 |
| 11626: | B:1 G:2 H:8 P:3 S:3 U:6 W:1 Y:2 |
| 11627: | C:2 H:3 K:1 V:1 AC:2 |
| 11628: | C:3 H:1 I:2 N:1 R:1 S:2 T:6 Y:2 |
| 11629: | B:3 AD:2 |
| 11630: | T:2 |
| 11631: | B:2 |
| 11632: | T:3 |
| 11633: | Y:3 |
| 11634: | H:4 |
| 11635: | B:1 G:2 H:1 |
| 11636: | S:2 |
| 11637: | O:2 |
| 11638: | G:1 H:1 R:2 |
| 11639: | V:2 |
| 11640: | B:1 H:2 |
| 11641: | B:5 W:3 |
| 11642: | B:5 |
| 11643: | B:9 |
| 11644: | B:1 O:2 |
| 11645: | W:4 |
| 11646: | AA:3 |
| 11647: | I:3 N:63 |
| 11648: | B:2 C:2 H:3 O:1 S:1 U:1 W:4 |
| 11649: | R:3 |
| 11650: | P:5 |
| 11651: | T:2 |
| 11652: | S:2 |
| 11653: | T:2 |
| 11654: | B:2 G:1 |
| 11655: | B:2 C:2 D:2 G:2 H:8 O:2 P:2 S:1 V:2 W:3 Z:4 AA:7 AD:4 |
| 11656: | B:2 C:2 H:2 I:2 P:1 S:4 Y:1 AC:1 |
| 11657: | F:2 |
| 11658: | B:2 |
| 11659: | B:3 H:2 W:1 AC:1 |
| 11660: | B:14 L:1 |
| 11661: | B:12 L:1 |
| 11662: | B:2 |
| 11663: | B:1 O:1 T:1 |
| 11664: | B:1 T:1 |
| 11665: | H:1 S:3 |
| 11666: | B:5 |
| 11667: | H:4 K:1 |
| 11668: | H:2 K:2 |
| 11669: | B:1 H:2 O:1 R:2 X:3 Z:2 AA:1 |
| 11670: | B:3 |
| 11671: | H:4 |
| 11672: | B:1 C:2 H:1 K:2 Y:1 Z:1 |
| 11673: | B:2 |
| 11674: | B:1 C:1 T:3 Y:4 |
| 11675: | B:3 D:2 W:5 Y:7 |
| 11676: | B:3 W:4 |
| 11677: | B:6 W:2 |
| 11678: | F:2 R:7 W:7 AC:1 |
| 11679: | B:11 F:4 S:3 T:5 W:19 Y:11 |
| 11680: | B:13 F:4 S:5 T:7 W:23 Y:13 |
| 11681: | C:2 |
| 11682: | T:4 |
| 11683: | AA:3 |
| 11684: | P:1 S:1 U:2 |
| 11685: | B:1 H:5 I:2 O:1 S:2 W:1 AC:1 |
| 11686: | B:1 C:4 H:3 P:1 S:1 T:1 W:1 |
| 11687: | K:1 S:1 AA:1 |
| 11688: | B:2 H:2 |
| 11689: | B:5 G:1 |
| 11690: | B:2 |
| 11691: | I:3 |
| 11692: | G:1 H:1 K:1 S:2 |
| 11693: | T:2 |
| 11694: | H:1 Q:1 |
| 11695: | T:5 |

TABLE II-continued

| SEQ ID NO. | Spatial Distribution |
|---|---|
| 11696: | C:1 H:9 J:1 N:2 O:3 P:2 S:1 V:1 AA:1 |
| 11697: | B:12 C:3 E:4 G:6 H:4 K:3 L:3 N:2 O:2 P:2 Q:6 S:4 T:18 V:1 W:10 X:2 AA:4 AB:1 AC:3 AD:3 |
| 11698: | B:12 C:3 E:4 G:6 H:4 K:3 L:3 N:2 O:2 P:2 Q:6 S:5 T:18 V:1 W:9 X:2 AA:4 AB:1 AC:3 AD:3 |
| 11699: | AA:8 |
| 11700: | H:1 AA:2 |
| 11701: | C:1 H:1 Y:1 |
| 11702: | C:2 Y:2 |
| 11703: | B:18 C:29 D:2 E:2 F:2 G:13 H:35 I:1 J:3 K:21 N:5 O:7 P:10 Q:8 R:8 S:33 T:3 U:3 W:5 X:1 Y:2 Z:2 AA:11 AC:8 AD:8 |
| 11704: | AA:2 |
| 11705: | C:4 |
| 11706: | C:4 |
| 11707: | N:1 AD:1 |
| 11708: | B:2 |
| 11709: | B:4 |
| 11710: | AA:3 |
| 11711: | X:2 |
| 11712: | H:2 |
| 11713: | AA:2 |
| 11714: | C:1 G:1 T:4 |
| 11715: | H:1 Y:1 |
| 11716: | B:1 E:1 |
| 11717: | AA:2 |
| 11718: | T:4 |
| 11719: | J:1 AD:2 |
| 11720: | P:1 W:1 |
| 11721: | H:3 AA:1 |
| 11722: | G:1 O:1 S:1 |
| 11723: | AA:4 |
| 11724: | B:4 C:1 S:1 |
| 11725: | C:3 |
| 11726: | C:2 L:2 T:2 |
| 11727: | D:30 |
| 11728: | B:3 |
| 11729: | P:2 |
| 11730: | C:3 F:1 K:1 |
| 11731: | B:8 H:1 L:2 |
| 11732: | B:3 C:3 H:1 K:2 R:1 S:2 T:1 Y:1 AA:4 |
| 11733: | B:3 C:2 H:1 K:2 R:1 S:2 T:1 Y:1 AA:3 |
| 11734: | W:2 |
| 11735: | B:2 E:1 H:1 N:1 Y:1 |
| 11736: | B:3 |
| 11737: | X:2 |
| 11738: | S:2 |
| 11739: | AA:2 |
| 11740: | B:31 C:3 F:1 G:2 H:4 J:1 K:5 N:2 O:5 S:6 T:3 U:1 V:1 W:2 X:1 Y:7 Z:1 AA:6 AC:4 |
| 11741: | B:2 H:2 |
| 11742: | AA:5 |
| 11743: | H:1 I:2 Z:1 |
| 11744: | H:6 L:3 |
| 11745: | H:6 L:3 |
| 11746: | B:1 Y:1 |
| 11747: | B:1 R:1 |
| 11748: | C:4 |
| 11749: | AA:4 |
| 11750: | P:10 |
| 11751: | AD:2 |
| 11752: | AA:2 AD:1 |
| 11753: | B:4 |
| 11754: | O:3 P:20 X:2 AA:40 |
| 11755: | S:2 |
| 11756: | B:1 O:1 T:2 |
| 11757: | B:1 AA:2 |
| 11758: | C:1 R:1 |
| 11759: | AA:2 |
| 11760: | B:14 C:12 E:6 F:2 H:10 I:6 J:2 K:4 N:4 O:8 R:2 S:8 T:4 W:4 X:2 Z:6 AA:11 AC:4 AD:3 |
| 11761: | W:4 |
| 11762: | W:5 |
| 11763: | B:8 |
| 11764: | B:1 S:1 |
| 11765: | D:4 |
| 11766: | H:2 Y:1 |
| 11767: | H:1 K:1 AD:2 |
| 11768: | X:2 |
| 11769: | B:3 X:1 AA:2 |
| 11770: | B:3 X:1 AA:1 |
| 11771: | B:1 C:2 S:1 AC:1 |
| 11772: | B:9 |
| 11773: | R:2 |
| 11774: | G:2 K:1 O:1 |
| 11775: | T:3 |
| 11776: | B:1 H:1 AA:1 |
| 11777: | G:1 H:1 |
| 11778: | B:2 |
| 11779: | B:1 P:2 |
| 11780: | A:2 |
| 11781: | P:1 AA:7 |
| 11782: | B:11 C:4 F:1 G:1 H:2 J:1 K:1 O:1 P:2 S:3 Y:3 Z:1 AA:2 |
| 11783: | B:27 C:7 E:1 F:1 G:2 H:3 J:1 K:1 O:2 P:2 S:4 Y:4 Z:2 AA:3 |
| 11784: | B:25 C:7 E:1 F:1 G:2 H:3 J:1 K:1 O:1 P:2 S:4 Y:4 Z:2 AA:3 |
| 11785: | B:45 C:10 E:1 F:2 G:4 H:3 J:2 K:1 O:2 P:4 S:6 Y:6 Z:2 AA:3 |
| 11786: | B:25 C:5 E:1 F:1 G:2 H:2 J:1 K:1 O:1 P:2 S:3 Y:3 Z:2 AA:2 |
| 11787: | AA:2 |
| 11788: | F:1 H:1 K:1 W:2 AA:1 |
| 11789: | F:1 H:1 K:1 W:2 AA:1 |
| 11790: | W:3 AA:3 |
| 11791: | B:1 O:1 S:1 U:1 W:5 Y:1 |
| 11792: | S:1 Y:1 |
| 11793: | J:1 O:1 |
| 11794: | B:17 C:6 D:3 E:4 F:1 G:6 H:14 J:1 K:3 N:1 O:5 P:12 Q:1 R:4 S:14 T:14 U:1 V:5 W:5 X:2 Y:1 Z:3 AA:9 AD:4 |
| 11795: | W:3 |
| 11796: | AA:2 AD:2 |
| 11797: | G:1 S:1 |
| 11798: | H:3 |
| 11799: | C:1 P:1 |
| 11800: | N:1 AD:1 |
| 11801: | B:2 D:3 J:1 |
| 11802: | G:2 |
| 11803: | AA:2 |
| 11804: | I:2 |
| 11805: | B:6 O:2 |
| 11806: | AA:2 |
| 11807: | W:2 |
| 11808: | B:2 G:1 |
| 11809: | B:2 G:1 |
| 11810: | S:2 |
| 11811: | B:1 H:1 K:1 N:1 S:1 |
| 11812: | B:4 |
| 11813: | C:1 H:1 R:2 V:5 W:1 Y:1 AC:1 |
| 11814: | B:4 |
| 11815: | B:2 H:1 |
| 11816: | AA:4 |
| 11817: | P:2 |
| 11818: | D:3 |

TABLE II-continued

| SEQ ID NO. | Spatial Distribution |
|---|---|
| 11819: | O:2 T:3 |
| 11820: | Y:2 |
| 11821: | V:2 |
| 11822: | H:1 AA:2 |
| 11823: | S:1 T:1 |
| 11824: | B:6 C:1 E:1 G:2 H:1 O:2 P:1 Q:2 R:3 S:2 T:1 W:4 Y:1 Z:1 AA:1 |
| 11825: | B:5 C:1 E:1 G:2 H:1 O:2 P:1 Q:2 R:2 S:2 T:1 W:1 Y:1 Z:1 AA:1 |
| 11826: | O:2 |
| 11827: | T:2 |
| 11828: | C:3 |
| 11829: | B:5 Y:1 |
| 11830: | B:94 G:1 W:2 Y:5 |
| 11831: | B:11 C:4 D:2 E:1 F:1 H:1 K:9 O:1 P:1 Q:1 R:7 S:3 Z:1 AA:2 AD:1 |
| 11832: | B:2 |
| 11833: | AD:3 |
| 11834: | B:3 |
| 11835: | B:1 G:1 AD:1 |
| 11836: | T:2 AA:1 |
| 11837: | B:1 S:2 W:1 |
| 11838: | J:2 AA:3 |
| 11839: | T:1 X:1 |
| 11840: | Y:4 |
| 11841: | B:3 C:3 H:1 K:1 O:2 S:1 V:1 X:1 Z:1 AA:2 |
| 11842: | C:1 AD:1 |
| 11843: | AA:3 |
| 11844: | A:6 B:48 C:88 D:13 E:89 F:43 G:44 H:81 I:4 J:22 K:46 L:3 N:34 O:16 P:29 Q:10 R:15 S:62 T:135 U:2 V:8 W:4 X:11 Y:6 Z:13 AA:30 AB:2 AC:7 AD:38 |
| 11845: | B:11 C:3 G:1 H:5 K:1 N:2 S:7 U:3 W:1 Y:2 |
| 11846: | B:10 C:3 G:1 H:3 K:1 N:2 S:6 U:3 W:1 Y:2 |
| 11847: | AA:3 |
| 11848: | H:2 |
| 11849: | AA:3 |
| 11850: | R:2 |
| 11851: | AA:3 |
| 11852: | S:1 AA:1 |
| 11853: | B:7 C:12 E:2 F:1 G:3 H:8 K:13 N:2 O:3 P:6 Q:2 S:13 W:2 X:6 AC:1 |
| 11854: | T:3 |
| 11855: | AA:2 |
| 11856: | H:1 O:1 V:1 |
| 11857: | D:10 |
| 11858: | G:1 P:1 |
| 11859: | S:1 AC:1 |
| 11860: | V:8 AC:1 |
| 11861: | V:2 |
| 11862: | T:4 |
| 11863: | W:5 |
| 11864: | B:1 G:1 |
| 11865: | N:1 AA:3 |
| 11866: | AD:2 |
| 11867: | B:2 |
| 11868: | B:3 Y:1 AC:3 |
| 11869: | AA:2 |
| 11870: | P:2 |
| 11871: | C:1 P:2 |
| 11872: | X:3 |
| 11873: | X:1 AC:1 |
| 11874: | AA:2 |
| 11875: | G:1 AD:1 |
| 11876: | D:1 W:1 |
| 11877: | T:2 |
| 11878: | G:4 |
| 11879: | T:2 |
| 11880: | K:2 O:1 T:1 W:1 |
| 11881: | H:1 W:1 |
| 11882: | H:1 Y:1 |
| 11883: | T:2 |
| 11884: | K:1 N:1 |
| 11885: | H:4 |
| 11886: | H:1 S:1 |
| 11887: | B:1 G:1 S:1 |
| 11888: | G:2 H:3 J:1 O:1 S:2 |
| 11889: | P:3 |
| 11890: | B:1 P:1 T:1 |
| 11891: | H:1 V:3 Y:2 Z:1 AA:1 AC:2 |
| 11892: | F:1 H:2 Y:1 |
| 11893: | Y:2 AA:1 |
| 11894: | S:3 |
| 11895: | AA:3 |
| 11896: | C:1 D:2 F:1 H:1 AC:1 |
| 11897: | B:8 S:2 AA:1 |
| 11898: | AA:2 |
| 11899: | D:2 |
| 11900: | C:1 G:1 |
| 11901: | B:3 |
| 11902: | N:3 |
| 11903: | D:2 G:1 H:5 P:2 S:3 X:1 |
| 11904: | T:2 |
| 11905: | B:3 |
| 11906: | T:2 |
| 11907: | Q:2 |
| 11908: | G:2 |
| 11909: | B:12 D:1 W:10 Y:2 |
| 11910: | B:2 G:1 H:3 |
| 11911: | B:4 G:2 |
| 11912: | S:2 Y:1 |
| 11913: | H:1 T:4 |
| 11914: | B:1 G:1 J:2 R:2 S:1 Y:1 |
| 11915: | B:3 |
| 11916: | AA:2 |
| 11917: | O:1 W:2 |
| 11918: | V:3 |
| 11919: | C:3 H:2 P:2 T:6 W:1 |
| 11920: | R:4 |
| 11921: | H:3 |
| 11922: | S:2 |
| 11923: | B:1 G:1 H:5 P:3 AA:1 AD:1 |
| 11924: | W:2 |
| 11925: | K:3 U:1 |
| 11926: | K:2 S:2 AC:1 AD:3 |
| 11927: | C:4 G:1 H:7 K:1 S:11 Y:11 Z:2 AA:2 |
| 11928: | K:4 S:10 |
| 11929: | B:5 H:1 K:3 P:1 S:13 T:2 AC:3 AD:4 |
| 11930: | H:3 |
| 11931: | B:1 S:1 |
| 11932: | AA:2 |
| 11933: | B:2 |
| 11934: | B:4 |
| 11935: | B:14 C:1 G:1 N:3 W:3 X:4 Y:1 Z:1 AA:2 |
| 11936: | B:4 |
| 11937: | B:3 |
| 11938: | T:2 |
| 11939: | B:4 |
| 11940: | T:2 |
| 11941: | B:3 C:4 E:2 F:1 H:6 J:1 L:6 O:1 P:2 Q:1 R:2 S:2 T:12 U:1 W:2 AA:3 |
| 11942: | B:2 C:6 E:2 F:1 H:8 J:1 L:6 O:1 P:3 Q:2 R:2 S:2 T:14 U:1 W:2 AA:3 |
| 11943: | B:4 C:4 E:4 F:2 H:13 J:2 L:11 O:2 P:3 Q:3 R:4 S:4 T:26 U:2 W:4 AA:6 |
| 11944: | B:4 C:4 E:4 F:2 H:10 J:2 L:10 O:2 P:1 Q:2 R:4 S:4 T:24 U:2 W:4 AA:6 |
| 11945: | AA:2 |

TABLE II-continued

| SEQ ID NO. | Spatial Distribution |
|---|---|
| 11946: | C:3 G:2 S:2 |
| 11947: | H:5 |
| 11948: | B:8 E:1 F:2 G:1 I:3 J:3 N:2 O:1 Q:3 R:1 S:5 T:1 W:4 Y:1 Z:1 AA:5 AC:4 AD:1 |
| 11949: | B:9 E:1 F:2 G:1 I:3 J:3 N:2 O:1 Q:3 R:1 S:5 T:1 W:4 Y:1 Z:1 AA:4 AC:4 AD:1 |
| 11950: | B:1 Y:1 Z:1 |
| 11951: | B:4 C:3 G:1 H:2 P:3 Y:1 |
| 11952: | B:2 C:2 G:1 H:1 P:1 Y:1 |
| 11953: | J:1 R:4 S:1 T:1 |
| 11954: | C:2 G:1 H:2 AA:17 |
| 11955: | C:2 G:1 H:2 AA:16 |
| 11956: | B:1 T:1 |
| 11957: | O:3 P:1 |
| 11958: | B:6 C:4 H:4 P:2 Q:4 AD:2 |
| 11959: | C:3 F:2 H:6 O:1 S:1 T:1 |
| 11960: | C:2 F:3 H:4 O:1 |
| 11961: | P:2 |
| 11962: | B:1 S:1 |
| 11963: | AA:2 |
| 11964: | G:7 |
| 11965: | H:1 W:4 |
| 11966: | H:3 |
| 11967: | W:6 |
| 11968: | AD:2 |
| 11969: | H:3 AC:1 |
| 11970: | B:2 |
| 11971: | Q:1 S:1 |
| 11972: | B:1 G:1 |
| 11973: | K:3 S:2 Z:1 |
| 11974: | B:2 |
| 11975: | N:1 S:2 X:1 |
| 11976: | B:3 |
| 11977: | C:2 G:2 Y:1 AC:1 |
| 11978: | B:1 K:1 S:2 AA:1 |
| 11979: | B:1 W:2 |
| 11980: | B:1 V:1 |
| 11981: | C:4 E:1 G:2 H:3 K:1 N:2 Q:1 S:9 W:1 X:1 Z:1 AA:8 AD:5 |
| 11982: | H:2 |
| 11983: | N:2 P:2 AA:2 |
| 11984: | F:1 H:1 P:1 S:5 T:4 AC:1 |
| 11985: | B:1 G:1 H:3 P:2 U:1 V:2 Y:1 AC:1 |
| 11986: | H:1 AD:1 |
| 11987: | B:4 |
| 11988: | J:2 |
| 11989: | P:1 S:2 T:4 |
| 11990: | W:2 |
| 11991: | B:2 |
| 11992: | S:2 |
| 11993: | X:2 |
| 11994: | B:4 N:1 W:2 Y:1 |
| 11995: | S:2 T:2 AD:3 |
| 11996: | AA:3 |
| 11997: | A:3 B:10 C:7 D:1 G:3 H:10 J:2 K:6 P:8 Q:1 S:5 T:7 W:3 X:2 Z:1 AA:7 AD:6 |
| 11998: | A:2 B:20 C:15 D:3 G:4 H:17 J:4 K:8 P:17 Q:3 S:12 T:12 W:10 X:6 Z:2 AA:12 AD:9 |
| 11999: | B:2 |
| 12000: | C:3 H:3 W:1 |
| 12001: | V:7 |
| 12002: | B:2 |
| 12003: | B:2 C:1 F:1 H:6 T:1 AA:1 |
| 12004: | H:1 S:1 |
| 12005: | J:1 P:1 S:1 T:1 |
| 12006: | V:2 |
| 12007: | G:2 |
| 12008: | G:2 AC:1 |
| 12009: | H:1 R:1 T:1 W:1 AA:1 |
| 12010: | B:1 T:1 |
| 12011: | B:1 S:1 W:1 AA:1 |
| 12012: | B:6 |
| 12013: | AA:2 |
| 12014: | H:4 |
| 12015: | J:1 L:1 S:1 |
| 12016: | B:3 |
| 12017: | C:3 G:5 K:2 P:5 Y:1 AA:3 |
| 12018: | C:1 G:1 |
| 12019: | P:5 |
| 12020: | T:6 |
| 12021: | W:4 |
| 12022: | P:2 S:1 T:1 W:2 X:1 Y:1 |
| 12023: | F:1 G:2 J:1 R:7 |
| 12024: | AA:2 |
| 12025: | B:2 G:1 H:4 P:2 T:1 W:2 Y:3 |
| 12026: | B:88 C:11 E:6 F:2 G:31 H:35 I:2 J:2 K:7 N:3 O:9 P:13 Q:14 R:10 S:16 T:3 W:5 X:7 Y:10 Z:4 AA:11 AC:11 |
| 12027: | B:86 C:11 E:6 F:2 G:31 H:35 I:2 J:2 K:7 N:3 O:10 P:13 Q:14 R:10 S:16 T:3 W:5 X:7 Y:10 Z:4 AA:11 AC:11 |
| 12028: | AA:5 |
| 12029: | G:2 |
| 12030: | N:2 |
| 12031: | AA:2 |
| 12032: | P:1 S:1 |
| 12033: | C:1 Y:3 AC:1 |
| 12034: | C:1 O:1 |
| 12035: | H:2 |
| 12036: | H:2 I:1 O:1 |
| 12037: | T:4 |
| 12038: | AA:3 |
| 12039: | F:4 T:1 |
| 12040: | X:3 |
| 12041: | B:5 C:1 Y:1 |
| 12042: | N:1 T:2 |
| 12043: | P:2 S:1 |
| 12044: | X:2 |
| 12045: | B:12 C:3 E:2 F:6 G:6 H:18 J:4 K:2 N:7 O:5 P:3 S:11 T:43 V:2 W:2 X:1 Y:1 Z:3 AA:12 AC:11 AD:4 |
| 12046: | B:12 C:3 E:2 F:6 G:6 H:18 J:4 K:2 N:7 O:5 P:3 S:12 T:44 V:2 W:2 X:1 Y:1 Z:3 AA:12 AC:11 AD:4 |
| 12047: | B:11 C:3 E:2 F:6 G:5 H:13 J:4 K:2 N:7 O:4 P:3 S:8 T:37 V:2 W:1 X:1 Y:1 Z:3 AA:11 AC:11 AD:3 |
| 12048: | R:3 |
| 12049: | H:3 |
| 12050: | H:2 |
| 12051: | S:2 |
| 12052: | B:6 C:5 E:2 H:10 K:2 O:4 S:5 U:2 Y:1 AC:1 |
| 12053: | B:6 C:4 E:2 H:7 K:1 O:3 S:3 U:2 Y:1 AC:1 |
| 12054: | B:17 E:1 F:2 T:2 W:1 Y:1 |
| 12055: | B:4 C:11 F:2 H:4 J:5 N:1 S:2 T:2 V:2 W:1 Y:2 AA:5 AC:2 |
| 12056: | E:1 H:1 |
| 12057: | T:2 |
| 12058: | AA:2 |
| 12059: | B:1 C:1 O:1 P:1 S:1 W:2 |
| 12060: | B:1 G:1 W:1 Y:3 |
| 12061: | T:2 |
| 12062: | C:5 D:2 F:1 G:9 H:5 J:5 K:3 L:2 O:3 S:2 V:6 W:1 X:1 |
| 12063: | O:1 S:2 |
| 12064: | B:3 |
| 12065: | H:1 N:2 AA:2 |
| 12066: | B:2 |
| 12067: | AA:4 |
| 12068: | P:2 |
| 12069: | B:3 O:1 |
| 12070: | T:2 |

TABLE II-continued

| SEQ ID NO. | Spatial Distribution |
|---|---|
| 12071: | Y:2 |
| 12072: | B:3 K:2 N:1 AD:1 |
| 12073: | G:3 |
| 12074: | Q:2 |
| 12075: | X:2 |
| 12076: | B:1 T:2 Y:2 |
| 12077: | C:1 W:2 Y:2 AD:1 |
| 12078: | B:2 |
| 12079: | N:2 |
| 12080: | D:2 |
| 12081: | W:3 |
| 12082: | AA:5 |
| 12083: | O:2 |
| 12084: | W:4 |
| 12085: | E:1 X:1 |
| 12086: | G:3 S:1 |
| 12087: | F:1 J:1 Y:1 |
| 12088: | A:3 B:13 C:13 D:2 E:6 F:3 G:16 H:37 K:9 O:5 P:1 R:3 S:17 T:4 W:2 Y:8 Z:8 AA:1 AC:2 |
| 12089: | A:1 B:6 C:7 D:1 E:4 F:1 G:6 H:13 K:4 O:3 P:1 R:1 S:6 T:2 W:1 Y:3 Z:4 AA:1 AC:1 |
| 12090: | R:2 |
| 12091: | AA:2 |
| 12092: | B:1 AA:1 |
| 12093: | G:1 W:3 |
| 12094: | C:23 |
| 12095: | H:2 AA:1 |
| 12096: | W:2 |
| 12097: | AA:2 |
| 12098: | B:3 |
| 12099: | B:5 C:2 G:3 K:3 S:2 V:1 W:1 Y:1 Z:1 AA:3 AC:1 |
| 12100: | B:4 |
| 12101: | B:1 C:1 |
| 12102: | AA:2 |
| 12103: | AA:3 |
| 12104: | B:10 C:20 E:2 F:2 G:13 H:11 J:2 K:5 O:4 P:6 Q:2 S:12 T:3 V:2 W:1 X:2 Y:18 Z:5 AA:10 AD:5 |
| 12105: | R:2 |
| 12106: | B:7 H:2 |
| 12107: | T:2 AC:1 |
| 12108: | K:2 O:1 |
| 12109: | Y:5 |
| 12110: | B:2 |
| 12111: | D:2 |
| 12112: | B:1 C:1 E:2 H:10 O:3 Q:1 R:3 W:1 Y:1 |
| 12113: | B:2 C:3 E:1 H:10 O:3 Q:2 R:3 W:2 Y:2 |
| 12114: | B:2 E:1 W:2 |
| 12115: | B:1 G:1 H:2 O:1 |
| 12116: | B:1 G:1 H:1 O:2 |
| 12117: | B:1 H:1 W:1 |
| 12118: | G:1 O:1 X:3 |
| 12119: | A:1 C:6 |
| 12120: | A:1 C:7 |
| 12121: | AA:2 |
| 12122: | G:1 Y:1 |
| 12123: | K:1 S:1 AA:2 |
| 12124: | B:1 C:6 H:3 S:1 X:4 Y:2 AA:2 AC:2 |
| 12125: | C:1 AA:1 |
| 12126: | B:1 N:1 Z:1 |
| 12127: | B:2 |
| 12128: | B:19 C:3 G:7 H:5 J:4 K:4 N:1 P:2 Y:3 Z:1 AA:2 |
| 12129: | AA:3 |
| 12130: | G:2 H:1 |
| 12131: | T:3 |
| 12132: | B:1 W:1 |
| 12133: | B:2 |
| 12134: | O:2 AC:1 |
| 12135: | T:3 |
| 12136: | B:2 |
| 12137: | T:3 |
| 12138: | B:1 N:2 |
| 12139: | B:2 |
| 12140: | AA:3 |
| 12141: | B:1 G:1 |
| 12142: | AA:2 |
| 12143: | C:1 P:2 |
| 12144: | N:2 S:2 AC:1 |
| 12145: | H:4 |
| 12146: | C:4 |
| 12147: | G:1 Y:1 |
| 12148: | X:2 |
| 12149: | Y:3 |
| 12150: | P:3 |
| 12151: | B:2 |
| 12152: | W:3 |
| 12153: | B:2 |
| 12154: | H:2 |
| 12155: | W:4 |
| 12156: | P:2 |
| 12157: | AA:2 |
| 12158: | H:2 |
| 12159: | H:2 |
| 12160: | G:2 S:14 |
| 12161: | P:2 S:1 X:1 Y:1 |
| 12162: | B:3 N:1 S:2 V:2 Y:1 |
| 12163: | T:3 |
| 12164: | G:2 P:1 |
| 12165: | H:3 |
| 12166: | AA:3 |
| 12167: | H:2 |
| 12168: | H:2 |
| 12169: | B:2 H:1 |
| 12170: | AC:2 |
| 12171: | B:2 AB:1 |
| 12172: | U:4 |
| 12173: | AA:2 |
| 12174: | H:3 |
| 12175: | T:3 |
| 12176: | H:3 |
| 12177: | B:4 G:1 K:2 AA:1 |
| 12178: | E:1 L:1 S:1 T:2 |
| 12179: | F:1 W:2 |
| 12180: | H:1 T:1 |
| 12181: | W:1 AD:1 |
| 12182: | B:1 C:3 G:3 H:7 O:2 S:7 T:3 Y:2 |
| 12183: | B:1 C:1 Q:1 S:2 T:1 U:1 Y:1 AC:2 AD:2 |
| 12184: | B:1 C:1 Q:1 S:2 T:1 U:1 Y:1 AC:2 AD:1 |
| 12185: | B:2 |
| 12186: | B:3 F:1 P:1 |
| 12187: | Y:1 AA:2 |
| 12188: | W:2 Y:1 |
| 12189: | B:1 C:3 W:1 |
| 12190: | J:3 |
| 12191: | T:2 |
| 12192: | P:7 Y:2 |
| 12193: | B:4 C:1 E:1 H:2 K:1 O:1 |
| 12194: | G:3 |
| 12195: | A:7 |
| 12196: | B:3 C:7 D:1 G:3 H:10 J:3 K:3 N:1 O:5 P:8 R:8 S:4 W:2 X:1 Y:2 Z:1 AA:8 AC:1 AD:3 |
| 12197: | B:3 C:7 D:1 G:3 H:10 J:3 K:3 N:1 O:5 P:8 R:8 S:4 W:2 X:1 Y:2 Z:1 AA:8 AC:1 AD:3 |
| 12198: | AA:3 |
| 12199: | AA:5 |
| 12200: | H:2 N:2 |
| 12201: | T:5 |
| 12202: | T:3 |

TABLE II-continued

| SEQ ID NO. | Spatial Distribution |
|---|---|
| 12203: | H:2 W:1 |
| 12204: | C:1 J:1 |
| 12205: | B:2 H:1 |
| 12206: | B:3 E:2 F:1 G:12 H:33 I:1 P:5 Q:2 S:3 T:4 W:3 Y:4 AC:5 |
| 12207: | P:1 AA:3 |
| 12208: | C:1 K:1 S:2 W:1 |
| 12209: | D:1 S:1 |
| 12210: | D:3 |
| 12211: | T:4 |
| 12212: | AA:5 |
| 12213: | B:3 |
| 12214: | B:2 |
| 12215: | B:2 N:1 Y:1 |
| 12216: | AA:2 |
| 12217: | AA:3 |
| 12218: | N:2 |
| 12219: | B:1 H:1 |
| 12220: | E:1 G:2 H:1 I:2 Y:1 |
| 12221: | E:1 G:2 H:2 I:1 Y:1 |
| 12222: | AA:5 |
| 12223: | AA:3 |
| 12224: | B:1 C:5 G:1 H:3 J:2 K:1 N:1 O:5 P:2 Q:1 S:3 W:2 AA:4 AC:1 AD:3 |
| 12225: | B:2 C:6 G:2 H:4 J:4 K:2 N:1 O:8 P:3 Q:2 S:6 W:3 AA:6 AC:2 AD:5 |
| 12226: | B:2 C:6 G:2 H:4 J:4 K:2 N:1 O:8 P:3 Q:2 S:6 W:3 AA:6 AC:2 AD:5 |
| 12227: | AA:2 |
| 12228: | P:6 |
| 12229: | D:6 |
| 12230: | B:5 H:1 |
| 12231: | C:2 G:1 N:1 |
| 12232: | B:1 C:1 G:4 K:2 O:1 P:1 S:1 |
| 12233: | H:3 |
| 12234: | B:5 |
| 12235: | H:4 |
| 12236: | H:2 K:1 S:1 W:1 Z:1 |
| 12237: | T:2 |
| 12238: | B:1 G:2 W:2 AC:1 |
| 12239: | B:1 G:3 W:2 AC:1 |
| 12240: | B:1 Y:1 |
| 12241: | P:2 |
| 12242: | C:2 |
| 12243: | B:2 |
| 12244: | B:1 H:1 |
| 12245: | W:2 |
| 12246: | B:3 |
| 12247: | E:1 H:2 O:1 |
| 12248: | E:2 G:2 H:1 O:2 AA:1 |
| 12249: | P:2 |
| 12250: | H:1 K:1 |
| 12251: | H:1 AD:2 |
| 12252: | B:2 |
| 12253: | A:2 L:1 |
| 12254: | J:1 AA:1 |
| 12255: | P:4 |
| 12256: | P:3 T:1 |
| 12257: | AA:3 |
| 12258: | H:1 AD:1 |
| 12259: | U:2 |
| 12260: | G:4 |
| 12261: | K:2 Q:2 W:1 AA:1 |
| 12262: | AA:4 |
| 12263: | H:2 Y:1 |
| 12264: | Y:2 |
| 12265: | N:1 W:1 |
| 12266: | W:2 |
| 12267: | D:211 |
| 12268: | B:1 W:2 Y:1 |
| 12269: | H:2 |
| 12270: | B:2 P:3 Q:1 S:2 V:1 AA:3 |
| 12271: | P:4 |
| 12272: | H:1 S:1 X:1 |
| 12273: | H:1 L:1 S:1 X:2 |
| 12274: | AA:2 |
| 12275: | S:2 |
| 12276: | L:3 |
| 12277: | AA:2 |
| 12278: | X:1 AC:1 |
| 12279: | B:4 |
| 12280: | B:3 |
| 12281: | B:2 K:1 |
| 12282: | B:1 H:1 K:2 |
| 12283: | B:4 |
| 12284: | G:2 |
| 12285: | AA:2 |
| 12286: | B:1 S:1 |
| 12287: | X:3 |
| 12288: | P:1 S:1 AA:1 |
| 12289: | B:2 |
| 12290: | C:1 H:1 Y:1 |
| 12291: | B:2 |
| 12292: | H:4 AA:96 |
| 12293: | V:3 |
| 12294: | C:1 AA:1 |
| 12295: | X:2 |
| 12296: | AA:6 |
| 12297: | P:2 |
| 12298: | H:2 |
| 12299: | AA:4 |
| 12300: | AA:3 |
| 12301: | AC:2 |
| 12302: | H:2 |
| 12303: | J:1 AC:2 |
| 12304: | B:10 C:4 H:3 N:2 T:1 W:2 AA:2 |
| 12305: | Y:3 AA:2 AD:1 |
| 12306: | Y:3 AA:2 AD:1 |
| 12307: | C:1 H:2 P:1 |
| 12308: | B:1 K:1 O:2 |
| 12309: | Y:3 |
| 12310: | T:4 |
| 12311: | B:2 |
| 12312: | B:3 |
| 12313: | Y:1 AC:1 |
| 12314: | B:2 I:3 K:1 S:1 T:1 Y:1 |
| 12315: | R:3 |
| 12316: | C:1 S:1 |
| 12317: | C:1 AD:1 |
| 12318: | G:3 |
| 12319: | H:1 S:1 |
| 12320: | AA:3 |
| 12321: | B:3 |
| 12322: | B:1 G:2 X:1 AD:2 |
| 12323: | B:3 W:7 Y:3 |
| 12324: | B:2 W:8 Y:3 |
| 12325: | B:4 Y:1 AC:1 |
| 12326: | O:1 T:2 |
| 12327: | B:2 |
| 12328: | B:2 |
| 12329: | P:2 |
| 12330: | F:1 S:2 AC:1 |
| 12331: | B:1 H:2 T:1 |
| 12332: | B:2 |
| 12333: | G:5 H:11 I:22 V:10 AC:3 |
| 12334: | U:2 |
| 12335: | J:1 K:1 |
| 12336: | H:2 N:1 Q:1 |
| 12337: | H:1 N:1 Q:2 |
| 12338: | B:1 F:2 G:4 J:1 K:1 N:4 O:1 P:1 Q:1 T:4 W:1 AA:3 |
| 12339: | P:3 |
| 12340: | Y:1 AC:1 |
| 12341: | R:1 T:1 AC:1 |
| 12342: | AC:2 |
| 12343: | C:1 J:2 P:1 S:1 |
| 12344: | AA:3 |
| 12345: | B:2 H:1 K:2 S:1 |
| 12346: | C:1 AA:2 AC:3 |

TABLE II-continued

| SEQ ID NO. | Spatial Distribution |
|---|---|
| 12347: | H:1 P:1 |
| 12348: | B:3 C:2 D:3 E:1 J:4 V:3 AC:5 |
| 12349: | B:2 C:1 D:2 E:2 J:2 V:2 AC:3 |
| 12350: | T:3 |
| 12351: | B:1 G:3 H:3 K:2 Y:2 |
| 12352: | P:3 R:1 S:1 |
| 12353: | Y:3 |
| 12354: | C:2 H:3 N:5 O:3 S:1 AA:6 AC:3 |
| 12355: | T:2 |
| 12356: | V:2 |
| 12357: | AA:4 |
| 12358: | O:2 |
| 12359: | F:49 R:10 AC:1 |
| 12360: | F:49 R:10 AC:1 |
| 12361: | B:2 |
| 12362: | B:2 V:2 |
| 12363: | B:2 V:2 |
| 12364: | F:1 W:1 |
| 12365: | C:1 S:1 |
| 12366: | F:1 G:2 H:2 S:1 |
| 12367: | F:1 G:1 H:2 S:1 |
| 12368: | V:6 |
| 12369: | V:2 |
| 12370: | H:1 Y:2 |
| 12371: | V:2 |
| 12372: | B:1 F:1 G:1 H:2 O:1 P:2 S:2 T:1 W:2 Y:1 |
| 12373: | P:1 AA:1 |
| 12374: | H:1 Y:1 |
| 12375: | O:1 S:1 X:2 AD:1 |
| 12376: | D:1 P:2 T:3 |
| 12377: | K:2 |
| 12378: | B:1 P:1 |
| 12379: | W:2 |
| 12380: | T:5 |
| 12381: | B:3 |
| 12382: | B:2 T:3 Y:2 |
| 12383: | T:3 |
| 12384: | C:2 |
| 12385: | S:3 |
| 12386: | P:2 |
| 12387: | H:2 |
| 12388: | T:2 |
| 12389: | W:2 |
| 12390: | G:3 |
| 12391: | C:1 H:3 O:1 |
| 12392: | Y:3 |
| 12393: | B:2 |
| 12394: | T:4 |
| 12395: | B:4 C:1 E:2 H:1 O:2 P:1 |
| 12396: | G:1 Y:1 |
| 12397: | B:4 G:3 |
| 12398: | AA:3 |
| 12399: | K:1 AD:1 |
| 12400: | W:2 |
| 12401: | P:5 |
| 12402: | B:2 G:1 |
| 12403: | I:1 |
| 12404: | B:2 |
| 12405: | R:2 |
| 12406: | F:2 |
| 12407: | S:3 |
| 12408: | AA:3 |
| 12409: | B:3 |
| 12410: | B:2 |
| 12411: | T:2 |
| 12412: | E:1 O:1 Q:1 |
| 12413: | T:2 |
| 12414: | T:1 U:4 |
| 12415: | T:2 |
| 12416: | B:1 Y:1 |
| 12417: | V:3 |
| 12418: | B:3 C:1 P:4 |
| 12419: | H:2 |
| 12420: | K:1 W:1 |
| 12421: | A:1 B:7 S:3 T:2 W:3 AC:2 |
| 12422: | B:163 C:35 D:4 E:1 G:46 H:51 I:3 J:19 K:20 N:3 O:7 P:9 Q:2 R:16 S:26 V:1 W:24 X:5 Y:44 Z:7 AA:9 AC:17 AD:5 |
| 12423: | B:144 C:25 D:3 E:1 G:38 H:38 I:3 J:13 K:16 N:3 O:7 P:8 Q:2 R:12 S:22 V:1 W:20 X:5 Y:40 Z:5 AA:8 AC:12 AD:4 |
| 12424: | B:157 C:34 D:4 E:1 G:43 H:50 I:3 J:19 K:20 N:3 O:7 P:8 Q:2 R:16 S:25 V:1 W:22 X:5 Y:42 Z:7 AA:9 AC:16 AD:5 |
| 12425: | B:160 C:35 D:4 E:1 G:45 H:50 I:3 J:19 K:20 N:3 O:7 P:8 Q:2 R:16 S:26 V:1 W:24 X:5 Y:43 Z:7 AA:9 AC:17 AD:5 |
| 12426: | B:2 S:1 |
| 12427: | F:2 |
| 12428: | Q:1 AA:2 |
| 12429: | B:1 H:2 W:3 AA5 |
| 12430: | H:2 Q:1 |
| 12431: | T:2 |
| 12432: | AA:2 |
| 12433: | G:3 R:1 |
| 12434: | X:2 |
| 12435: | B:3 |
| 12436: | B:5 C:4 E:1 F:1 G:3 J:1 K:4 L:1 O:1 P:1 S:3 T:1 V:1 W:3 X:2 Y:1 AA:6 |
| 12437: | B:2 Y:1 |
| 12438: | P:1 T:6 |
| 12439: | G:3 |
| 12440: | T:3 |
| 12441: | T:2 |
| 12442: | R:1 T:2 AC:1 |
| 12443: | T:2 |
| 12444: | T:2 |
| 12445: | B:2 Y:2 |
| 12446: | B:2 |
| 12447: | B:2 |
| 12448: | B:2 U:1 |
| 12449: | P:1 Y:7 |
| 12450: | F:16 R:23 S:2 |
| 12451: | B:5 |
| 12452: | AA:2 |
| 12453: | G:2 W:1 Y:1 |
| 12454: | C:2 |
| 12455: | AC:2 |
| 12456: | AC:4 |
| 12457: | E:2 L:1 N:4 S:1 |
| 12458: | H:3 |
| 12459: | H:3 |
| 12460: | N:1 T:5 |
| 12461: | S:4 |
| 12462: | C:1 F:7 H:4 J:2 K:17 N:10 O:3 P:25 R:5 S:18 T:2 X:28 AA:24 AD:19 |
| 12463: | C:2 F:9 H:5 J:3 K:27 N:12 O:4 P:36 R:6 S:25 T:3 X:42 AA:30 AD:26 |
| 12464: | B:17 D:2 W:2 Y:12 |
| 12465: | H:2 |
| 12466: | C:1 E:4 F:1 G:1 H:2 I:2 K:4 L:7 N:4 O:5 R:2 S:7 T:12 W:2 X:1 Z:2 AA:13 |
| 12467: | C:1 E:4 F:1 G:1 H:3 I:2 K:3 L:7 N:4 O:5 R:2 S:7 T:13 W:2 X:1 Z:2 AA:14 |
| 12468: | C:1 E:4 F:1 G:1 H:1 I:2 K:3 L:7 N:4 O:5 R:2 S:3 T:12 W:2 X:1 Z:2 AA:10 |

TABLE II-continued

| SEQ ID NO. | Spatial Distribution |
|---|---|
| 12469: | C:1 E:4 F:1 G:1 H:1 I:2 K:3 L:7 N:4 O:5 R:2 S:3 T:12 W:2 X:1 Z:2 AA:11 |
| 12470: | B:2 D:1 |
| 12471: | T:2 |
| 12472: | E:2 G:2 S:1 U:1 |
| 12473: | B:1 S:4 |
| 12474: | B:1 D:1 G:1 H:1 Y:1 |
| 12475: | B:2 G:1 |
| 12476: | H:2 |
| 12477: | G:1 O:2 |
| 12478: | R:3 |
| 12479: | B:2 U:5 W:3 |
| 12480: | W:2 |
| 12481: | B:1 Q:1 |
| 12482: | V:4 |
| 12483: | H:10 |
| 12484: | V:2 |
| 12485: | B:3 C:1 K:1 P:1 |
| 12486: | E:3 T:6 AA:1 |
| 12487: | B:2 |
| 12488: | G:2 |
| 12489: | Y:3 |
| 12490: | G:1 Y:1 |
| 12491: | N:2 |
| 12492: | H:1 AA:339 |
| 12493: | C:1 K:2 S:2 Z:1 AA:1 AC:2 |
| 12494: | X:2 |
| 12495: | H:1 S:1 |
| 12496: | K:6 |
| 12497: | K:1 S:2 |
| 12498: | W:2 |
| 12499: | B:2 |
| 12500: | X:3 |
| 12501: | B:3 S:2 |
| 12502: | R:2 |
| 12503: | AA:3 |
| 12504: | B:2 O:1 P:1 |
| 12505: | X:2 |
| 12506: | AD:2 |
| 12507: | T:2 |
| 12508: | AA:7 |
| 12509: | T:2 |
| 12510: | B:3 S:2 |
| 12511: | B:1 C:1 F:1 H:4 J:1 K:1 L:1 R:1 S:3 T:2 Z:1 AC:1 |
| 12512: | P:5 |
| 12513: | N:1 R:1 |
| 12514: | B:1 J:1 T:5 |
| 12515: | U:4 |
| 12516: | X:3 |
| 12517: | C:2 H:3 O:2 P:2 R:2 S:1 W:1 X:1 AA:38 |
| 12518: | B:8 |
| 12519: | O:1 S:1 T:1 W:2 |
| 12520: | P:15 |
| 12521: | L:1 AA:1 |
| 12522: | O:1 P:4 |
| 12523: | C:1 P:1 T:4 |
| 12524: | T:2 |
| 12525: | G:1 T:1 Y:1 |
| 12526: | G:1 T:2 Y:2 |
| 12527: | G:2 S:1 T:4 Y:3 Z:1 |
| 12528: | B:2 C:2 E:2 G:1 H:2 K:1 O:1 S:4 |
| 12529: | G:7 |
| 12530: | G:7 |
| 12531: | G:7 |
| 12532: | G:1 K:1 T:3 |
| 12533: | T:3 |
| 12534: | H:2 |
| 12535: | G:1 K:1 |
| 12536: | G:1 O:1 |
| 12537: | N:2 AC:1 |
| 12538: | B:1 G:2 |
| 12539: | O:1 S:1 V:1 |
| 12540: | AA:3 |
| 12541: | A:1 B:58 C:51 D:7 E:23 F:4 G:37 H:57 I:2 J:12 K:23 N:16 O:7 P:51 Q:15 R:5 S:39 T:30 U:2 V:10 W:5 X:8 Y:17 Z:9 AA:48 AC:10 AD:30 |
| 12542: | A:2 B:90 C:80 D:8 E:32 F:8 G:60 H:86 I:2 J:20 K:35 N:22 O:9 P:70 Q:19 R:10 S:59 T:49 U:2 V:11 W:8 X:16 Y:25 Z:13 AA:56 AC:17 AD:30 |
| 12543: | B:4 C:1 G:1 L:6 S:1 T:1 AC:1 |
| 12544: | B:4 C:1 G:1 L:6 S:1 T:1 AC:1 |
| 12545: | B:2 G:2 |
| 12546: | T:3 Y:2 |
| 12547: | C:1 H:1 O:1 |
| 12548: | P:32 |
| 12549: | B:1 G:2 Y:4 |
| 12550: | B:1 S:2 |
| 12551: | S:1 Y:1 |
| 12552: | B:4 G:1 L:1 O:2 P:3 T:3 V:5 W:1 Y:1 |
| 12553: | B:3 |
| 12554: | H:1 S:2 W:1 |
| 12555: | B:14 C:3 E:4 F:1 G:2 H:5 O:1 S:3 V:1 AA:1 AC:2 |
| 12556: | C:1 T:1 X:1 |
| 12557: | G:1 T:1 |
| 12558: | B:2 H:1 |
| 12559: | H:5 S:3 AA:1 |
| 12560: | B:6 |
| 12561: | T:2 |
| 12562: | E:2 H:1 S:1 T:3 |
| 12563: | E:2 H:1 |
| 12564: | V:2 |
| 12565: | AC:2 |
| 12566: | AA:4 |
| 12567: | T:6 |
| 12568: | O:2 W:2 |
| 12569: | B:3 C:2 O:1 R:2 |
| 12570: | L:2 |
| 12571: | B:2 |
| 12572: | H:6 L:3 T:1 W:2 Z:2 |
| 12573: | B:2 |
| 12574: | B:2 |
| 12575: | H:2 AA:2 |
| 12576: | T:2 |
| 12577: | T:2 |
| 12578: | AC:3 |
| 12579: | X:2 |
| 12580: | B:2 |
| 12581: | T:2 |
| 12582: | Y:3 |
| 12583: | G:1 S:1 |
| 12584: | F:14 R:27 S:2 T:1 AA:1 AC:1 |
| 12585: | F:13 R:19 S:2 T:1 AA:1 AC:1 |
| 12586: | B:1 R:2 |
| 12587: | G:1 H:1 |
| 12588: | T:2 |
| 12589: | B:6 C:1 G:4 H:5 K:1 R:4 T:1 Y:1 Z:1 AA:4 |
| 12590: | W:1 X:2 |
| 12591: | AA:2 |
| 12592: | E:2 F:2 T:1 W:2 |
| 12593: | AA:2 |
| 12594: | B:5 C:16 D:3 F:13 G:2 H:9 J:9 L:1 N:13 O:3 P:7 R:8 S:9 T:11 V:2 W:3 Y:3 Z:1 AA:7 AC:7 AD:10 |
| 12595: | P:2 AA:1 |
| 12596: | AA:2 |
| 12597: | B:2 |
| 12598: | W:2 |

TABLE II-continued

| SEQ ID NO. | Spatial Distribution |
|---|---|
| 12599: | B:2 |
| 12600: | C:1 O:2 |
| 12601: | B:2 |
| 12602: | K:3 |
| 12603: | H:2 |
| 12604: | B:1 Y:1 |
| 12605: | B:5 E:1 G:3 H:3 K:2 P:2 S:2 T:4 Z:1 AD:2 |
| 12606: | W:2 |
| 12607: | T:3 |
| 12608: | G:2 |
| 12609: | E:1 H:2 O:1 |
| 12610: | S:1 Y:1 |
| 12611: | B:3 Y:1 |
| 12612: | H:1 AD:2 |
| 12613: | C:4 G:1 T:5 Y:1 AA:2 |
| 12614: | B:1 H:2 N:1 T:3 Y:1 |
| 12615: | B:12 D:1 H:8 S:1 T:4 V:1 |
| 12616: | C:1 G:1 H:1 S:2 W:2 |
| 12617: | H:6 O:1 P:1 |
| 12618: | H:6 O:1 P:1 |
| 12619: | S:5 |
| 12620: | B:2 E:1 V:1 |
| 12621: | B:1 S:1 W:1 |
| 12622: | B:2 G:3 |
| 12623: | G:2 P:1 |
| 12624: | B:1 J:1 K:1 S:5 X:3 Y:1 |
| 12625: | B:1 J:1 K:1 S:2 X:1 Y:1 |
| 12626: | S:1 AA:1 |
| 12627: | A:2 F:1 |
| 12628: | J:13 |
| 12629: | O:1 Q:2 |
| 12630: | A:1 H:1 N:1 P:2 Q:1 X:1 |
| 12631: | K:3 |
| 12632: | AA:4 |
| 12633: | E:1 H:1 |
| 12634: | B:2 |
| 12635: | G:1 J:1 T:1 W:2 AC:1 |
| 12636: | B:2 C:11 D:1 F:1 G:4 H:4 N:3 P:2 Q:1 S:11 T:2 Z:1 AD:1 |
| 12637: | B:2 H:2 |
| 12638: | B:2 T:1 AA:1 |
| 12639: | C:3 |
| 12640: | B:1 K:1 AC:2 |
| 12641: | C:1 F:2 K:1 O:4 W:2 X:1 AA:1 AC:3 |
| 12642: | S:3 |
| 12643: | AA:2 |
| 12644: | C:1 G:1 S:1 X:3 |
| 12645: | B:5 W:1 Y:1 |
| 12646: | B:2 W:1 |
| 12647: | Y:2 |
| 12648: | T:4 |
| 12649: | F:4 |
| 12650: | C:2 G:1 J:1 S:1 W:2 Z:1 |
| 12651: | C:2 G:1 J:2 S:1 W:2 Z:1 |
| 12652: | B:2 |
| 12653: | H:2 T:3 |
| 12654: | C:4 O:1 |
| 12655: | T:2 |
| 12656: | AA:2 |
| 12657: | AA:3 |
| 12658: | AA:3 |
| 12659: | AA:4 |
| 12660: | H:5 |
| 12661: | C:1 S:2 AA:6 |
| 12662: | B:2 |
| 12663: | F:2 J:1 O:1 S:3 AA:4 |
| 12664: | T:3 |
| 12665: | B:2 |
| 12666: | T:2 |
| 12667: | B:3 F:1 G:2 |
| 12668: | C:1 F:2 |
| 12669: | T:2 |
| 12670: | B:3 C:3 H:2 K:4 P:1 S:1 T:1 W:1 X:2 |

TABLE II-continued

| SEQ ID NO. | Spatial Distribution |
|---|---|
| 12671: | AA:2 |
| 12672: | B:3 |
| 12673: | B:1 H:2 AA:1 |
| 12674: | B:2 |
| 12675: | D:3 |
| 12676: | AA:2 |
| 12677: | B:2 Y:1 AD:1 |
| 12678: | AA:2 |
| 12679: | B:1 C:1 K:1 |
| 12680: | D:2 G:1 |
| 12681: | B:2 C:7 D:1 E:5 G:3 H:7 I:1 J:1 N:1 O:3 P:8 Q:3 S:2 T:2 W:1 AD:6 |
| 12682: | B:2 C:8 D:1 E:7 G:4 H:13 I:2 J:2 N:1 O:3 P:9 Q:3 S:2 T:2 W:1 AC:1 AD:8 |
| 12683: | G:1 Y:1 |
| 12684: | B:2 G:1 Y:1 |
| 12685: | B:4 |
| 12686: | B:2 |
| 12687: | A:2 |
| 12688: | S:2 |
| 12689: | T:2 |
| 12690: | G:1 Y:2 |
| 12691: | T:4 |
| 12692: | D:1 P:1 |
| 12693: | AA:4 |
| 12694: | C:1 S:1 V:1 |
| 12695: | B:1 P:4 |
| 12696: | B:3 |
| 12697: | C:2 K:1 S:1 |
| 12698: | AA:3 |
| 12699: | B:3 Y:1 AA:2 |
| 12700: | B:2 |
| 12701: | H:2 K:2 S:3 |
| 12702: | K:2 S:2 |
| 12703: | E:2 AA:6 |
| 12704: | AA:5 |
| 12705: | H:4 |
| 12706: | H:3 AD:2 |
| 12707: | B:1 F:1 |
| 12708: | B:1 G:2 |
| 12709: | B:3 C:3 AA:1 AD:1 |
| 12710: | B:4 C:2 AA:1 AD:2 |
| 12711: | B:1 Y:1 |
| 12712: | B:12 C:1 D:1 E:1 G:5 H:3 S:5 W:2 Y:3 Z:4 AA:1 |
| 12713: | H:2 AC:1 |
| 12714: | B:1 Y:1 |
| 12715: | K:1 S:2 |
| 12716: | B:2 H:2 S:1 AA:1 |
| 12717: | B:1 C:1 |
| 12718: | AA:4 |
| 12719: | P:2 |
| 12720: | B:3 C:1 G:1 H:1 S:2 T:1 AA:4 AD:3 |
| 12721: | H:1 P:2 X:1 |
| 12722: | X:4 |
| 12723: | Y:3 |
| 12724: | Y:3 |
| 12725: | B:1 C:1 S:1 V:6 |
| 12726: | B:1 C:1 S:1 V:7 |
| 12727: | F:2 |
| 12728: | B:1 C:1 R:1 |
| 12729: | B:8 C:4 D:1 E:3 F:2 G:5 H:7 J:4 K:3 L:2 N:5 O:6 P:3 Q:8 R:2 S:2 T:5 W:8 X:1 Y:7 Z:3 AA:10 AC:1 AD:1 |
| 12730: | B:8 C:4 D:1 E:3 F:2 G:5 H:7 J:4 K:3 L:2 N:5 O:6 P:3 Q:8 R:3 S:2 T:5 W:8 X:1 Y:7 Z:3 AA:10 AC:1 AD:1 |
| 12731: | B:15 C:8 D:2 E:3 F:4 G:10 H:10 J:6 K:6 L:1 N:7 O:8 P:6 Q:10 R:3 S:3 T:7 W:12 X:2 Y:13 Z:6 AA:19 AC:2 AD:2 |

TABLE II-continued

| SEQ ID NO. | Spatial Distribution |
|---|---|
| 12732: | B:7 C:4 D:1 E:3 F:2 G:5 H:7 J:4 K:3 L:2 N:5 O:6 P:3 Q:8 R:3 S:2 T:5 W:7 X:1 Y:7 Z:3 AA:10 AC:1 AD:1 |
| 12733: | C:1 H:1 |
| 12734: | R:2 |
| 12735: | E:1 T:2 AA:2 |
| 12736: | C:3 |
| 12737: | G:3 |
| 12738: | S:2 |
| 12739: | B:1 E:1 G:1 W:1 AD:1 |
| 12740: | A:2 H:2 P:5 T:1 |
| 12741: | T:3 |
| 12742: | T:5 |
| 12743: | F:2 H:2 |
| 12744: | H:3 |
| 12745: | E:2 G:1 S:2 |
| 12746: | E:2 G:2 S:2 |
| 12747: | O:2 |
| 12748: | B:1 G:2 |
| 12749: | C:2 H:1 O:2 S:1 W:1 Y:2 |
| 12750: | B:1 C:2 N:3 R:2 S:2 U:1 Z:1 |
| 12751: | N:2 T:1 |
| 12752: | AA:3 |
| 12753: | C:3 |
| 12754: | C:2 |
| 12755: | B:2 P:1 |
| 12756: | G:1 K:2 |
| 12757: | B:3 C:2 D:41 E:2 F:1 H:3 K:2 N:1 O:2 P:4 R:1 S:3 T:1 W:1 X:1 Y:1 Z:2 AA:13 AC:3 |
| 12758: | B:3 C:1 D:40 E:2 F:1 H:3 K:2 N:1 O:2 P:4 R:1 S:3 T:1 W:3 X:1 Y:1 Z:2 AA:11 AC:3 |
| 12759: | B:3 C:1 D:34 E:2 F:1 H:3 K:2 N:1 O:1 P:4 R:1 S:3 T:1 W:3 X:1 Y:1 Z:2 AA:10 AC:3 |
| 12760: | B:2 |
| 12761: | Y:2 |
| 12762: | K:1 O:1 |
| 12763: | B:2 C:2 D:4 F:1 H:7 K:3 T:5 Y:3 Z:2 AA:1 AC:1 |
| 12764: | B:1 S:1 |
| 12765: | T:2 |
| 12766: | B:1 AA:3 |
| 12767: | T:2 |
| 12768: | B:2 |
| 12769: | B:1 H:1 P:1 |
| 12770: | B:2 K:2 P:2 Y:2 |
| 12771: | B:6 D:1 G:1 |
| 12772: | B:1 S:1 |
| 12773: | C:1 D:1 K:1 O:1 R:2 S:4 T:11 W:1 Z:1 AB:1 |
| 12774: | AA:2 |
| 12775: | R:3 |
| 12776: | C:1 S:2 |
| 12777: | H:3 |
| 12778: | B:1 C:3 F:2 G:2 H:2 J:1 S:1 T:1 V:1 W:1 AC:1 |
| 12779: | H:1 O:1 P:1 X:1 |
| 12780: | C:3 H:3 |
| 12781: | B:2 |
| 12782: | B:4 Y:1 |
| 12783: | S:2 T:1 |
| 12784: | E:3 H:1 J:3 O:2 S:1 V:1 X:1 |
| 12785: | AA:2 |
| 12786: | T:3 |
| 12787: | Y:2 |
| 12788: | B:3 |
| 12789: | G:1 H:1 |
| 12790: | T:2 |
| 12791: | B:1 O:1 |
| 12792: | B:1 C:2 |
| 12793: | C:1 S:2 |
| 12794: | S:2 |
| 12795: | D:3 |
| 12796: | W:3 |
| 12797: | B:1 C:1 K:1 O:1 P:1 AA:3 |
| 12798: | T:5 |
| 12799: | V:2 |
| 12800: | A:2 B:33 C:89 D:13 E:14 F:7 G:16 H:49 J:4 K:44 L:4 N:26 O:14 P:43 Q:4 R:8 S:60 T:26 U:1 V:5 W:4 X:4 Y:13 Z:9 AA:55 AB:1 AC:9 AD:10 |
| 12801: | A:2 B:27 C:83 D:14 E:13 F:7 G:17 H:48 J:4 K:42 L:5 N:23 O:11 P:33 Q:4 R:5 S:54 T:25 U:1 V:5 W:4 X:4 Y:9 Z:11 AA:46 AB:2 AC:6 AD:15 |
| 12802: | A:2 B:27 C:75 D:12 E:13 F:6 G:16 H:41 J:4 K:39 L:5 N:23 O:11 P:30 Q:4 R:5 S:50 T:25 U:1 V:5 W:4 X:4 Y:9 Z:10 AA:40 AB:1 AC:6 AD:11 |
| 12803: | A:2 B:27 C:78 D:14 E:13 F:7 G:17 H:44 J:4 K:40 L:5 N:23 O:11 P:30 Q:4 R:5 S:51 T:25 U:1 V:5 W:4 X:4 Y:9 Z:11 AA:40 AB:2 AC:6 AD:14 |
| 12804: | A:2 B:24 C:68 D:13 E:12 F:8 G:10 H:41 J:2 K:34 L:2 N:16 O:9 P:28 Q:3 R:3 S:47 T:21 U:1 V:5 W:3 X:3 Y:5 Z:8 AA:47 AC:6 AD:11 |
| 12805: | B:2 G:1 H:2 R:1 T:2 AA:2 |
| 12806: | H:5 |
| 12807: | E:1 J:1 |
| 12808: | H:2 |
| 12809: | C:2 H:1 |
| 12810: | T:2 |
| 12811: | W:3 |
| 12812: | W:2 |
| 12813: | B:22 C:3 G:2 H:2 O:2 Q:2 S:3 X:1 Y:2 |
| 12814: | T:2 |
| 12815: | G:1 H:1 |
| 12816: | D:1 T:1 |
| 12817: | T:3 |
| 12818: | B:1 G:1 T:4 |
| 12819: | B:3 S:1 |
| 12820: | B:1 Y:1 |
| 12821: | B:16 C:45 E:7 F:10 G:31 H:72 J:5 K:28 L:3 N:4 O:19 P:23 Q:33 S:43 T:33 U:3 W:12 X:6 Y:10 Z:2 AA:34 AC:11 AD:30 |
| 12822: | B:1 C:1 |
| 12823: | T:2 |
| 12824: | E:1 Y:3 |
| 12825: | H:4 |
| 12826: | AA:2 |
| 12827: | R:5 S:2 |
| 12828: | B:2 J:1 |
| 12829: | G:4 |
| 12830: | P:2 |
| 12831: | C:2 D:1 P:3 W:4 X:1 AC:1 |
| 12832: | B:1 G:1 |
| 12833: | P:2 |
| 12834: | AA:5 |
| 12835: | H:2 O:1 |
| 12836: | B:1 S:1 |
| 12837: | B:5 C:5 E:2 F:3 H:2 O:1 P:2 S:1 T:2 W:2 AA:5 AC:1 AD:2 |
| 12838: | B:5 C:5 E:2 F:3 H:2 O:1 P:2 S:1 T:2 W:2 AA:5 AC:1 AD:2 |
| 12839: | J:4 |
| 12840: | B:2 |
| 12841: | B:1 F:2 H:2 O:1 T:2 Y:2 Z:2 |

TABLE II-continued

| SEQ ID NO. | Spatial Distribution |
|---|---|
| 12842: | B:2 |
| 12843: | G:1 Y:1 |
| 12844: | D:3 G:3 K:1 W:2 |
| 12845: | T:4 |
| 12846: | V:2 |
| 12847: | B:2 |
| 12848: | G:1 H:2 |
| 12849: | U:3 |
| 12850: | B:2 C:1 E:1 F:2 G:1 H:3 N:2 S:2 T:5 W:1 Y:1 AA:3 |
| 12851: | B:1 H:1 W:1 |
| 12852: | B:1 Y:1 |
| 12853: | B:1 K:1 |
| 12854: | B:1 C:1 E:1 O:1 T:1 Z:1 |
| 12855: | C:3 |
| 12856: | B:2 AC:1 |
| 12857: | B:5 F:5 H:3 J:1 N:3 S:4 T:7 |
| 12858: | AD:2 |
| 12859: | V:5 |
| 12860: | H:2 R:1 AC:2 |
| 12861: | D:3 |
| 12862: | G:1 H:1 N:1 O:1 S:1 Y:1 |
| 12863: | G:1 H:1 N:1 O:2 S:1 Y:1 |
| 12864: | B:2 |
| 12865: | F:1 Q:1 |
| 12866: | B:4 |
| 12867: | B:1 AD:1 |
| 12868: | Y:1 |
| 12869: | F:2 AA:2 |
| 12870: | T:2 |
| 12871: | AA:2 |
| 12872: | B:1 P:2 |
| 12873: | O:6 P:1 |
| 12874: | O:8 P:2 |
| 12875: | H:2 AD:2 |
| 12876: | AC:2 |
| 12877: | G:1 AA:1 |
| 12878: | A:3 |
| 12879: | B:2 K:3 X:1 AC:1 |
| 12880: | B:2 K:3 X:1 AC:1 |
| 12881: | P:4 |
| 12882: | AA:3 |
| 12883: | H:2 S:3 |
| 12884: | B:14 C:12 E:4 G:1 H:9 K:4 L:2 R:6 S:3 T:2 U:3 X:3 AC:3 |
| 12885: | T:4 |
| 12886: | P:2 |
| 12887: | P:2 |
| 12888: | AA:2 |
| 12889: | AA:2 |
| 12890: | Y:2 |
| 12891: | C:1 E:1 H:2 N:1 O:2 P:1 V:1 AC:1 |
| 12892: | C:1 E:1 H:2 N:1 O:2 P:1 V:1 AC:1 |
| 12893: | G:1 H:3 Y:2 |
| 12894: | K:1 S:2 |
| 12895: | C:2 F:1 H:3 S:4 |
| 12896: | P:2 |
| 12897: | H:2 |
| 12898: | V:2 |
| 12899: | V:3 |
| 12900: | T:2 |
| 12901: | B:2 G:2 AA:1 |
| 12902: | K:1 Y:4 |
| 12903: | B:2 |
| 12904: | AA:11 |
| 12905: | AA:11 |
| 12906: | P:2 |
| 12907: | W:3 |
| 12908: | AD:3 |
| 12909: | Y:2 |
| 12910: | C:2 |
| 12911: | B:4 |
| 12912: | B:9 C:2 G:2 H:3 J:1 P:1 Q:2 S:5 T:1 W:2 Z:2 AA:2 |
| 12913: | B:9 C:2 G:2 H:3 J:1 P:1 Q:2 S:5 T:1 W:2 Z:2 AA:2 |
| 12914: | AD:3 |
| 12915: | T:2 |
| 12916: | B:2 E:1 G:4 W:1 |
| 12917: | B:4 |
| 12918: | T:3 AC:1 |
| 12919: | AA:2 |
| 12920: | B:4 |
| 12921: | B:1 O:1 |
| 12922: | B:1 G:2 N:1 O:1 P:1 S:1 W:1 |
| 12923: | B:1 G:2 N:1 O:1 P:1 S:2 W:1 |
| 12924: | B:5 C:2 G:3 H:2 W:4 X:1 Y:3 |
| 12925: | B:2 G:2 AC:1 |
| 12926: | T:2 |
| 12927: | C:1 G:1 S:1 |
| 12928: | H:1 S:1 |
| 12929: | B:2 |
| 12930: | AA:3 |
| 12931: | B:5 C:1 G:2 H:13 S:1 T:4 V:4 X:3 AA:1 |
| 12932: | H:2 |
| 12933: | B:11 G:9 W:4 |
| 12934: | B:16 G:10 W:5 |
| 12935: | B:1 C:1 |
| 12936: | T:4 |
| 12937: | P:1 W:1 |
| 12938: | N:2 |
| 12939: | S:2 |
| 12940: | B:2 H:1 N:2 T:1 V:1 |
| 12941: | B:2 H:2 N:2 T:2 V:1 |
| 12942: | B:2 H:1 N:2 T:2 V:1 |
| 12943: | X:3 |
| 12944: | W:2 |
| 12945: | H:1 V:1 |
| 12946: | AA:2 |
| 12947: | D:2 W:1 X:2 |
| 12948: | B:2 |
| 12949: | B:1 G:1 |
| 12950: | AA:2 |
| 12951: | H:2 |
| 12952: | B:1 T:1 |
| 12953: | G:2 |
| 12954: | R:2 S:1 |
| 12955: | G:2 O:1 W:2 |
| 12956: | O:3 |
| 12957: | E:2 F:4 G:3 H:2 T:1 Y:1 Z:1 AA:2 |
| 12958: | B:2 |
| 12959: | H:2 |
| 12960: | B:2 |
| 12961: | U:3 |
| 12962: | G:2 |
| 12963: | O:3 S:3 T:1 V:3 |
| 12964: | B:4 |
| 12965: | P:2 |
| 12966: | U:3 |
| 12967: | B:2 |
| 12968: | B:2 |
| 12969: | I:1 T:1 X:2 |
| 12970: | R:3 AA:2 AC:1 |
| 12971: | B:49 C:26 D:3 F:3 G:10 H:16 K:9 N:4 P:6 R:8 S:9 W:7 Y:5 Z:3 AA:25 AD:3 |
| 12972: | B:1 X:1 Y:1 |
| 12973: | B:1 G:1 |
| 12974: | G:1 Z:1 |
| 12975: | B:2 W:2 |
| 12976: | P:2 |
| 12977: | B:2 |
| 12978: | B:2 |
| 12979: | U:4 |
| 12980: | AA:3 |
| 12981: | T:2 |
| 12982: | B:3 |
| 12983: | T:5 |
| 12984: | G:4 H:4 S:1 AA:4 |
| 12985: | B:2 Y:1 |
| 12986: | H:1 P:2 T:1 W:3 X:1 |

TABLE II-continued

| SEQ ID NO. | Spatial Distribution |
|---|---|
| 12987: | B:1 G:4 |
| 12988: | P:2 |
| 12989: | W:2 |
| 12990: | T:2 |
| 12991: | E:1 S:2 |
| 12992: | W:2 |
| 12993: | G:2 H:2 |
| 12994: | F:1 K:2 AA:1 |
| 12995: | C:1 H:1 K:1 S:1 T:4 |
| 12996: | C:3 S:1 |
| 12997: | T:1 U:1 |
| 12998: | B:1 K:1 |
| 12999: | B:7 C:2 F:3 G:1 H:3 L:1 N:1 S:1 T:2 W:2 AA:9 AB:1 AC:1 |
| 13000: | B:2 L:1 |
| 13001: | C:4 F:1 H:3 K:2 S:9 T:4 U:3 Y:1 AA:1 AC:1 AD:1 |
| 13002: | W:2 |
| 13003: | B:2 H:1 J:1 U:1 |
| 13004: | P:3 |
| 13005: | G:1 O:1 |
| 13006: | C:2 |
| 13007: | C:9 W:1 |
| 13008: | AA:2 |
| 13009: | B:2 H:2 |
| 13010: | B:1 I:1 |
| 13011: | B:2 C:11 D:1 G:4 H:8 J:1 K:4 N:1 R:1 S:4 T:1 W:2 Y:5 Z:1 AA:4 AC:4 |
| 13012: | T:3 |
| 13013: | H:4 |
| 13014: | O:3 |
| 13015: | T:3 X:1 |
| 13016: | B:2 W:3 |
| 13017: | P:2 |
| 13018: | C:5 |
| 13019: | AA:7 |
| 13020: | K:1 P:2 |
| 13021: | W:1 AC:1 |
| 13022: | T:3 |
| 13023: | S:1 V:3 |
| 13024: | B:1 E:3 G:3 H:2 L:1 N:4 O:1 R:1 AA:1 |
| 13025: | F:1 H:1 N:1 T:1 AA:2 |
| 13026: | P:2 |
| 13027: | B:2 |
| 13028: | AA:5 |
| 13029: | P:1 Y:1 |
| 13030: | P:4 |
| 13031: | H:1 S:1 AC:3 |
| 13032: | H:1 AA:1 |
| 13033: | D:3 |
| 13034: | H:1 S:2 Z:1 |
| 13035: | C:1 O:1 P:3 S:2 X:2 |
| 13036: | AA:2 |
| 13037: | B:2 H:1 K:1 P:2 T:1 X:1 AA:1 |
| 13038: | I:3 |
| 13039: | B:6 G:2 H:1 K:1 S:5 Y:1 |
| 13040: | B:11 G:1 H:2 K:2 S:6 Y:1 |
| 13041: | H:5 |
| 13042: | T:2 |
| 13043: | AA:3 |
| 13044: | AA:2 |
| 13045: | Q:2 |
| 13046: | V:2 |
| 13047: | G:3 |
| 13048: | H:1 AA:2 |
| 13049: | K:1 P:1 |
| 13050: | G:1 L:1 N:1 T:1 V:2 |
| 13051: | T:3 |
| 13052: | U:2 |
| 13053: | C:4 F:1 H:1 |
| 13054: | V:2 Y:1 AC:2 |
| 13055: | K:1 Y:1 |
| 13056: | S:1 X:1 |
| 13057: | B:3 J:1 K:1 |
| 13058: | B:2 |
| 13059: | G:1 Y:2 |
| 13060: | AA:2 |
| 13061: | E:1 H:1 J:1 Q:1 W:2 |
| 13062: | G:3 |
| 13063: | B:3 |
| 13064: | B:2 |
| 13065: | AA:4 |
| 13066: | G:3 P:1 S:10 |
| 13067: | G:1 S:2 |
| 13068: | B:6 G:3 H:1 Y:2 AD:1 |
| 13069: | AA:6 |
| 13070: | P:2 |
| 13071: | B:2 |
| 13072: | A:1 C:1 K:1 Q:3 AD:1 |
| 13073: | AA:3 |
| 13074: | B:2 W:2 |
| 13075: | AA:3 |
| 13076: | S:5 |
| 13077: | B:2 |
| 13078: | B:15 C:6 F:4 G:1 H:10 K:3 P:1 S:11 X:1 Z:2 |
| 13079: | B:2 |
| 13080: | H:3 |
| 13081: | B:2 |
| 13082: | T:4 |
| 13083: | AA:2 |
| 13084: | T:1 AC:1 |
| 13085: | B:5 C:2 E:1 F:3 G:3 H:2 S:5 W:2 AA:3 AD:1 |
| 13086: | X:2 |
| 13087: | B:2 G:2 L:1 P:1 T:2 V:1 W:1 |
| 13088: | B:2 E:1 G:2 |
| 13089: | G:5 |
| 13090: | C:2 E:2 G:2 O:1 Y:2 AA:1 |
| 13091: | P:1 S:2 AA:2 |
| 13092: | B:18 C:3 F:3 H:5 N:2 S:15 T:6 W:1 Z:3 AD:2 |
| 13093: | B:16 C:2 F:3 H:3 N:2 S:10 T:4 W:1 Z:2 AD:1 |
| 13094: | C:1 O:16 |
| 13095: | D:3 |
| 13096: | Y:3 |
| 13097: | P:1 S:1 |
| 13098: | B:1 C:5 J:3 T:3 W:1 Y:1 Z:1 AA:2 |
| 13099: | AD:1 |
| 13100: | B:2 E:1 |
| 13101: | V:2 |
| 13102: | C:1 O:1 |
| 13103: | T:2 |
| 13104: | B:1 C:1 J:2 K:2 W:1 |
| 13105: | B:3 G:3 V:3 Y:1 |
| 13106: | B:1 F:1 |
| 13107: | T:1 W:3 |
| 13108: | B:1 G:3 H:4 N:1 T:1 X:1 Z:1 AD:2 |
| 13109: | B:1 K:2 |
| 13110: | U:6 |
| 13111: | B:1 H:2 O:1 AA:1 |
| 13112: | B:2 H:1 P:2 AA:1 |
| 13113: | B:2 |
| 13114: | T:2 |
| 13115: | C:1 F:2 K:3 |
| 13116: | B:6 |
| 13117: | B:1 H:1 S:1 Y:1 Z:1 |
| 13118: | B:1 H:1 S:1 Y:1 Z:1 |
| 13119: | B:5 C:3 G:3 H:3 K:1 N:1 O:8 P:1 S:1 W:1 Y:3 AA:1 AC:1 |
| 13120: | B:2 |
| 13121: | P:2 |
| 13122: | H:6 Y:2 |
| 13123: | C:2 G:1 H:5 U:3 |
| 13124: | J:1 O:1 S:2 |
| 13125: | T:3 |
| 13126: | H:2 K:4 O:5 R:2 AA:2 |
| 13127: | B:1 Y:2 |
| 13128: | B:1 H:2 |
| 13129: | C:1 X:2 |
| 13130: | H:2 S:1 T:1 |
| 13131: | H:1 S:1 T:2 |

TABLE II-continued

| SEQ ID NO. | Spatial Distribution |
|---|---|
| 13132: | K:2 P:1 T:1 |
| 13133: | S:4 |
| 13134: | B:5 C:5 H:4 S:2 AC:1 |
| 13135: | B:5 C:5 H:4 S:2 AC:1 |
| 13136: | E:1 H:1 |
| 13137: | C:2 |
| 13138: | H:2 AD:3 |
| 13139: | S:3 |
| 13140: | O:2 |
| 13141: | H:3 K:1 |
| 13142: | B:1 T:1 U:2 X:3 AD:1 |
| 13143: | AA:2 |
| 13144: | T:3 |
| 13145: | E:1 G:1 L:1 |
| 13146: | B:1 G:2 O:1 |
| 13147: | B:1 G:2 O:1 |
| 13148: | T:3 |
| 13149: | W:4 |
| 13150: | C:1 S:5 |
| 13151: | B:2 |
| 13152: | T:2 |
| 13153: | C:3 K:2 S:1 T:7 U:2 |
| 13154: | B:1 C:1 |
| 13155: | B:3 |
| 13156: | P:2 |
| 13157: | G:2 AD:2 |
| 13158: | AA:6 |
| 13159: | H:4 |
| 13160: | X:3 |
| 13161: | H:1 T:1 |
| 13162: | S:2 |
| 13163: | O:2 |
| 13164: | T:2 |
| 13165: | B:1 G:1 |
| 13166: | B:1 S:1 |
| 13167: | B:3 G:1 |
| 13168: | K:2 |
| 13169: | B:1 C:2 F:2 H:2 K:1 N:3 O:1 S:2 X:1 Y:1 AA:1 |
| 13170: | B:2 |
| 13171: | B:1 H:1 |
| 13172: | P:1 AA:1 |
| 13173: | R:2 |
| 13174: | AA:3 |
| 13175: | O:3 |
| 13176: | H:3 |
| 13177: | H:3 |
| 13178: | B:1 C:1 |
| 13179: | AA:4 |
| 13180: | B:1 S:1 |
| 13181: | H:2 Q:1 |
| 13182: | N:1 S:1 |
| 13183: | B:1 H:1 |
| 13184: | B:2 J:1 P:1 S:2 |
| 13185: | K:1 T:2 |
| 13186: | S:2 |
| 13187: | AA:2 |
| 13188: | G:1 H:1 J:1 Q:1 W:4 AA:1 |
| 13189: | AA:2 |
| 13190: | B:1 K:4 T:3 W:1 AA:1 AD:1 |
| 13191: | H:1 K:1 |
| 13192: | B:1 P:1 |
| 13193: | Y:4 |
| 13194: | B:6 F:2 G:1 H:2 K:4 N:1 O:2 R:2 AA:3 AC:3 |
| 13195: | B:10 F:1 G:1 H:3 K:6 O:2 R:1 AA:4 AC:2 |
| 13196: | B:2 Y:1 |
| 13197: | B:11 C:1 G:1 H:2 J:5 S:4 W:1 Y:2 AC:1 |
| 13198: | B:1 K:1 |
| 13199: | H:1 O:1 |
| 13200: | B:1 G:3 H:6 T:1 Y:1 |
| 13201: | G:1 O:1 |
| 13202: | P:3 Y:2 |
| 13203: | B:10 C:14 E:11 G:1 H:5 J:2 K:4 L:1 N:1 O:2 P:11 Q:5 S:2 T:29 U:6 V:6 W:2 X:4 Y:1 AA:1 AC:2 |
| 13204: | B:3 |
| 13205: | B:2 |
| 13206: | B:2 |
| 13207: | B:2 G:1 |
| 13208: | T:3 |
| 13209: | B:4 |
| 13210: | Y:1 AA:1 |
| 13211: | N:1 S:1 |
| 13212: | K:1 X:1 |
| 13213: | G:2 H:4 S:1 |
| 13214: | H:1 Y:1 |
| 13215: | G:2 Y:1 |
| 13216: | B:2 |
| 13217: | Q:2 |
| 13218: | AA:1 AC:1 |
| 13219: | T:2 |
| 13220: | B:2 H:1 |
| 13221: | B:3 G:1 H:1 |
| 13222: | B:2 |
| 13223: | P:1 Q:1 |
| 13224: | B:3 AA:3 |
| 13225: | B:34 E:1 G:3 H:2 O:2 P:1 R:1 S:1 W:1 Y:2 Z:1 AC:1 AD:2 |
| 13226: | B:4 E:1 K:1 T:5 W:3 |
| 13227: | B:3 E:1 K:1 T:4 W:2 |
| 13228: | L:1 T:2 |
| 13229: | S:4 |
| 13230: | B:1 H:2 Y:1 |
| 13231: | AA:4 |
| 13232: | F:1 S:1 T:1 |
| 13233: | R:1 S:1 |
| 13234: | W:3 |
| 13235: | AA:3 |
| 13236: | B:1 H:1 |
| 13237: | S:2 AA:1 |
| 13238: | B:2 |
| 13239: | G:1 J:1 |
| 13240: | A:2 B:6 C:4 E:2 F:2 G:4 H:4 N:2 P:3 S:3 W:1 X:2 Y:2 Z:2 |
| 13241: | B:1 C:2 G:1 |
| 13242: | B:3 S:1 AC:1 |
| 13243: | O:2 |
| 13244: | B:4 C:2 G:3 |
| 13245: | P:2 T:1 |
| 13246: | C:2 |
| 13247: | B:2 |
| 13248: | B:6 G:1 K:2 N:3 W:1 |
| 13249: | B:2 G:1 |
| 13250: | B:1 Z:1 AA:1 |
| 13251: | P:2 |
| 13252: | H:1 W:1 |
| 13253: | W:2 |
| 13254: | AA:2 |
| 13255: | H:2 |
| 13256: | D:2 E:1 H:2 S:4 W:1 X:2 AB:1 |
| 13257: | G:1 H:1 |
| 13258: | B:2 |
| 13259: | C:1 K:2 O:1 S:2 AD:1 |
| 13260: | P:1 W:1 |
| 13261: | V:1 Y:1 |
| 13262: | B:3 Y:2 AD:2 |
| 13263: | G:1 AA:1 |
| 13264: | K:1 O:1 W:1 X:1 |
| 13265: | C:12 G:1 H:7 J:1 K:4 N:1 O:3 P:1 Q:1 S:5 T:3 V:1 X:1 AA:3 AB:1 AD:11 |
| 13266: | C:12 G:1 H:7 J:1 K:4 N:1 O:3 P:1 Q:1 S:5 T:3 V:1 X:1 AA:3 AB:1 AD:11 |
| 13267: | AA:3 |
| 13268: | B:2 |
| 13269: | B:1 K:1 |
| 13270: | Y:2 |
| 13271: | B:1 K:1 |
| 13272: | B:3 |
| 13273: | B:3 |
| 13274: | T:4 |
| 13275: | B:2 |

TABLE II-continued

| SEQ ID NO. | Spatial Distribution |
|---|---|
| 13276: | G:1 O:2 |
| 13277: | O:1 P:2 |
| 13278: | T:3 |
| 13279: | C:2 |
| 13280: | AA:2 |
| 13281: | G:2 |
| 13282: | F:2 H:2 |
| 13283: | B:4 J:1 O:2 |
| 13284: | G:1 H:1 Y:1 |
| 13285: | P:1 W:2 |
| 13286: | AA:3 |
| 13287: | N:2 |
| 13288: | AD:4 |
| 13289: | C:4 T:2 |
| 13290: | C:6 T:4 |
| 13291: | C:3 |
| 13292: | AA:2 |
| 13293: | B:1 C:1 |
| 13294: | AA:2 |
| 13295: | D:2 |
| 13296: | R:2 |
| 13297: | E:2 |
| 13298: | O:2 AA:6 |
| 13299: | B:1 H:1 |
| 13300: | C:1 J:1 O:3 V:1 Y:1 Z:1 AC:1 |
| 13301: | P:2 |
| 13302: | B:3 |
| 13303: | B:2 |
| 13304: | A:2 J:1 AA:1 |
| 13305: | X:2 |
| 13306: | G:1 H:1 |
| 13307: | B:1 F:1 |
| 13308: | T:2 |
| 13309: | K:2 |
| 13310: | AD:2 |
| 13311: | AA:2 |
| 13312: | T:3 |
| 13313: | Y:1 AD:1 |
| 13314: | C:3 K:1 |
| 13315: | B:2 |
| 13316: | S:1 T:1 |
| 13317: | F:2 |
| 13318: | T:3 |
| 13319: | K:2 |
| 13320: | AA:2 |
| 13321: | H:1 Z:2 |
| 13322: | C:3 H:2 S:1 |
| 13323: | B:2 C:1 E:1 P:2 R:1 S:4 AA:3 AC:1 |
| 13324: | B:2 C:1 E:1 P:1 R:1 S:5 AA:3 AC:1 |
| 13325: | B:3 |
| 13326: | H:1 T:1 W:2 AA:1 |
| 13327: | B:1 E:1 G:3 K:3 N:3 O:4 R:1 S:5 Y:2 Z:1 AA:2 AC:4 |
| 13328: | B:5 C:8 D:7 H:19 J:2 K:4 N:1 O:6 P:2 S:5 T:4 W:1 X:3 Z:3 AA:16 AC:3 |
| 13329: | B:4 C:9 D:7 H:14 J:4 K:2 N:2 O:6 P:3 S:5 T:8 X:2 Z:2 AA:15 AC:2 |
| 13330: | C:1 E:1 X:1 |
| 13331: | C:4 |
| 13332: | B:1 AA:1 |
| 13333: | C:1 S:1 |
| 13334: | B:1 N:10 |
| 13335: | Y:2 |
| 13336: | AA:3 |
| 13337: | B:1 G:1 |
| 13338: | AA:3 |
| 13339: | AC:2 |
| 13340: | C:2 O:2 |
| 13341: | AD:2 |
| 13342: | L:1 R:1 S:1 AC:1 |
| 13343: | G:3 |
| 13344: | AA:2 |
| 13345: | C:4 |
| 13346: | C:2 T:1 |
| 13347: | H:1 P:1 |
| 13348: | AC:2 |
| 13349: | G:1 H:3 |
| 13350: | G:2 H:2 K:4 Q:3 S:1 V:2 W:4 |
| 13351: | T:7 |
| 13352: | C:10 |
| 13353: | O:2 |
| 13354: | Y:1 AA:4 |
| 13355: | P:4 |
| 13356: | AA:2 |
| 13357: | X:2 |
| 13358: | W:3 |
| 13359: | AA:4 |
| 13360: | T:3 |
| 13361: | S:4 |
| 13362: | AA:2 |
| 13363: | P:2 |
| 13364: | C:1 H:1 |
| 13365: | P:2 |
| 13366: | H:1 |
| 13367: | T:2 |
| 13368: | AD:2 |
| 13369: | AA:4 |
| 13370: | B:2 |
| 13371: | F:2 |
| 13372: | T:3 |
| 13373: | T:2 |
| 13374: | B:1 H:2 |
| 13375: | W:3 |
| 13376: | C:1 H:1 |
| 13377: | T:2 |
| 13378: | B:3 H:1 T:1 AA:1 AC:1 |
| 13379: | P:2 |
| 13380: | H:4 |
| 13381: | H:2 AA:1 |
| 13382: | AA:2 |
| 13383: | AC:2 |
| 13384: | S:3 |
| 13385: | AA:3 |
| 13386: | N:1 S:1 Z:1 |
| 13387: | S:3 |
| 13388: | C:2 |
| 13389: | C:1 Y:1 AA:1 |
| 13390: | B:1 C:1 K:1 |
| 13391: | S:3 |
| 13392: | F:2 |
| 13393: | G:1 Y:1 |
| 13394: | W:2 |
| 13395: | H:1 P:2 AA:1 |
| 13396: | AA:2 |
| 13397: | T:2 |
| 13398: | T:2 |
| 13399: | W:2 |
| 13400: | H:1 S:1 |
| 13401: | D:2 R:1 |
| 13402: | B:2 |
| 13403: | G:2 |
| 13404: | B:4 |
| 13405: | B:2 C:1 |
| 13406: | S:3 |
| 13407: | S:4 |
| 13408: | G:1 P:1 R:1 |
| 13409: | B:1 O:1 |
| 13410: | C:2 E:1 X:1 |
| 13411: | C:2 E:1 X:1 |
| 13412: | B:1 Y:1 |
| 13413: | B:2 G:1 |
| 13414: | T:3 AA:2 |
| 13415: | B:1 Y:1 |
| 13416: | T:4 |
| 13417: | T:2 |
| 13418: | T:3 |
| 13419: | R:4 |
| 13420: | B:3 |
| 13421: | H:3 AA:2 |
| 13422: | P:2 AA:1 |
| 13423: | B:1 G:2 H:1 T:1 |
| 13424: | G:2 |

TABLE II-continued

| SEQ ID NO. | Spatial Distribution |
|---|---|
| 13425: | B:2 |
| 13426: | B:1 C:2 J:1 |
| 13427: | H:1 W:1 |
| 13428: | T:2 |
| 13429: | AA:2 |
| 13430: | B:1 Y:1 |
| 13431: | A:1 C:2 G:1 H:4 J:2 O:2 S:3 X:1 Y:2 AA:3 AC:2 |
| 13432: | Y:2 |
| 13433: | T:2 |
| 13434: | AA:2 |
| 13435: | P:2 |
| 13436: | AA:16 |
| 13437: | H:2 AA:4 |
| 13438: | H:2 |
| 13439: | AA:2 |
| 13440: | AD:2 |
| 13441: | D:5 |
| 13442: | S:2 |
| 13443: | B:1 F:1 |
| 13444: | B:1 H:4 K:1 T:4 |
| 13445: | S:2 |
| 13446: | S:1 T:2 |
| 13447: | V:2 AC:3 |
| 13448: | B:1 Y:1 |
| 13449: | H:1 P:1 V:1 AA:1 |
| 13450: | H:1 Y:1 |
| 13451: | B:9 C:4 H:6 I:2 O:1 S:1 T:3 W:3 |
| 13452: | E:2 |
| 13453: | AA:4 |
| 13454: | T:2 |
| 13455: | H:1 S:1 |
| 13456: | B:3 |
| 13457: | T:2 |
| 13458: | H:3 K:1 |
| 13459: | H:1 Y:1 |
| 13460: | T:3 |
| 13461: | B:1 G:1 R:1 X:3 AA:2 |
| 13462: | B:2 G:1 R:2 X:4 AA:1 |
| 13463: | O:2 |
| 13464: | X:4 |
| 13465: | F:1 Y:1 |
| 13466: | P:2 |
| 13467: | T:4 |
| 13468: | AA:3 |
| 13469: | AA:2 |
| 13470: | K:1 S:1 |
| 13471: | Y:2 |
| 13472: | G:1 H:9 O:1 S:1 AC:1 |
| 13473: | B:2 |
| 13474: | A:3 H:3 |
| 13475: | Y:2 |
| 13476: | O:1 AA:1 |
| 13477: | T:3 |
| 13478: | B:2 |
| 13479: | G:1 |
| 13480: | T:4 |
| 13481: | B:5 |
| 13482: | B:4 |
| 13483: | U:2 |
| 13484: | T:2 |
| 13485: | K:1 T:2 |
| 13486: | B:2 T:4 |
| 13487: | B:2 T:3 |
| 13488: | H:2 S:1 |
| 13489: | H:2 T:1 |
| 13490: | B:1 J:1 T:1 |
| 13491: | C:2 E:2 P:1 |
| 13492: | Y:2 |
| 13493: | G:2 K:1 |
| 13494: | B:2 D:5 |
| 13495: | T:3 |
| 13496: | G:1 AA:1 |
| 13497: | D:3 |
| 13498: | T:3 |
| 13499: | T:4 |
| 13500: | H:2 |
| 13501: | B:3 |
| 13502: | T:2 |
| 13503: | D:1 Y:1 |
| 13504: | Q:2 |
| 13505: | P:1 R:1 |
| 13506: | D:1 Y:2 |
| 13507: | R:2 S:1 W:1 |
| 13508: | G:2 |
| 13509: | J:1 AC:1 |
| 13510: | N:1 P:1 T:1 |
| 13511: | H:3 |
| 13512: | B:4 |
| 13513: | H:2 O:1 |
| 13514: | O:5 |
| 13515: | C:1 T:1 |
| 13516: | B:2 |
| 13517: | T:2 |
| 13518: | H:2 K:1 P:2 T:1 X:1 AC:1 |
| 13519: | AA:2 |
| 13520: | R:1 X:1 |
| 13521: | AA:2 |
| 13522: | B:3 |
| 13523: | B:2 F:1 AA:1 |
| 13524: | D:5 |
| 13525: | H:1 K:1 T:1 V:1 |
| 13526: | T:2 |
| 13527: | T:2 |
| 13528: | O:1 Y:1 |
| 13529: | C:2 D:1 K:4 |
| 13530: | H:1 L:1 N:1 AD:1 |
| 13531: | H:2 |
| 13532: | AA:3 |
| 13533: | T:3 |
| 13534: | H:1 W:1 AA:1 |
| 13535: | T:7 |
| 13536: | B:1 K:1 |
| 13537: | L:1 S:1 |
| 13538: | O:1 S:1 |
| 13539: | B:2 |
| 13540: | T:2 |
| 13541: | S:2 |
| 13542: | AA:2 |
| 13543: | B:1 H:1 |
| 13544: | B:3 |
| 13545: | P:1 Y:1 AA:1 |
| 13546: | B:2 |
| 13547: | T:2 |
| 13548: | P:4 |
| 13549: | P:3 |
| 13550: | AA:2 |
| 13551: | B:2 |
| 13552: | G:2 |
| 13553: | G:1 Q:1 |
| 13554: | C:1 E:3 T:4 |
| 13555: | S:2 |
| 13556: | B:2 |
| 13557: | B:5 G:1 H:9 S:3 |
| 13558: | B:5 G:1 H:9 S:3 |
| 13559: | H:2 |
| 13560: | P:2 |
| 13561: | A:3 |
| 13562: | U:1 W:1 |
| 13563: | B:2 |
| 13564: | W:2 |
| 13565: | B:1 E:1 H:1 Q:1 |
| 13566: | B:2 |
| 13567: | H:2 |
| 13568: | AD:2 |
| 13569: | G:1 AA:1 |
| 13570: | H:3 W:3 X:3 |
| 13571: | B:1 Y:1 |
| 13572: | AA:3 |
| 13573: | U:2 |
| 13574: | B:1 K:1 |
| 13575: | H:2 |
| 13576: | T:4 |
| 13577: | AA:4 |

TABLE II-continued

| SEQ ID NO. | Spatial Distribution |
|---|---|
| 13578: | B:2 |
| 13579: | B:2 |
| 13580: | C:2 H:3 S:1 T:1 AC:1 |
| 13581: | AA:2 |
| 13582: | V:2 |
| 13583: | T:3 |
| 13584: | X:2 |
| 13585: | G:2 |
| 13586: | P:1 S:1 |
| 13587: | G:2 |
| 13588: | S:1 Y:1 |
| 13589: | B:2 |
| 13590: | F:2 |
| 13591: | B:4 |
| 13592: | G:1 W:1 |
| 13593: | T:4 |
| 13594: | C:2 AA:1 |
| 13595: | T:2 |
| 13596: | AA:3 |
| 13597: | T:1 W:1 AA:1 |
| 13598: | T:1 W:1 AA:1 |
| 13599: | V:4 |
| 13600: | AA:2 |
| 13601: | G:2 |
| 13602: | P:2 |
| 13603: | P:2 |
| 13604: | G:2 |
| 13605: | B:1 G:1 |
| 13606: | B:6 |
| 13607: | B:3 |
| 13608: | H:2 |
| 13609: | D:2 |
| 13610: | B:3 E:1 T:2 |
| 13611: | B:1 S:2 |
| 13612: | B:10 C:6 G:2 H:7 K:2 O:2 P:2 AA:2 AC:2 AD:2 |
| 13613: | W:2 |
| 13614: | H:1 S:1 |
| 13615: | AA:3 |
| 13616: | G:1 S:1 T:1 Z:1 AA:1 |
| 13617: | N:1 S:1 |
| 13618: | B:4 |
| 13619: | J:2 R:1 |
| 13620: | C:2 K:3 W:1 AD:3 |
| 13621: | Y:2 |
| 13622: | C:5 |
| 13623: | H:1 O:1 |
| 13624: | G:1 X:1 Z:2 |
| 13625: | C:14 S:2 |
| 13626: | C:14 S:2 |
| 13627: | B:1 G:2 |
| 13628: | H:4 |
| 13629: | G:2 H:1 Q:2 T:6 |
| 13630: | W:2 |
| 13631: | C:3 E:1 K:2 |
| 13632: | AA:10 |
| 13633: | U:2 |
| 13634: | T:5 |
| 13635: | E:2 |
| 13636: | J:1 T:2 |
| 13637: | T:3 |
| 13638: | AA:3 |
| 13639: | N:2 |
| 13640: | C:1 G:2 W:1 |
| 13641: | B:1 H:2 I:1 S:5 Z:2 AA:2 |
| 13642: | G:1 H:1 |
| 13643: | P:2 |
| 13644: | Y:2 |
| 13645: | H:3 |
| 13646: | C:4 K:1 S:7 |
| 13647: | V:2 |
| 13648: | Y:2 |
| 13649: | B:3 |
| 13650: | B:1 T:1 |
| 13651: | H:3 |
| 13652: | D:2 |
| 13653: | H:1 AA:1 |
| 13654: | B:1 I:1 O:2 AA:2 AD:1 |
| 13655: | B:1 I:1 O:2 AA:2 AD:1 |
| 13656: | B:1 I:1 O:2 AA:2 AD:1 |
| 13657: | T:2 |
| 13658: | F:2 R:1 |
| 13659: | B:2 |
| 13660: | T:5 |
| 13661: | A:1 B:4 C:1 E:1 F:1 G:2 H:9 O:1 P:2 T:9 W:1 X:1 Z:1 AD:1 |
| 13662: | A:1 B:8 C:2 E:3 F:2 G:3 H:10 O:1 P:2 T:9 W:1 X:1 Z:1 AD:1 |
| 13663: | Q:2 AC:1 |
| 13664: | H:2 AD:2 |
| 13665: | G:2 |
| 13666: | D:1 E:1 R:2 S:3 W:1 |
| 13667: | B:1 W:1 |
| 13668: | E:1 T:1 |
| 13669: | H:2 |
| 13670: | Y:3 |
| 13671: | B:3 |
| 13672: | T:2 |
| 13673: | F:2 R:31 S:1 |
| 13674: | H:1 R:1 |
| 13675: | T:3 |
| 13676: | T:2 |
| 13677: | T:2 |
| 13678: | D:4 |
| 13679: | P:2 |
| 13680: | H:1 T:3 AA:2 |
| 13681: | R:3 |
| 13682: | P:2 |
| 13683: | K:2 |
| 13684: | J:1 S:2 |
| 13685: | AA:4 |
| 13686: | AA:2 |
| 13687: | AA:3 |
| 13688: | A:1 B:1 H:1 S:2 AA:2 |
| 13689: | A:1 B:1 H:1 S:2 AA:3 |
| 13690: | L:2 W:1 |
| 13691: | B:1 T:2 |
| 13692: | T:2 |
| 13693: | AA:3 |
| 13694: | B:3 |
| 13695: | C:2 T:5 |
| 13696: | V:2 |
| 13697: | T:3 |
| 13698: | T:2 |
| 13699: | B:3 G:2 |
| 13700: | W:2 AC:1 |
| 13701: | H:1 S:1 |
| 13702: | AD:2 |
| 13703: | C:1 O:1 W:2 AA:1 |
| 13704: | T:2 |
| 13705: | T:2 |
| 13706: | AA:3 |
| 13707: | B:2 |
| 13708: | H:4 |
| 13709: | Y:3 |
| 13710: | C:3 P:2 Y:2 |
| 13711: | B:4 S:1 |
| 13712: | AA:3 |
| 13713: | B:2 |
| 13714: | P:1 W:1 AC:1 |
| 13715: | B:2 |
| 13716: | B:2 |
| 13717: | AA:3 |
| 13718: | T:2 |
| 13719: | H:6 |
| 13720: | H:3 |
| 13721: | O:2 |
| 13722: | H:1 J:1 S:2 |
| 13723: | B:1 H:1 K:7 L:2 N:1 P:1 Y:1 |
| 13724: | H:5 |
| 13725: | N:1 T:2 |
| 13726: | K:2 S:1 |
| 13727: | D:3 |
| 13728: | AA:3 |

TABLE II-continued

| SEQ ID NO. | Spatial Distribution |
|---|---|
| 13729: | T:2 |
| 13730: | T:3 |
| 13731: | T:2 |
| 13732: | AA:2 |
| 13733: | C:4 |
| 13734: | B:1 C:1 |
| 13735: | B:2 |
| 13736: | H:3 |
| 13737: | B:2 |
| 13738: | G:2 |
| 13739: | B:3 G:2 S:2 |
| 13740: | T:4 |
| 13741: | B:30 C:16 E:1 F:1 G:9 H:7 J:1 K:8 L:1 P:5 Q:1 R:2 S:7 T:17 V:3 W:1 X:1 Y:1 AA:7 AC:1 AD:4 |
| 13742: | B:30 C:16 E:1 F:1 G:9 H:7 J:1 K:8 L:1 P:5 Q:1 R:2 S:7 T:17 V:3 W:1 X:1 Y:1 AA:7 AC:1 AD:4 |
| 13743: | B:30 C:15 E:1 F:1 G:9 H:6 J:1 K:7 L:1 P:5 Q:1 R:1 S:7 T:17 V:3 W:1 X:1 Y:1 AA:7 AC:1 AD:4 |
| 13744: | V:2 |
| 13745: | B:3 |
| 13746: | P:3 |
| 13747: | B:3 |
| 13748: | B:8 H:2 O:2 |
| 13749: | F:1 G:1 |
| 13750: | F:2 H:2 U:4 |
| 13751: | G:3 |
| 13752: | AC:2 |
| 13753: | Y:3 |
| 13754: | AA:2 |
| 13755: | B:2 H:1 L:1 W:1 Y:1 |
| 13756: | G:1 X:1 |
| 13757: | C:1 S:6 W:1 AA:2 |
| 13758: | B:3 J:1 |
| 13759: | C:1 K:1 N:1 |
| 13760: | E:1 G:1 |
| 13761: | B:1 X:2 |
| 13762: | S:1 Y:1 |
| 13763: | B:12 C:5 E:1 F:1 G:7 H:14 J:2 K:1 N:1 O:2 P:3 R:2 S:2 V:1 W:3 X:1 Y:4 AA:20 AC:3 AD:3 |
| 13764: | C:1 E:2 W:1 |
| 13765: | T:2 |
| 13766: | B:1 H:1 N:1 P:2 S:2 T:2 W:3 AC:1 |
| 13767: | H:2 |
| 13768: | B:1 H:1 L:1 S:1 U:1 W:1 X:3 Y:2 Z:1 |
| 13769: | B:1 H:1 I:2 R:1 T:3 |
| 13770: | D:3 |
| 13771: | P:2 |
| 13772: | H:1 P:1 |
| 13773: | B:1 L:1 |
| 13774: | H:2 |
| 13775: | B:2 |
| 13776: | AA:3 |
| 13777: | W:1 AC:1 |
| 13778: | K:1 P:1 |
| 13779: | AD:2 |
| 13780: | K:2 |
| 13781: | B:1 O:2 T:2 W:2 Z:1 |
| 13782: | T:2 |
| 13783: | AA:4 |
| 13784: | D:3 O:1 S:1 |
| 13785: | G:3 |
| 13786: | T:2 |
| 13787: | A:4 B:14 C:2 G:3 H:5 K:2 L:1 N:5 S:10 T:2 W:1 Y:1 AA:2 |
| 13788: | A:3 B:24 C:2 G:3 H:4 K:3 L:2 N:11 S:15 T:3 W:2 Y:2 AA:4 |
| 13789: | B:1 W:1 |
| 13790: | N:2 |
| 13791: | B:1 F:2 H:1 W:1 Y:2 Z:1 AA:3 |
| 13792: | B:1 F:2 H:1 W:1 Y:2 Z:1 AA:3 |
| 13793: | B:1 F:2 H:1 W:1 Y:2 Z:1 AA:3 |
| 13794: | B:4 |
| 13795: | B:7 C:1 H:1 S:1 T:3 |
| 13796: | B:1 H:3 |
| 13797: | B:3 |
| 13798: | T:2 |
| 13799: | I:3 P:1 |
| 13800: | E:1 AA:2 |
| 13801: | P:2 |
| 13802: | W:4 |
| 13803: | AD:3 |
| 13804: | B:1 Y:1 |
| 13805: | B:3 E:6 G:3 H:4 J:2 N:1 O:2 Q:3 R:2 S:1 T:7 V:10 W:3 Z:1 |
| 13806: | C:2 T:1 |
| 13807: | B:3 F:1 P:1 S:2 Y:1 |
| 13808: | H:1 S:2 Y:1 |
| 13809: | H:1 Y:1 |
| 13810: | B:2 |
| 13811: | B:2 |
| 13812: | B:3 D:1 S:2 Y:5 |
| 13813: | K:4 |
| 13814: | X:3 |
| 13815: | AA:2 |
| 13816: | A:1 Q:1 S:2 T:2 |
| 13817: | B:1 L:1 |
| 13818: | H:1 S:1 |
| 13819: | H:2 N:1 |
| 13820: | B:13 C:2 W:3 Y:4 |
| 13821: | B:3 C:1 E:1 G:7 H:4 K:3 N:1 O:1 P:4 S:2 T:5 W:3 AA:4 AC:2 |
| 13822: | B:1 W:2 |
| 13823: | G:2 O:1 S:1 |
| 13824: | B:2 D:1 G:2 |
| 13825: | B:2 D:1 G:1 |
| 13826: | B:3 C:1 G:2 H:1 T:1 |
| 13827: | S:3 |
| 13828: | H:2 W:1 |
| 13829: | J:1 AC:1 |
| 13830: | B:2 |
| 13831: | P:4 |
| 13832: | C:2 K:2 V:3 |
| 13833: | E:2 Z:1 |
| 13834: | G:2 |
| 13835: | H:1 K:1 O:1 T:1 X:1 |
| 13836: | T:2 |
| 13837: | C:3 P:3 AA:1 |
| 13838: | B:6 H:8 K:2 W:2 AD:2 |
| 13839: | N:1 AA:4 |
| 13840: | AA:2 |
| 13841: | X:2 AC:2 |
| 13842: | AA:3 |
| 13843: | L:2 |
| 13844: | B:4 G:1 N:1 O:1 P:9 S:1 T:1 W:1 AA:1 |
| 13845: | B:4 G:1 N:1 O:1 P:9 S:1 T:1 W:1 AA:1 |
| 13846: | T:2 |
| 13847: | B:1 Y:1 |
| 13848: | T:2 |
| 13849: | F:1 G:2 W:1 |
| 13850: | H:3 |
| 13851: | B:1 G:4 |
| 13852: | B:1 G:4 |
| 13853: | G:1 P:1 |
| 13854: | N:37 AA:2 |
| 13855: | T:2 |
| 13856: | C:2 |
| 13857: | B:1 Y:1 |
| 13858: | AA:3 |
| 13859: | B:1 C:1 G:1 R:2 S:1 W:1 Y:1 AA:1 |
| 13860: | F:1 H:1 S:1 |
| 13861: | E:1 K:1 S:1 X:2 |
| 13862: | S:4 |
| 13863: | B:1 C:1 AA:1 |
| 13864: | B:1 F:1 S:1 T:4 |
| 13865: | A:1 H:1 |
| 13866: | O:1 |
| 13867: | R:2 W:1 |
| 13868: | AA:2 |
| 13869: | O:2 |
| 13870: | C:2 H:2 T:2 |

TABLE II-continued

| SEQ ID NO. | Spatial Distribution |
|---|---|
| 13871: | B:5 C:3 G:5 N:1 P:2 W:1 AA:2 |
| 13872: | B:1 H:4 T:1 AA:1 |
| 13873: | B:1 H:2 T:2 AA:2 |
| 13874: | T:2 |
| 13875: | B:2 |
| 13876: | AA:2 |
| 13877: | AA:5 |
| 13878: | H:1 S:1 |
| 13879: | B:3 |
| 13880: | T:2 |
| 13881: | AA:3 |
| 13882: | B:2 |
| 13883: | R:2 |
| 13884: | B:1 H:1 W:1 |
| 13885: | O:2 R:2 AC:1 |
| 13886: | G:1 U:1 |
| 13887: | B:2 W:2 |
| 13888: | B:1 T:1 AA:3 |
| 13889: | AA:2 |
| 13890: | V:2 |
| 13891: | C:2 |
| 13892: | H:1 Y:2 |
| 13893: | B:1 C:1 F:1 L:3 T:3 |
| 13894: | F:2 H:7 P:1 R:4 V:1 |
| 13895: | H:1 AC:1 |
| 13896: | AA:36 |
| 13897: | G:2 |
| 13898: | B:2 F:2 T:1 |
| 13899: | T:3 |
| 13900: | R:2 W:1 |
| 13901: | C:1 G:1 |
| 13902: | B:5 G:1 Q:1 AA:2 |
| 13903: | B:1 Y:1 |
| 13904: | B:1 C:1 Y:1 |
| 13905: | V:3 |
| 13906: | B:2 C:1 L:1 |
| 13907: | C:1 S:1 |
| 13908: | J:1 P:2 |
| 13909: | B:2 |
| 13910: | C:1 AC:1 |
| 13911: | T:2 |
| 13912: | AA:2 |
| 13913: | F:1 W:1 |
| 13914: | B:2 AA:1 |
| 13915: | C:2 |
| 13916: | H:1 N:1 |
| 13917: | F:2 |
| 13918: | F:2 |
| 13919: | W:4 |
| 13920: | H:2 |
| 13921: | T:2 |
| 13922: | V:3 |
| 13923: | AA:4 |
| 13924: | R:2 |
| 13925: | AA:2 |
| 13926: | X:1 AA:1 |
| 13927: | B:1 H:1 |
| 13928: | H:1 T:1 |
| 13929: | B:1 H:1 |
| 13930: | P:2 |
| 13931: | B:1 T:1 |
| 13932: | AA:2 |
| 13933: | P:3 |
| 13934: | B:1 G:1 |
| 13935: | P:2 |
| 13936: | K:1 V:1 |
| 13937: | P:2 |
| 13938: | P:1 T:1 |
| 13939: | T:2 |
| 13940: | B:2 Z:1 |
| 13941: | H:2 |
| 13942: | T:2 |
| 13943: | E:1 S:1 |
| 13944: | B:2 E:1 O:1 |
| 13945: | Y:2 |
| 13946: | N:3 |
| 13947: | B:3 G:1 R:1 |
| 13948: | B:2 |
| 13949: | G:3 |
| 13950: | B:3 W:2 |
| 13951: | U:3 |
| 13952: | AA:2 |
| 13953: | S:2 |
| 13954: | B:3 S:1 |
| 13955: | B:2 H:1 O:1 S:1 |
| 13956: | H:2 AA:1 |
| 13957: | P:1 S:3 AC:1 |
| 13958: | B:2 |
| 13959: | F:9 J:2 |
| 13960: | B:2 E:1 G:2 AA:1 |
| 13961: | B:2 |
| 13962: | P:2 |
| 13963: | B:2 P:1 S:1 |
| 13964: | S:2 |
| 13965: | T:1 Y:1 |
| 13966: | S:2 |
| 13967: | B:2 |
| 13968: | W:3 |
| 13969: | F:1 S:1 |
| 13970: | H:1 AC:1 |
| 13971: | B:1 T:1 |
| 13972: | Y:2 |
| 13973: | P:2 |
| 13974: | B:4 C:3 E:1 G:1 H:6 J:1 N:1 O:2 P:1 Q:1 T:3 V:1 W:1 X:1 Z:1 AA:3 AC:1 |
| 13975: | B:1 H:2 |
| 13976: | B:1 G:1 |
| 13977: | W:2 |
| 13978: | H:1 AC:1 |
| 13979: | B:1 C:1 L:1 T:1 Z:1 |
| 13980: | B:2 H:1 W:1 |
| 13981: | H:1 P:1 |
| 13982: | B:2 AA:1 |
| 13983: | B:2 |
| 13984: | H:1 AD:1 |
| 13985: | V:8 |
| 13986: | B:2 |
| 13987: | B:2 C:1 G:3 H:8 P:4 Y:2 AA:2 |
| 13988: | H:2 |
| 13989: | AA:6 |
| 13990: | I:2 |
| 13991: | O:1 AA:1 |
| 13992: | C:2 E:1 H:2 I:1 O:2 P:1 Q:1 R:2 S:2 T:5 X:3 Y:1 Z:1 AA:2 AB:1 |
| 13993: | C:2 E:1 H:2 I:1 O:2 P:1 Q:1 R:2 S:2 T:5 X:3 Y:1 Z:1 AA:2 AB:1 |
| 13994: | N:1 P:1 |
| 13995: | S:1 AA:1 |
| 13996: | L:2 |
| 13997: | C:1 G:1 |
| 13998: | U:1 W:1 |
| 13999: | T:2 |
| 14000: | O:2 |
| 14001: | B:1 W:1 |
| 14002: | P:1 W:1 |
| 14003: | B:1 C:2 H:2 K:1 Z:1 AA:2 AD:1 |
| 14004: | N:1 X:1 |
| 14005: | O:2 |
| 14006: | G:1 H:1 W:2 |
| 14007: | B:5 |
| 14008: | P:2 |
| 14009: | B:2 G:1 |
| 14010: | U:2 Y:1 |
| 14011: | T:3 |
| 14012: | AA:2 |
| 14013: | Q:2 |
| 14014: | H:1 T:1 |
| 14015: | AA:1 AC:1 |
| 14016: | Q:1 X:1 |
| 14017: | V:3 |
| 14018: | D:2 |

TABLE II-continued

| SEQ ID NO. | Spatial Distribution |
|---|---|
| 14019: | H:1 Z:1 |
| 14020: | G:1 S:1 T:1 |
| 14021: | B:1 L:1 O:1 S:1 |
| 14022: | AA:2 |
| 14023: | AA:2 |
| 14024: | B:1 G:1 |
| 14025: | G:2 |
| 14026: | P:2 |
| 14027: | B:3 C:10 D:1 E:3 F:1 G:8 H:17 J:1 K:10 O:5 P:7 Q:4 R:3 S:17 T:10 U:1 V:2 W:5 Y:2 Z:1 AC:2 AD:10 |
| 14028: | B:3 C:8 D:1 E:3 F:1 G:8 H:13 J:1 K:7 O:4 P:7 Q:4 R:3 S:15 T:9 U:1 V:2 W:3 Y:2 Z:1 AC:2 AD:10 |
| 14029: | B:3 C:8 D:1 E:3 F:1 G:8 H:13 J:1 K:7 O:4 P:7 Q:4 R:3 S:13 T:8 U:1 V:2 W:3 Y:2 Z:1 AC:2 AD:8 |
| 14030: | X:3 |
| 14031: | P:1 R:2 |
| 14032: | R:1 AD:1 |
| 14033: | T:2 |
| 14034: | A:1 B:23 C:8 D:1 E:3 G:3 H:1 J:1 K:4 L:1 N:4 O:4 Q:2 R:1 S:5 W:4 AA:3 |
| 14035: | G:1 H:2 R:1 S:1 |
| 14036: | N:2 |
| 14037: | I:3 |
| 14038: | T:2 |
| 14039: | AA:2 |
| 14040: | B:1 E:2 N:1 R:1 T:3 W:1 |
| 14041: | T:3 |
| 14042: | B:2 |
| 14043: | T:2 |
| 14044: | AA:3 |
| 14045: | B:1 N:1 |
| 14046: | H:1 O:3 AA:2 |
| 14047: | E:1 S:1 |
| 14048: | AA:2 |
| 14049: | T:5 |
| 14050: | B:2 G:1 Y:1 AA:2 |
| 14051: | G:1 Y:1 |
| 14052: | S:1 W:1 |
| 14053: | F:1 T:1 |
| 14054: | B:2 S:1 |
| 14055: | B:2 |
| 14056: | S:2 |
| 14057: | T:2 |
| 14058: | B:1 G:1 J:1 N:1 |
| 14059: | F:1 L:2 |
| 14060: | H:1 X:1 |
| 14061: | B:15 C:3 D:1 H:2 I:1 N:1 O:1 S:1 T:2 Y:2 AA:1 |
| 14062: | B:14 C:3 D:1 H:2 I:1 N:1 O:1 S:1 T:2 Y:2 AA:1 |
| 14063: | AA:2 |
| 14064: | J:1 S:1 |
| 14065: | G:2 H:1 |
| 14066: | T:2 |
| 14067: | AA:2 |
| 14068: | T:2 |
| 14069: | F:1 H:1 J:1 |
| 14070: | C:1 P:3 T:2 X:1 |
| 14071: | B:1 L:1 Y:1 |
| 14072: | S:2 |
| 14073: | H:2 |
| 14074: | H:1 N:1 |
| 14075: | T:2 |
| 14076: | Y:2 |
| 14077: | B:2 |
| 14078: | AA:2 |
| 14079: | H:1 J:1 |
| 14080: | F:1 H:1 X:1 |
| 14081: | P:2 |
| 14082: | U:2 |
| 14083: | AD:2 |
| 14084: | B:2 S:1 |
| 14085: | H:1 V:2 |
| 14086: | X:3 |
| 14087: | B:3 |
| 14088: | P:1 V:1 |
| 14089: | G:2 H:1 |
| 14090: | G:2 |
| 14091: | AA:2 |
| 14092: | H:2 |
| 14093: | B:2 |
| 14094: | O:1 AC:1 |
| 14095: | S:1 W:1 |
| 14096: | B:1 O:1 |
| 14097: | B:1 C:1 G:1 |
| 14098: | AA:3 |
| 14099: | H:2 O:1 AA:1 |
| 14100: | K:1 W:1 |
| 14101: | Y:2 |
| 14102: | O:1 Q:1 |
| 14103: | G:2 |
| 14104: | G:1 T:1 |
| 14105: | P:1 V:2 AC:2 |
| 14106: | F:2 G:1 O:1 P:2 R:1 T:20 W:1 AA:3 AD:1 |
| 14107: | B:1 G:2 |
| 14108: | V:2 |
| 14109: | AA:3 |
| 14110: | C:1 Y:2 |
| 14111: | C:1 N:1 T:2 |
| 14112: | C:1 N:2 S:1 X:1 AA:2 |
| 14113: | C:1 N:2 S:1 X:1 AA:2 |
| 14114: | B:2 |
| 14115: | G:1 P:1 |
| 14116: | T:2 |
| 14117: | H:1 S:1 Y:1 |
| 14118: | B:2 AC:1 |
| 14119: | D:2 |
| 14120: | B:2 G:1 |
| 14121: | C:2 |
| 14122: | C:1 H:1 |
| 14123: | B:1 J:1 |
| 14124: | F:2 |
| 14125: | AD:2 |
| 14126: | B:1 AD:1 |
| 14127: | P:2 |
| 14128: | J:1 Y:1 |
| 14129: | S:1 W:1 |
| 14130: | AA:2 |
| 14131: | B:2 |
| 14132: | B:1 S:1 X:1 |
| 14133: | S:1 T:3 |
| 14134: | B:2 |
| 14135: | T:1 AD:3 |
| 14136: | T:2 |
| 14137: | C:1 P:1 T:1 AD:1 |
| 14138: | Y:1 AC:1 |
| 14139: | T:2 |
| 14140: | H:1 S:1 |
| 14141: | B:2 |
| 14142: | P:2 AA:2 |
| 14143: | B:1 C:1 O:1 |
| 14144: | AA:2 |
| 14145: | B:2 |
| 14146: | B:1 T:1 |
| 14147: | AA:2 |
| 14148: | T:2 |
| 14149: | T:1 AA:1 |
| 14150: | N:1 T:1 |
| 14151: | W:3 |
| 14152: | B:2 |
| 14153: | E:1 H:1 |
| 14154: | AC:2 |
| 14155: | U:2 |
| 14156: | B:2 P:2 T:4 |
| 14157: | B:2 P:2 T:4 |
| 14158: | T:2 |
| 14159: | H:1 W:2 |
| 14160: | B:2 |
| 14161: | B:1 C:1 W:1 |
| 14162: | B:1 E:1 |

TABLE II-continued

| SEQ ID NO. | Spatial Distribution |
|---|---|
| 14163: | V:2 |
| 14164: | O:1 P:1 |
| 14165: | U:2 |
| 14166: | B:2 C:1 I:1 L:1 Q:2 U:1 W:1 |
| 14167: | X:2 |
| 14168: | I:2 |
| 14169: | T:2 |
| 14170: | T:2 |
| 14171: | T:2 |
| 14172: | AA:3 |
| 14173: | T:2 |
| 14174: | B:2 |
| 14175: | B:2 G:1 |
| 14176: | AA:2 |
| 14177: | T:2 |
| 14178: | T:1 W:1 |
| 14179: | AA:2 |
| 14180: | H:1 S:1 T:1 |
| 14181: | B:2 |
| 14182: | B:6 C:1 F:1 G:2 H:1 J:1 R:1 S:2 T:1 W:1 |
| 14183: | C:1 G:1 |
| 14184: | F:1 H:1 |
| 14185: | H:1 AA:1 |
| 14186: | P:2 |
| 14187: | T:2 |
| 14188: | B:3 |
| 14189: | V:1 AD:1 |
| 14190: | B:2 |
| 14191: | S:2 |
| 14192: | H:1 O:1 T:2 |
| 14193: | T:2 |
| 14194: | H:1 L:1 |
| 14195: | C:1 X:2 AD:1 |
| 14196: | O:1 Y:1 |
| 14197: | P:2 |
| 14198: | B:2 F:1 |
| 14199: | L:2 N:1 |
| 14200: | T:2 |
| 14201: | B:8 F:1 S:2 AC:3 |
| 14202: | B:2 |
| 14203: | B:1 V:1 |
| 14204: | H:1 Y:1 |
| 14205: | B:2 |
| 14206: | N:1 P:2 T:3 |
| 14207: | B:1 N:1 S:1 T:1 |
| 14208: | H:1 AA:1 |
| 14209: | G:1 R:1 |
| 14210: | G:1 H:1 J:1 |
| 14211: | H:1 AA:1 |
| 14212: | P:2 |
| 14213: | J:1 R:1 |
| 14214: | B:2 |
| 14215: | T:1 AD:1 |
| 14216: | AA:3 |
| 14217: | B:1 J:1 |
| 14218: | P:2 |
| 14219: | D:2 |
| 14220: | W:2 |
| 14221: | E:2 I:1 N:1 |
| 14222: | E:2 I:1 N:1 |
| 14223: | P:2 |
| 14224: | B:1 E:1 |
| 14225: | G:2 |
| 14226: | P:2 |
| 14227: | V:3 |
| 14228: | F:1 AC:1 |
| 14229: | B:2 |
| 14230: | T:1 V:2 |
| 14231: | T:2 |
| 14232: | X:2 |
| 14233: | O:2 |
| 14234: | G:2 H:2 O:1 AC:2 |
| 14235: | S:2 |
| 14236: | C:2 |
| 14237: | T:2 |
| 14238: | T:2 |
| 14239: | N:2 |

TABLE II-continued

| SEQ ID NO. | Spatial Distribution |
|---|---|
| 14240: | H:3 O:1 T:1 V:2 AC:1 |
| 14241: | F:1 T:1 |
| 14242: | Y:2 |
| 14243: | B:1 K:1 |
| 14244: | B:2 |
| 14245: | T:2 |
| 14246: | B:2 G:2 H:7 O:1 Y:1 |
| 14247: | B:2 |
| 14248: | B:1 C:1 |
| 14249: | B:1 G:1 |
| 14250: | T:2 |
| 14251: | B:1 AA:1 |
| 14252: | L:3 |
| 14253: | B:3 X:1 |
| 14254: | F:1 R:1 AC:1 |
| 14255: | K:1 O:1 AA:1 AD:1 |
| 14256: | G:1 T:1 |
| 14257: | B:4 |
| 14258: | W:1 AC:1 |
| 14259: | E:1 Y:1 |
| 14260: | B:2 G:4 W:1 Z:1 |
| 14261: | H:1 T:1 |
| 14262: | B:3 |
| 14263: | B:3 |
| 14264: | B:10 G:1 H:1 K:1 |
| 14265: | S:2 |
| 14266: | T:1 AA:1 |
| 14267: | H:2 |
| 14268: | AC:2 |
| 14269: | E:1 G:1 H:1 |
| 14270: | C:1 Y:1 |
| 14271: | B:2 |
| 14272: | B:2 |
| 14273: | P:1 Q:1 |
| 14274: | B:4 G:3 H:1 O:3 Y:1 |
| 14275: | B:1 C:1 G:2 H:1 V:1 |
| 14276: | B:2 |
| 14277: | G:1 T:1 |
| 14278: | B:1 F:1 K:1 P:1 |
| 14279: | L:1 O:1 Z:1 |
| 14280: | AA:2 |
| 14281: | P:5 |
| 14282: | B:1 I:1 L:1 V:4 |
| 14283: | AA:2 |
| 14284: | B:6 C:1 G:4 H:5 J:1 K:6 L:1 N:1 S:2 W:1 X:1 |
| 14285: | B:2 Y:1 |
| 14286: | T:2 |
| 14287: | B:2 |
| 14288: | T:1 W:1 |
| 14289: | H:3 L:1 |
| 14290: | I:1 O:2 |
| 14291: | G:2 |
| 14292: | AD:2 |
| 14293: | T:4 |
| 14294: | P:2 |
| 14295: | H:2 |
| 14296: | G:2 |
| 14297: | P:2 |
| 14298: | B:1 G:2 T:1 Y:1 |
| 14299: | B:4 |
| 14300: | AA:2 |
| 14301: | T:4 |
| 14302: | T:1 AD:1 |
| 14303: | T:4 |
| 14304: | E:1 N:1 |
| 14305: | G:2 |
| 14306: | T:2 |
| 14307: | T:2 |
| 14308: | T:2 |
| 14309: | H:2 |
| 14310: | AA:3 |
| 14311: | Y:3 |
| 14312: | D:1 AD:1 |
| 14313: | C:1 G:1 |
| 14314: | T:2 |
| 14315: | H:1 K:1 S:4 Y:1 AD:1 |

TABLE II-continued

| SEQ ID NO. | Spatial Distribution |
|---|---|
| 14316: | H:3 |
| 14317: | G:2 |
| 14318: | T:2 |
| 14319: | AA:2 |
| 14320: | X:3 |
| 14321: | S:1 T:1 |
| 14322: | X:3 |
| 14323: | H:2 |
| 14324: | T:2 |
| 14325: | C:1 J:1 T:2 |
| 14326: | C:1 J:1 T:2 |
| 14327: | B:1 T:2 |
| 14328: | B:1 T:2 |
| 14329: | T:1 Y:1 |
| 14330: | J:2 |
| 14331: | B:2 |
| 14332: | S:1 T:2 W:2 |
| 14333: | F:1 L:1 T:2 |
| 14334: | T:2 |
| 14335: | T:2 |
| 14336: | T:2 |
| 14337: | I:2 |
| 14338: | Y:2 |
| 14339: | U:2 |
| 14340: | H:1 V:1 |
| 14341: | AA:2 |
| 14342: | B:1 E:1 |
| 14343: | B:2 |
| 14344: | B:17 G:1 |
| 14345: | B:19 G:1 |
| 14346: | B:18 G:1 |
| 14347: | B:1 W:1 |
| 14348: | C:4 F:4 H:4 J:2 O:2 P:2 W:4 |
| 14349: | F:1 H:1 |
| 14350: | T:2 |
| 14351: | AA:2 |
| 14352: | H:1 O:1 S:1 AC:1 |
| 14353: | B:2 |
| 14354: | T:2 |
| 14355: | O:2 |
| 14356: | G:2 |
| 14357: | AA:2 |
| 14358: | W:3 |
| 14359: | W:2 AD:1 |
| 14360: | AD:2 |
| 14361: | H:2 X:1 |
| 14362: | S:1 Y:1 |
| 14363: | H:2 |
| 14364: | AA:2 |
| 14365: | B:2 W:1 |
| 14366: | P:3 |
| 14367: | H:1 W:1 |
| 14368: | AC:2 |
| 14369: | AA:2 |
| 14370: | Y:2 |
| 14371: | AA:2 |
| 14372: | T:2 |
| 14373: | T:2 |
| 14374: | B:1 G:1 |
| 14375: | V:3 |
| 14376: | C:1 D:1 |
| 14377: | T:2 |
| 14378: | T:3 |
| 14379: | D:2 |
| 14380: | B:2 |
| 14381: | B:1 AA:1 |
| 14382: | O:1 V:1 |
| 14383: | B:2 |
| 14384: | B:1 O:3 S:1 |
| 14385: | B:2 |
| 14386: | B:1 P:1 |
| 14387: | V:2 AD:1 |
| 14388: | L:2 |
| 14389: | I:1 O:1 |
| 14390: | H:2 |
| 14391: | T:2 |
| 14392: | H:1 K:1 |
| 14393: | B:5 E:1 S:2 |
| 14394: | B:5 S:2 |
| 14395: | B:3 |
| 14396: | I:2 |
| 14397: | R:2 |
| 14398: | C:1 S:1 |
| 14399: | B:1 W:1 |
| 14400: | H:2 |
| 14401: | D:2 |
| 14402: | B:6 C:1 G:2 H:2 I:2 Q:2 U:2 Y:1 |
| 14403: | W:2 |
| 14404: | C:2 |
| 14405: | T:2 |
| 14406: | Y:2 |
| 14407: | B:1 H:1 |
| 14408: | C:2 |
| 14409: | AA:2 |
| 14410: | I:2 |
| 14411: | T:2 |
| 14412: | H:2 |
| 14413: | B:3 |
| 14414: | J:1 Y:1 |
| 14415: | T:2 |
| 14416: | B:2 P:1 S:1 |
| 14417: | B:1 X:1 |
| 14418: | S:2 |
| 14419: | X:2 |
| 14420: | N:2 |
| 14421: | V:2 |
| 14422: | B:2 |
| 14423: | G:1 AA:1 |
| 14424: | B:1 N:1 |
| 14425: | X:2 |
| 14426: | C:2 P:1 |
| 14427: | C:2 P:1 |
| 14428: | G:1 T:1 |
| 14429: | E:1 H:1 |
| 14430: | B:2 Y:1 |
| 14431: | B:2 |
| 14432: | C:1 W:2 |
| 14433: | AA:2 |
| 14434: | O:1 P:1 AA:1 |
| 14435: | S:1 T:1 |
| 14436: | B:2 |
| 14437: | H:2 |
| 14438: | B:2 |
| 14439: | T:3 |
| 14440: | T:3 |
| 14441: | T:3 W:1 |
| 14442: | B:3 H:1 N:1 S:1 Y:2 AA:4 |
| 14443: | B:4 H:1 N:1 S:1 Y:3 AA:2 |
| 14444: | T:3 |
| 14445: | P:1 U:1 |
| 14446: | T:2 |
| 14447: | C:2 |
| 14448: | T:2 |
| 14449: | T:2 |
| 14450: | W:2 |
| 14451: | B:28 C:4 E:6 G:2 H:20 J:3 K:5 O:3 P:10 Q:2 R:4 S:4 T:1 Y:17 Z:1 AA:14 AC:3 |
| 14452: | B:22 C:3 E:5 G:2 H:12 J:2 K:3 O:2 P:6 Q:2 S:6 T:1 Y:12 AA:13 AC:3 |
| 14453: | B:2 |
| 14454: | H:1 P:1 |
| 14455: | K:1 R:1 |
| 14456: | T:2 |
| 14457: | G:2 |
| 14458: | G:1 W:1 |
| 14459: | W:2 |
| 14460: | B:3 |
| 14461: | E:2 F:1 N:1 P:1 W:1 |
| 14462: | B:2 |
| 14463: | P:1 W:1 |
| 14464: | H:1 O:1 |
| 14465: | B:3 |

TABLE II-continued

| SEQ ID NO. | Spatial Distribution |
|---|---|
| 14466: | B:2 |
| 14467: | AA:3 |
| 14468: | B:2 |
| 14469: | H:1 P:1 R:1 AA:1 |
| 14470: | T:2 |
| 14471: | B:5 H:2 J:2 V:1 |
| 14472: | B:5 H:2 J:2 V:1 |
| 14473: | Y:2 |
| 14474: | B:2 W:5 |
| 14475: | B:2 |
| 14476: | B:1 H:1 |
| 14477: | B:1 C:1 H:3 O:1 P:2 Q:1 S:3 Y:1 AA:2 |
| 14478: | K:1 S:1 |
| 14479: | U:2 |
| 14480: | B:2 |
| 14481: | T:1 AA:1 |
| 14482: | T:2 |
| 14483: | K:1 O:1 |
| 14484: | R:2 |
| 14485: | B:1 V:3 |
| 14486: | B:2 |
| 14487: | T:3 |
| 14488: | H:1 AA:1 |
| 14489: | P:1 AC:1 |
| 14490: | H:1 U:3 |
| 14491: | G:1 L:1 |
| 14492: | AA:2 |
| 14493: | I:1 J:1 P:3 |
| 14494: | J:1 P:3 |
| 14495: | O:2 Z:1 |
| 14496: | O:2 |
| 14497: | U:2 |
| 14498: | B:2 AA:1 |
| 14499: | B:2 O:1 W:1 |
| 14500: | B:1 H:1 |
| 14501: | N:1 T:1 |
| 14502: | W:2 |
| 14503: | C:1 G:1 H:1 R:1 |
| 14504: | Q:1 S:2 |
| 14505: | S:1 Y:1 AC:1 |
| 14506: | H:1 J:1 K:1 |
| 14507: | B:2 |
| 14508: | P:2 |
| 14509: | T:2 |
| 14510: | B:2 |
| 14511: | T:2 |
| 14512: | I:1 W:1 |
| 14513: | J:2 |
| 14514: | H:2 |
| 14515: | B:1 H:1 |
| 14516: | S:2 |
| 14517: | B:2 |
| 14518: | W:2 |
| 14519: | B:2 |
| 14520: | P:2 |
| 14521: | B:2 |
| 14522: | O:1 S:1 |
| 14523: | H:1 T:3 |
| 14524: | P:2 |
| 14525: | S:2 |
| 14526: | T:3 |
| 14527: | S:2 |
| 14528: | T:2 |
| 14529: | Y:2 |
| 14530: | T:2 |
| 14531: | B:1 E:1 O:1 |
| 14532: | B:4 W:1 Y:1 Z:1 |
| 14533: | B:7 W:2 Y:1 Z:2 |
| 14534: | B:2 |
| 14535: | T:2 |
| 14536: | B:2 |
| 14537: | E:1 T:1 |
| 14538: | B:2 T:1 |
| 14539: | H:1 L:1 O:1 W:1 |
| 14540: | B:2 |
| 14541: | V:3 |
| 14542: | R:1 S:1 T:1 AC:1 |
| 14543: | N:1 P:1 |
| 14544: | Y:2 |
| 14545: | B:1 H:1 O:1 |
| 14546: | J:4 |
| 14547: | B:1 S:1 |
| 14548: | T:2 |
| 14549: | AA:3 |
| 14550: | H:1 AA:1 |
| 14551: | H:2 |
| 14552: | H:2 |
| 14553: | B:1 G:1 |
| 14554: | G:1 Y:1 |
| 14555: | B:3 C:2 D:1 E:1 G:4 H:4 J:2 K:4 L:1 O:1 P:3 Q:2 R:2 S:3 Z:5 AA:3 AC:3 |
| 14556: | B:3 C:2 D:1 E:1 G:3 H:3 J:2 K:4 L:1 O:1 P:2 Q:1 R:2 S:3 Z:3 AA:2 AC:3 |
| 14557: | F:1 W:1 |
| 14558: | P:2 T:1 |
| 14559: | W:2 |
| 14560: | G:2 |
| 14561: | AA:2 |
| 14562: | B:1 AA:1 |
| 14563: | Y:1 AA:1 |
| 14564: | O:1 Q:1 Y:1 AC:4 |
| 14565: | B:1 G:1 AC:1 |
| 14566: | O:1 W:1 |
| 14567: | S:3 |
| 14568: | C:1 E:1 |
| 14569: | T:3 |
| 14570: | H:1 P:1 |
| 14571: | B:2 |
| 14572: | E:1 AC:1 |
| 14573: | B:3 F:1 G:1 L:1 W:1 AD:1 |
| 14574: | AA:2 |
| 14575: | G:1 V:2 |
| 14576: | B:2 |
| 14577: | F:1 S:1 |
| 14578: | D:2 |
| 14579: | B:4 G:1 |
| 14580: | B:4 G:1 |
| 14581: | AA:4 |
| 14582: | B:2 |
| 14583: | E:2 |
| 14584: | G:1 O:2 |
| 14585: | Q:1 T:1 |
| 14586: | H:2 |
| 14587: | B:1 H:1 S:1 |
| 14588: | B:1 H:1 S:1 |
| 14589: | B:5 C:1 E:1 G:4 K:1 N:3 P:2 S:1 T:1 Y:1 AA:3 AD:1 |
| 14590: | B:6 C:1 E:1 G:6 K:1 N:5 O:1 P:2 S:2 T:2 Y:4 AA:5 AD:2 |
| 14591: | T:3 |
| 14592: | C:1 X:1 |
| 14593: | B:1 T:2 |
| 14594: | X:1 AC:1 |
| 14595: | X:1 AD:1 |
| 14596: | AA:2 |
| 14597: | E:1 N:1 |
| 14598: | G:2 |
| 14599: | A:4 B:42 C:28 D:2 E:41 F:6 G:69 H:61 I:1 J:6 K:6 L:6 N:19 O:18 P:14 R:2 S:8 T:44 V:7 W:4 X:10 Y:4 AA:51 AC:4 AD:9 |
| 14600: | A:5 B:46 C:41 D:3 E:48 F:9 G:99 H:82 I:1 J:7 K:10 L:6 N:19 O:28 P:19 R:2 S:12 T:55 V:8 W:4 X:15 Y:7 AA:63 AC:6 AD:10 |
| 14601: | B:16 C:7 E:10 F:1 G:6 H:1 J:1 L:2 N:9 O:5 P:4 S:1 T:10 V:4 X:3 AA:11 |
| 14602: | T:5 |
| 14603: | B:2 |
| 14604: | K:1 Y:1 |
| 14605: | H:1 S:1 Y:2 |
| 14606: | B:1 S:1 Y:2 |

TABLE II-continued

| SEQ ID NO. | Spatial Distribution |
|---|---|
| 14607: | B:3 |
| 14608: | B:3 C:1 L:1 W:1 |
| 14609: | T:2 |
| 14610: | B:2 |
| 14611: | C:1 T:1 |
| 14612: | T:2 |
| 14613: | T:2 |
| 14614: | J:2 |
| 14615: | B:2 |
| 14616: | H:2 P:1 |
| 14617: | AA:3 |
| 14618: | H:1 T:1 |
| 14619: | V:2 |
| 14620: | H:2 |
| 14621: | S:1 AA:1 |
| 14622: | B:1 T:2 |
| 14623: | O:2 |
| 14624: | G:1 T:1 |
| 14625: | B:1 L:1 |
| 14626: | V:2 |
| 14627: | O:1 AA:1 |
| 14628: | B:2 |
| 14629: | B:2 |
| 14630: | H:2 |
| 14631: | H:2 |
| 14632: | B:1 K:2 |
| 14633: | R:2 |
| 14634: | E:1 T:1 |
| 14635: | AA:2 |
| 14636: | H:1 S:1 |
| 14637: | C:1 E:1 |
| 14638: | T:1 AA:1 |
| 14639: | T:2 |
| 14640: | T:3 |
| 14641: | S:2 |
| 14642: | T:2 |
| 14643: | L:1 T:1 |
| 14644: | W:2 |
| 14645: | B:2 |
| 14646: | B:2 |
| 14647: | J:1 T:2 |
| 14648: | V:4 |
| 14649: | B:2 |
| 14650: | C:1 AA:1 |
| 14651: | N:3 |
| 14652: | N:3 |
| 14653: | B:2 T:1 |
| 14654: | T:2 |
| 14655: | B:2 |
| 14656: | T:2 |
| 14657: | G:5 H:2 O:1 P:2 T:2 X:1 Y:1 AA:3 |
| 14658: | G:2 |
| 14659: | K:1 AA:2 |
| 14660: | D:3 |
| 14661: | L:1 AA:1 |
| 14662: | G:1 H:1 T:1 |
| 14663: | Y:1 AD:1 |
| 14664: | B:19 C:2 G:5 W:4 Y:1 |
| 14665: | AD:2 |
| 14666: | Y:2 |
| 14667: | B:1 S:1 |
| 14668: | B:2 |
| 14669: | T:2 |
| 14670: | C:1 G:1 |
| 14671: | AD:2 |
| 14672: | T:3 |
| 14673: | H:1 Q:1 |
| 14674: | B:2 |
| 14675: | S:1 Y:1 |
| 14676: | B:2 E:1 G:3 H:1 S:1 Z:1 AD:1 |
| 14677: | B:1 E:1 G:4 H:2 S:1 Z:1 AD:1 |
| 14678: | B:2 |
| 14679: | B:1 K:1 L:1 P:1 S:3 Y:1 |
| 14680: | B:1 V:1 |
| 14681: | B:2 |
| 14682: | B:1 G:1 |
| 14683: | B:3 |
| 14684: | W:2 |
| 14685: | H:1 T:1 |
| 14686: | B:1 F:1 H:2 |
| 14687: | O:2 |
| 14688: | T:2 |
| 14689: | W:2 |
| 14690: | Q:1 Z:1 |
| 14691: | W:2 |
| 14692: | B:2 |
| 14693: | P:3 |
| 14694: | W:1 |
| 14695: | C:1 T:1 |
| 14696: | T:2 |
| 14697: | C:1 H:1 |
| 14698: | K:1 S:1 |
| 14699: | B:1 C:1 Q:1 |
| 14700: | B:3 |
| 14701: | C:1 L:1 |
| 14702: | B:1 S:1 |
| 14703: | B:1 C:1 H:1 |
| 14704: | H:2 |
| 14705: | N:1 S:1 |
| 14706: | T:3 |
| 14707: | B:1 Y:1 |
| 14708: | S:1 U:1 |
| 14709: | D:2 |
| 14710: | T:4 |
| 14711: | P:2 |
| 14712: | G:2 |
| 14713: | H:2 |
| 14714: | H:2 |
| 14715: | S:1 T:1 |
| 14716: | T:2 |
| 14717: | B:1 Y:1 |
| 14718: | AA:2 |
| 14719: | B:2 S:1 |
| 14720: | G:1 H:1 |
| 14721: | C:1 AC:1 |
| 14722: | D:1 G:1 |
| 14723: | C:2 |
| 14724: | B:1 R:1 |
| 14725: | P:2 |
| 14726: | B:2 |
| 14727: | G:2 |
| 14728: | R:2 |
| 14729: | T:2 |
| 14730: | AA:2 |
| 14731: | H:2 |
| 14732: | B:64 S:1 W:37 Y:31 |
| 14733: | B:40 S:1 W:25 Y:25 |
| 14734: | B:71 S:2 W:50 Y:34 |
| 14735: | X:2 |
| 14736: | C:1 S:1 |
| 14737: | G:1 W:1 |
| 14738: | G:2 |
| 14739: | L:2 |
| 14740: | V:2 |
| 14741: | B:1 S:1 |
| 14742: | U:2 |
| 14743: | P:2 |
| 14744: | R:2 |
| 14745: | B:2 |
| 14746: | C:1 W:1 |
| 14747: | X:2 |
| 14748: | C:1 S:1 T:1 |
| 14749: | B:3 |
| 14750: | B:1 H:1 |
| 14751: | K:1 T:1 |
| 14752: | H:2 |
| 14753: | B:2 C:2 H:5 K:2 N:1 V:1 Y:1 AC:1 |
| 14754: | B:1 Y:1 |
| 14755: | R:2 |
| 14756: | H:1 K:1 |
| 14757: | H:1 AC:1 |
| 14758: | R:2 |
| 14759: | D:2 Q:1 |
| 14760: | O:1 W:1 |

TABLE II-continued

| SEQ ID NO. | Spatial Distribution |
|---|---|
| 14761: | B:1 C:3 E:1 F:1 P:1 |
| 14762: | T:2 |
| 14763: | H:1 X:1 |
| 14764: | AA:2 |
| 14765: | P:2 |
| 14766: | B:2 |
| 14767: | T:2 |
| 14768: | S:2 |
| 14769: | T:2 |
| 14770: | H:1 K:3 S:17 T:1 W:2 AC:9 AD:3 |
| 14771: | T:2 |
| 14772: | AA:2 |
| 14773: | B:2 |
| 14774: | B:2 |
| 14775: | B:1 G:1 |
| 14776: | G:2 Z:1 AA:3 |
| 14777: | A:2 B:30 C:35 D:5 E:6 F:1 G:12 H:51 I:2 J:1 K:24 N:3 O:7 P:23 Q:14 R:9 S:57 T:8 U:9 V:7 W:6 X:8 Y:14 Z:4 AA:35 AB:1 AC:10 AD:28 |
| 14778: | A:2 B:27 C:32 D:5 E:5 F:1 G:11 H:48 I:2 J:1 K:24 N:2 O:6 P:21 Q:14 R:8 S:54 T:8 U:8 V:7 W:5 X:8 Y:12 Z:4 AA:33 AB:1 AC:9 AD:28 |
| 14779: | A:2 B:28 C:35 D:5 E:6 F:1 G:12 H:50 I:2 J:1 K:23 N:3 O:7 P:21 Q:14 R:8 S:57 T:8 U:9 V:7 W:6 X:8 Y:13 Z:4 AA:35 AB:1 AC:10 AD:28 |
| 14780: | C:1 H:4 K:1 T:1 Y:1 |
| 14781: | B:1 C:1 H:9 K:1 T:1 Y:2 |
| 14782: | B:1 C:1 |
| 14783: | C:2 H:8 K:7 N:2 S:3 T:5 Y:1 |
| 14784: | R:1 AA:1 |
| 14785: | AA:2 |
| 14786: | C:17 K:15 S:32 |
| 14787: | C:23 K:21 S:57 |
| 14788: | O:2 |
| 14789: | O:6 |
| 14790: | S:3 |
| 14791: | P:2 |
| 14792: | AA:4 |
| 14793: | B:4 |
| 14794: | B:12 Y:10 |
| 14795: | B:3 E:3 G:3 H:6 K:1 N:1 P:2 S:1 W:4 Y:1 AC:2 AD:1 |
| 14796: | B:4 E:3 G:3 H:9 K:1 N:1 P:5 S:3 W:3 Y:2 AC:2 AD:1 |
| 14797: | A:2 B:119 C:10 F:4 G:26 H:38 J:2 K:5 O:3 P:16 Q:6 R:3 S:18 T:11 W:14 X:6 Y:9 Z:2 AA:5 AC:5 |
| 14798: | A:2 B:104 C:10 F:4 G:24 H:33 J:2 K:4 O:2 P:16 Q:6 R:3 S:18 T:11 W:11 X:6 Y:8 Z:2 AA:5 AC:5 |
| 14799: | A:1 B:105 C:10 F:5 G:22 H:41 J:2 K:5 O:2 P:13 Q:7 R:3 S:17 T:10 W:13 X:7 Y:8 Z:1 AA:6 AC:5 |
| 14800: | A:1 B:54 C:5 F:2 G:11 H:15 J:1 K:2 O:1 P:9 Q:3 R:1 S:8 T:7 W:5 X:3 Y:4 Z:1 AA:3 AC:2 |
| 14801: | A:2 B:113 C:11 F:5 G:22 H:37 J:2 K:5 O:2 P:18 Q:7 R:2 S:17 T:15 W:12 X:6 Y:9 Z:2 AA:6 AC:4 |
| 14802: | B:1 T:4 |
| 14803: | B:1 T:9 Y:2 AA:2 AD:2 |
| 14804: | R:3 |
| 14805: | B:2 |
| 14806: | B:2 P:1 |
| 14807: | B:1 C:8 E:12 F:3 G:2 H:6 K:1 O:2 P:1 Q:3 S:4 T:15 W:2 X:2 Y:1 AA:6 AC:3 AD:3 |
| 14808: | B:29 C:3 H:12 N:3 P:9 S:3 T:24 AA:6 |
| 14809: | B:29 C:3 H:12 N:3 P:9 S:3 T:24 AA:8 |
| 14810: | B:1 S:2 |
| 14811: | R:1 X:1 |
| 14812: | B:8 E:2 F:2 H:1 N:2 S:2 Z:1 |
| 14813: | AA:2 |
| 14814: | B:3 |
| 14815: | H:2 S:2 |
| 14816: | B:3 C:4 D:1 E:1 G:11 H:8 I:1 K:4 O:1 P:1 S:2 X:1 Y:2 Z:1 AA:2 |
| 14817: | B:3 C:4 D:1 E:1 G:11 H:8 I:1 K:4 O:1 P:1 S:2 X:1 Y:2 Z:1 AA:2 |
| 14818: | H:3 |
| 14819: | B:6 E:1 G:3 H:3 K:2 O:1 S:1 T:4 |
| 14820: | C:1 H:2 N:2 R:2 S:4 T:2 |
| 14821: | Y:2 |
| 14822: | B:2 |
| 14823: | T:2 |
| 14824: | H:4 AD:1 |
| 14825: | G:2 U:1 |
| 14826: | G:2 U:1 |
| 14827: | B:24 C:6 E:5 F:2 G:17 H:1 J:5 K:2 N:8 O:2 P:4 R:2 S:2 T:1 U:3 Y:5 Z:1 AA:14 AC:2 |
| 14828: | G:3 P:1 S:3 W:1 AA:1 |
| 14829: | G:3 P:1 S:3 W:1 AA:1 |
| 14830: | AA:2 |
| 14831: | B:1 H:1 O:1 P:2 V:1 AA:6 |
| 14832: | B:1 H:2 O:2 P:2 V:1 AA:8 |
| 14833: | K:7 S:5 T:9 Y:1 AC:3 |
| 14834: | S:2 |
| 14835: | B:4 C:10 E:1 G:1 H:8 K:2 O:3 P:4 R:2 S:4 T:2 U:2 V:1 Y:1 Z:1 AA:1 AC:2 AD:3 |
| 14836: | O:2 T:4 |
| 14837: | T:4 |
| 14838: | D:2 |
| 14839: | B:1 S:2 |
| 14840: | B:1 Y:1 AD:2 |
| 14841: | R:3 |
| 14842: | D:4 |
| 14843: | T:3 |
| 14844: | H:3 |
| 14845: | K:4 |
| 14846: | A:1 B:6 E:4 G:1 H:6 N:2 O:4 P:1 Q:2 S:1 T:6 V:1 W:2 AA:3 AD:1 |
| 14847: | O:1 Q:1 T:1 |
| 14848: | B:4 E:3 F:1 G:1 H:3 J:1 K:1 L:1 N:1 T:5 V:1 X:1 |
| 14849: | A:2 B:10 E:7 F:1 G:2 H:10 J:1 K:1 L:1 N:3 O:4 P:1 Q:1 S:1 T:11 V:2 W:2 X:1 AA:3 AD:1 |
| 14850: | AA:2 |
| 14851: | X:1 AD:1 |
| 14852: | A:1 B:6 C:1 G:1 H:3 J:1 P:1 Q:1 S:3 T:1 V:3 W:2 Y:1 AA:2 AD:2 |
| 14853: | A:1 W:2 |
| 14854: | B:2 |
| 14855: | AA:4 |
| 14856: | G:1 Y:1 |
| 14857: | O:1 P:2 Q:1 |
| 14858: | B:2 C:2 E:1 G:2 H:2 K:1 O:3 P:1 Q:1 R:5 S:3 T:7 U:2 V:1 W:2 X:1 Y:1 Z:1 AA:7 |
| 14859: | C:1 F:2 S:2 T:3 Z:1 |
| 14860: | C:2 F:7 S:2 T:10 Z:3 |
| 14861: | B:2 C:3 G:1 H:4 K:1 L:1 O:2 P:4 S:3 W:1 AA:2 |
| 14862: | F:1 N:3 |
| 14863: | C:1 H:4 T:1 W:1 AA:4 |
| 14864: | AA:3 |
| 14865: | B:1 G:4 H:8 S:3 Y:1 Z:1 AA:17 |
| 14866: | C:5 |
| 14867: | AA:4 |
| 14868: | B:1 G:9 H:2 X:4 AA:2 |
| 14869: | G:2 P:1 |

TABLE II-continued

| SEQ ID NO. | Spatial Distribution |
|---|---|
| 14870: | AA:5 |
| 14871: | C:2 H:1 I:2 V:1 |
| 14872: | T:3 |
| 14873: | B:1 C:3 H:1 K:2 S:2 |
| 14874: | B:27 C:44 D:4 E:11 F:3 G:18 H:153 I:4 J:7 K:18 L:2 N:3 O:17 P:36 Q:8 R:4 S:41 T:7 V:4 W:5 X:4 Y:15 Z:20 AA:120 AC:3 AD:21 |
| 14875: | B:36 C:63 D:4 E:15 F:4 G:23 H:329 I:5 J:12 K:30 L:3 N:3 O:25 P:53 Q:13 R:10 S:63 T:10 V:3 W:10 X:5 Y:21 Z:28 AA:212 AC:2 AD:28 |
| 14876: | B:52 C:88 D:7 E:21 F:6 G:32 H:348 I:8 J:15 K:43 L:5 N:5 O:31 P:69 Q:16 R:13 S:84 T:13 V:4 W:12 X:9 Y:28 Z:37 AA:221 AC:5 AD:41 |
| 14877: | B:50 C:76 D:7 E:21 F:6 G:29 H:274 I:8 J:14 K:30 L:4 N:5 O:29 P:65 Q:16 R:9 S:75 T:13 V:4 W:9 X:8 Y:24 Z:35 AA:192 AC:5 AD:32 |
| 14878: | B:53 C:84 D:7 E:21 F:7 G:34 H:393 I:8 J:14 K:37 L:5 N:5 O:31 P:70 Q:16 R:14 S:83 T:14 V:4 W:13 X:8 Y:26 Z:39 AA:242 AC:5 AD:37 |
| 14879: | B:39 C:68 D:4 E:16 F:5 G:23 H:334 I:5 J:14 K:31 L:3 N:4 O:25 P:52 Q:13 R:10 S:65 T:21 U:4 V:3 W:10 X:5 Y:21 Z:28 AA:213 AC:2 AD:28 |
| 14880: | B:5 C:2 H:2 O:3 P:1 Q:1 S:9 W:1 X:2 Y:1 AC:2 |
| 14881: | B:2 H:2 AA:3 AC:1 |
| 14882: | N:2 |
| 14883: | D:2 X:1 Y:2 AA:1 AD:1 |
| 14884: | W:3 |
| 14885: | AA:2 |
| 14886: | B:3 |
| 14887: | B:2 |
| 14888: | B:23 C:1 D:1 E:4 F:2 G:9 H:20 J:3 K:6 O:7 P:19 Q:2 R:6 S:20 T:5 W:2 X:3 Y:7 AA:8 AC:7 AD:3 |
| 14889: | B:21 C:1 D:1 E:3 F:2 G:8 H:18 J:2 K:6 O:7 P:19 Q:2 R:6 S:16 T:5 W:2 X:3 Y:7 AA:7 AC:6 AD:1 |
| 14890: | O:2 |
| 14891: | B:4 |
| 14892: | AA:4 |
| 14893: | AA:63 |
| 14894: | R:2 |
| 14895: | V:4 |
| 14896: | B:1 K:3 T:3 Z:1 AA:13 AC:1 AD:5 |
| 14897: | B:1 K:3 T:6 Z:1 AA:12 AC:1 AD:5 |
| 14898: | B:1 D:3 H:2 R:1 T:2 AC:2 |
| 14899: | O:2 S:1 |
| 14900: | B:6 D:8 E:2 G:8 H:16 I:3 J:1 K:2 N:2 O:1 P:7 R:2 S:6 T:7 U:4 V:1 W:7 Y:4 AA:3 AC:2 AD:6 |
| 14901: | B:6 D:8 E:1 G:8 H:14 I:3 J:1 K:2 N:2 O:1 P:7 R:2 S:6 T:7 U:4 V:80 W:7 Y:3 AA:3 AC:1 AD:6 |
| 14902: | V:118 |
| 14903: | V:130 |
| 14904: | V:121 |
| 14905: | V:144 |
| 14906: | V:107 |
| 14907: | D:20 |
| 14908: | Z:1 AA:1 |
| 14909: | B:8 C:6 E:2 G:6 H:6 K:5 O:6 P:2 Q:4 S:4 T:6 X:2 AA:4 AC:2 AD:2 |
| 14910: | H:3 |
| 14911: | Y:1 AA:1 |
| 14912: | B:2 |
| 14913: | B:14 C:7 D:1 E:2 F:1 G:5 H:1 K:1 N:1 O:2 Q:1 R:2 T:7 V:2 W:1 Y:3 Z:2 AA:7 AC:1 AD:1 |
| 14914: | B:6 C:1 G:1 |
| 14915: | B:1 G:1 H:4 J:2 N:1 S:2 |
| 14916: | C:1 S:1 |
| 14917: | L:4 |
| 14918: | B:27 C:11 E:6 G:5 J:1 N:2 O:2 P:1 R:4 S:5 T:5 W:3 X:1 Y:1 AC:2 |
| 14919: | B:26 C:7 E:5 G:3 J:1 N:2 O:2 P:1 R:2 S:5 T:5 W:2 X:1 Y:1 AC:2 |
| 14920: | H:1 T:2 |
| 14921: | B:1 C:1 H:4 K:1 S:2 W:1 Y:1 AA:4 |
| 14922: | B:2 C:1 H:4 K:1 S:2 W:2 Y:1 AA:3 |
| 14923: | B:2 |
| 14924: | A:3 B:7 C:30 F:2 G:29 H:53 I:1 J:3 K:16 L:1 N:4 O:8 P:32 Q:8 R:9 S:30 T:6 U:3 W:2 X:5 Y:3 Z:1 AA:13 AC:5 AD:20 |
| 14925: | G:1 H:1 T:1 |
| 14926: | C:5 H:14 P:1 AC:5 |
| 14927: | C:2 D:2 H:1 K:4 P:1 S:3 T:2 AA:5 |
| 14928: | B:13 C:14 E:2 F:2 G:17 H:58 I:1 J:1 K:6 N:1 O:7 P:8 Q:5 R:6 S:25 T:10 U:1 V:2 W:4 X:3 Y:3 Z:2 AA:4 AC:3 AD:5 |
| 14929: | A:8 B:81 C:13 D:28 E:3 F:13 G:22 H:78 I:19 J:16 K:9 L:9 N:80 O:34 P:35 Q:3 R:36 S:48 T:66 V:3 W:43 X:5 Y:29 Z:21 AA:68 AB:1 AC:19 AD:18 |
| 14930: | N:16 P:5 X:5 |
| 14931: | B:19 C:12 D:1 E:3 F:5 G:6 H:10 K:8 L:1 N:1 P:3 R:9 S:8 T:3 W:5 Y:3 AA:8 AC:4 AD:1 |
| 14932: | B:5 C:3 E:1 F:2 G:4 H:13 K:2 L:1 O:6 P:5 S:5 T:10 V:4 W:7 X:1 Y:1 AA:4 AC:3 |
| 14933: | B:38 D:1 H:6 J:4 K:3 O:4 S:3 T:6 U:13 V:3 W:7 X:3 Y:18 Z:7 AA:23 AC:35 |
| 14934: | B:33 D:1 H:5 J:2 K:2 O:2 S:2 T:4 U:10 V:2 W:7 X:2 Y:18 Z:4 AA:15 AC:23 |
| 14935: | F:38 R:2 AD:2 |
| 14936: | B:18 C:4 D:5 F:3 H:4 J:9 K:2 P:2 R:39 S:6 T:2 V:1 W:29 Y:15 Z:1 AA:13 AC:7 AD:1 |
| 14937: | B:25 C:7 D:6 F:5 H:7 J:10 K:4 P:3 R:50 S:6 T:3 V:1 W:35 Y:22 Z:2 AA:18 AC:12 AD:2 |
| 14938: | B:17 C:4 D:5 F:3 H:4 J:9 K:2 P:2 R:39 S:6 T:2 V:1 W:30 Y:15 Z:1 AA:13 AC:7 AD:1 |
| 14939: | B:30 C:55 D:4 E:12 F:5 G:22 H:261 I:4 J:9 K:23 L:3 N:4 O:18 P:36 Q:8 R:9 S:48 T:19 U:4 V:4 W:9 X:4 Y:17 Z:22 AA:150 AC:3 AD:23 |
| 14940: | B:90 C:11 E:6 F:2 G:35 H:37 I:2 J:2 K:7 N:3 O:10 P:13 Q:14 R:10 S:16 T:3 W:6 X:7 Y:10 Z:4 AA:11 AC:11 |
| 14941: | B:63 C:5 G:16 H:11 I:1 K:13 L:1 N:1 O:4 P:2 Q:1 S:6 T:1 V:5 W:1 Y:1 Z:1 AA:4 AC:1 |
| 14942: | B:18 C:4 D:5 F:3 H:4 J:9 K:2 P:2 R:39 S:7 T:2 V:1 W:29 Y:15 Z:1 AA:13 AC:9 AD:1 |
| 14943: | A:9 B:55 C:13 D:28 E:3 F:13 G:21 H:80 I:19 J:16 K:8 L:9 N:81 O:36 P:32 Q:3 R:36 S:48 T:66 V:3 W:43 X:6 Y:28 Z:21 AA:69 AB:1 AC:19 AD:18 |
| 14944: | B:13 C:13 E:2 F:1 G:17 H:49 I:1 J:1 K:6 N:1 O:7 P:7 Q:5 R:6 S:22 T:10 U:1 V:2 W:4 X:3 Y:3 Z:2 AA:4 AC:3 AD:5 |

TABLE II-continued

| SEQ ID NO. | Spatial Distribution |
|---|---|
| 14945: | A:1 B:58 C:24 E:5 F:4 G:16 H:17 I:3 J:9 K:7 N:7 O:4 P:4 Q:1 R:11 S:16 U:2 V:3 W:4 X:1 Y:20 Z:4 AA:24 AB:2 AC:8 AD:1 |
| 14946: | B:4 N:1 O:1 U:1 |
| 14947: | B:38 C:4 H:16 N:4 P:11 S:4 T:32 AA:10 |
| 14948: | B:1 E:1 G:1 H:4 L:1 Q:2 R:1 S:1 X:2 Y:1 |
| 14949: | B:2 G:7 H:5 S:2 |
| 14950: | B:92 C:11 E:6 F:2 G:35 H:37 I:2 J:2 K:7 N:3 O:9 P:13 Q:14 R:10 S:16 T:3 W:6 X:7 Y:10 Z:4 AA:11 AC:11 |
| 14951: | B:64 C:5 G:15 H:11 I:1 K:13 L:1 N:1 O:4 P:2 Q:1 S:6 T:1 V:5 W:1 Y:1 Z:1 AA:4 AC:1 |
| 14952: | A:1 I:3 N:108 |
| 14953: | B:17 G:5 |
| 14954: | A:1 B:59 C:27 E:6 F:4 G:17 H:20 I:3 J:10 K:7 N:7 O:4 P:4 Q:1 R:13 S:18 U:2 V:3 W:4 X:1 Y:23 Z:4 AA:25 AB:2 AC:8 AD:1 |
| 14955: | N:10 P:3 X:4 |
| 14956: | H:3 K:1 O:4 U:1 |
| 14957: | B:65 C:252 D:8 E:6 F:9 G:90 H:178 I:7 J:25 K:234 N:16 O:38 P:77 Q:24 R:23 S:233 T:38 U:25 V:5 W:24 X:18 Y:22 Z:14 AA:101 AB:2 AC:34 AD:95 |
| 14958: | B:1 E:1 H:2 K:2 O:2 R:1 T:2 |
| 14959: | C:2 S:17 |
| 14960: | B:15 D:5 G:4 H:8 K:5 P:11 Q:2 S:6 T:17 W:2 X:2 AA:2 AC:2 AD:1 |
| 14961: | B:11 S:1 Y:8 |
| 14962: | H:14 |
| 14963: | B:12 C:3 E:2 F:7 G:8 H:22 J:4 K:2 N:7 O:5 P:3 S:16 T:48 V:2 W:2 X:1 Y:1 Z:3 AA:12 AC:13 AD:7 |
| 14964: | B:80 C:3 D:4 G:3 H:11 N:1 S:1 T:1 W:6 X:6 Y:17 Z:6 AA:5 AD:3 |
| 14965: | B:80 C:333 D:10 E:8 F:11 G:108 H:225 I:9 J:30 K:307 N:18 O:46 P:99 Q:31 R:28 S:302 T:45 U:34 V:7 W:25 X:23 Y:28 Z:18 AA:115 AB:3 AC:43 AD:121 |
| 14966: | B:3 C:6 K:7 S:4 Y:1 |
| 14967: | B:30 E:2 F:4 G:2 T:4 W:1 X:1 Y:2 |
| 14968: | B:50 C:207 D:8 E:6 F:6 G:69 H:137 I:4 J:16 K:191 N:12 O:31 P:54 Q:14 R:18 S:197 T:27 U:17 V:4 W:24 X:15 Y:15 Z:10 AA:84 AB:2 AC:21 AD:76 |
| 14969: | O:3 P:3 |
| 14970: | A:1 I:10 N:181 AA:8 |
| 14971: | S:1 T:2 |
| 14972: | B:3 C:3 H:4 K:4 T:6 W:5 |
| 14973: | B:2 D:3 W:7 Y:9 |
| 14974: | C:2 F:1 J:1 AC:1 |
| 14975: | B:2 H:4 S:2 W:3 AA:3 |
| 14976: | B:9 T:3 Z:3 AC:3 |
| 14977: | H:3 K:1 O:2 U:3 |
| 14978: | B:4 C:2 E:3 G:1 H:2 O:3 P:2 |
| 14979: | B:1 G:1 H:1 O:2 P:2 Q:2 S:2 X:2 Z:1 AA:2 |
| 14980: | A:5 B:25 C:57 E:2 G:31 H:52 I:4 J:2 K:15 N:2 O:6 P:4 Q:1 R:2 S:59 T:12 U:2 W:11 X:4 Y:13 Z:3 AA:6 AC:4 AD:20 |
| 14981: | B:15 C:5 E:3 F:9 G:8 H:23 J:4 K:2 N:9 O:6 P:3 S:16 T:48 V:2 W:2 X:1 Y:1 Z:4 AA:11 AC:18 AD:7 |
| 14982: | B:13 C:31 D:3 E:6 G:13 H:39 J:2 K:12 N:6 O:4 P:15 Q:8 S:27 T:11 V:1 W:3 X:3 Y:8 Z:2 AA:14 AC:9 AD:30 |
| 14983: | B:2 C:5 H:4 K:3 T:4 W:3 |
| 14984: | N:270 AA:12 |
| 14985: | V:1 |
| 14986: | V:1 |
| 14987: | V:1 |
| 14988: | V:1 |
| 14989: | V:1 |
| 14990: | V:1 |
| 14991: | V:1 |
| 14992: | V:1 |
| 14993: | V:1 |
| 14994: | V:1 |
| 14995: | V:1 |
| 14996: | V:1 |
| 14997: | V:1 |
| 14998: | V:1 |
| 14999: | V:1 |
| 15000: | V:1 |
| 15001: | V:1 |
| 15002: | V:1 |
| 15003: | V:1 |
| 15004: | V:1 |
| 15005: | V:1 |
| 15006: | V:1 |
| 15007: | V:1 |
| 15008: | V:1 |
| 15009: | V:1 |
| 15010: | V:1 |
| 15011: | V:1 |
| 15012: | V:1 |
| 15013: | V:1 |
| 15014: | V:1 |
| 15015: | V:1 |
| 15016: | V:1 |
| 15017: | V:1 |
| 15018: | V:1 |
| 15019: | V:1 |
| 15020: | V:1 |
| 15021: | V:1 |
| 15022: | V:1 |
| 15023: | V:1 |
| 15024: | V:1 |
| 15025: | V:1 |
| 15026: | V:1 |
| 15027: | V:1 |
| 15028: | V:1 |
| 15029: | V:1 |
| 15030: | V:1 |
| 15031: | V:1 |
| 15032: | V:1 |
| 15033: | V:1 |
| 15034: | V:1 |
| 15035: | V:1 |
| 15036: | V:1 |
| 15037: | V:1 |
| 15038: | V:1 |
| 15039: | V:1 |
| 15040: | V:1 |
| 15041: | V:1 |
| 15042: | V:1 |
| 15043: | V:1 |
| 15044: | V:1 |
| 15045: | V:1 |
| 15046: | V:1 |
| 15047: | V:1 |
| 15048: | V:1 |
| 15049: | V:1 |
| 15050: | V:1 |
| 15051: | V:1 |
| 15052: | V:1 |
| 15053: | V:1 |
| 15054: | V:1 |
| 15055: | V:1 |
| 15056: | V:1 |
| 15057: | V:1 |

TABLE II-continued

| SEQ ID NO. | Spatial Distribution |
|---|---|
| 15058: | V:1 |
| 15059: | V:1 |
| 15060: | V:1 |
| 15061: | V:1 |
| 15062: | V:1 |
| 15063: | V:1 |
| 15064: | V:1 |
| 15065: | V:1 |
| 15066: | V:1 |
| 15067: | V:1 |
| 15068: | V:1 |
| 15069: | V:1 |
| 15070: | V:1 |
| 15071: | V:1 |
| 15072: | V:1 |
| 15073: | V:1 |
| 15074: | V:1 |
| 15075: | V:1 |
| 15076: | V:1 |
| 15077: | V:1 |
| 15078: | V:1 |
| 15079: | V:1 |
| 15080: | V:1 |
| 15081: | V:1 |
| 15082: | V:1 |
| 15083: | V:1 |
| 15084: | V:1 |
| 15085: | V:1 |
| 15086: | V:1 |
| 15087: | V:1 |
| 15088: | V:1 |
| 15089: | V:1 |
| 15090: | V:1 |
| 15091: | V:1 |
| 15092: | V:1 |
| 15093: | V:1 |
| 15094: | V:1 |
| 15095: | V:1 |
| 15096: | V:1 |
| 15097: | V:1 |
| 15098: | V:1 |
| 15099: | V:1 |
| 15100: | V:1 |
| 15101: | V:1 |
| 15102: | V:1 |
| 15103: | V:1 |
| 15104: | B:1 |
| 15105: | B:1 |
| 15106: | B:1 |
| 15107: | B:1 |
| 15108: | B:1 |
| 15109: | B:1 |
| 15110: | B:1 |
| 15111: | B:1 |
| 15112: | B:1 |
| 15113: | B:1 |
| 15114: | B:1 |
| 15115: | B:1 |
| 15116: | B:1 |
| 15117: | B:1 |
| 15118: | B:1 |
| 15119: | B:1 |
| 15120: | B:1 |
| 15121: | B:1 |
| 15122: | B:1 |
| 15123: | B:1 |
| 15124: | B:1 |
| 15125: | B:1 |
| 15126: | B:1 |
| 15127: | B:1 |
| 15128: | B:1 |
| 15129: | B:1 |
| 15130: | B:1 |
| 15131: | B:1 |
| 15132: | B:1 |
| 15133: | B:1 |
| 15134: | B:1 |
| 15135: | B:1 |
| 15136: | B:1 |
| 15137: | B:1 |
| 15138: | B:1 |
| 15139: | B:1 |
| 15140: | B:1 |
| 15141: | B:1 |
| 15142: | B:1 |
| 15143: | B:1 |
| 15144: | B:1 |
| 15145: | B:1 |
| 15146: | B:1 |
| 15147: | B:1 |
| 15148: | B:1 |
| 15149: | B:1 |
| 15150: | B:1 |
| 15151: | B:1 |
| 15152: | B:1 |
| 15153: | B:1 |
| 15154: | B:1 |
| 15155: | B:1 |
| 15156: | B:1 |
| 15157: | B:1 |
| 15158: | B:1 |
| 15159: | B:1 |
| 15160: | B:1 |
| 15161: | B:1 |
| 15162: | B:1 |
| 15163: | B:1 |
| 15164: | B:1 |
| 15165: | B:1 |
| 15166: | B:1 |
| 15167: | B:1 |
| 15168: | B:1 |
| 15169: | B:1 |
| 15170: | B:1 |
| 15171: | B:1 |
| 15172: | B:1 |
| 15173: | B:1 |
| 15174: | B:1 |
| 15175: | B:1 |
| 15176: | B:1 |
| 15177: | B:1 |
| 15178: | B:1 |
| 15179: | B:1 |
| 15180: | B:1 |
| 15181: | B:1 |
| 15182: | B:1 |
| 15183: | B:1 |
| 15184: | B:1 |
| 15185: | B:1 |
| 15186: | B:1 |
| 15187: | B:1 |
| 15188: | B:1 |
| 15189: | B:1 |
| 15190: | B:1 |
| 15191: | B:1 |
| 15192: | B:1 |
| 15193: | B:1 |
| 15194: | B:1 |
| 15195: | B:1 |
| 15196: | B:1 |
| 15197: | B:1 |
| 15198: | B:1 |
| 15199: | B:1 |
| 15200: | B:1 |
| 15201: | B:1 |
| 15202: | B:1 |
| 15203: | B:1 |
| 15204: | B:1 |
| 15205: | B:1 |
| 15206: | B:1 |
| 15207: | B:1 |
| 15208: | B:1 |
| 15209: | B:1 |
| 15210: | B:1 |
| 15211: | B:1 |

TABLE II-continued

| SEQ ID NO. | Spatial Distribution |
|---|---|
| 15212: | B:1 |
| 15213: | B:1 |
| 15214: | B:1 |
| 15215: | B:1 |
| 15216: | B:1 |
| 15217: | B:1 |
| 15218: | B:1 |
| 15219: | B:1 |
| 15220: | B:1 |
| 15221: | B:1 |
| 15222: | B:1 |
| 15223: | B:1 |
| 15224: | B:1 |
| 15225: | B:1 |
| 15226: | B:1 |
| 15227: | B:1 |
| 15228: | B:1 |
| 15229: | B:1 |
| 15230: | B:1 |
| 15231: | B:1 |
| 15232: | B:1 |
| 15233: | B:1 |
| 15234: | B:1 |
| 15235: | B:1 |
| 15236: | B:1 |
| 15237: | B:1 |
| 15238: | B:1 |
| 15239: | B:1 |
| 15240: | B:1 |
| 15241: | B:1 |
| 15242: | B:1 |
| 15243: | B:1 |
| 15244: | B:1 |
| 15245: | B:1 |
| 15246: | B:1 |
| 15247: | B:1 |
| 15248: | B:1 |
| 15249: | B:1 |
| 15250: | B:1 |
| 15251: | B:1 |
| 15252: | B:1 |
| 15253: | B:1 |
| 15254: | B:1 |
| 15255: | B:1 |
| 15256: | B:1 |
| 15257: | B:1 |
| 15258: | B:1 |
| 15259: | B:1 |
| 15260: | B:1 |
| 15261: | B:1 |
| 15262: | B:1 |
| 15263: | B:1 |
| 15264: | B:1 |
| 15265: | B:1 |
| 15266: | B:1 |
| 15267: | B:1 |
| 15268: | B:1 |
| 15269: | B:1 |
| 15270: | B:1 |
| 15271: | B:1 |
| 15272: | B:1 |
| 15273: | B:1 |
| 15274: | B:1 |
| 15275: | B:1 |
| 15276: | B:1 |
| 15277: | B:1 |
| 15278: | B:1 |
| 15279: | B:1 |
| 15280: | B:1 |
| 15281: | B:1 |
| 15282: | B:1 |
| 15283: | B:1 |
| 15284: | B:1 |
| 15285: | B:1 |
| 15286: | B:1 |
| 15287: | B:1 |
| 15288: | B:1 |
| 15289: | B:1 |
| 15290: | B:1 |
| 15291: | B:1 |
| 15292: | B:1 |
| 15293: | B:1 |
| 15294: | B:1 |
| 15295: | B:1 |
| 15296: | B:1 |
| 15297: | B:1 |
| 15298: | B:1 |
| 15299: | B:1 |
| 15300: | B:1 |
| 15301: | B:1 |
| 15302: | B:1 |
| 15303: | B:1 |
| 15304: | B:1 |
| 15305: | B:1 |
| 15306: | B:1 |
| 15307: | B:1 |
| 15308: | B:1 |
| 15309: | B:1 |
| 15310: | B:1 |
| 15311: | B:1 |
| 15312: | B:1 |
| 15313: | B:1 |
| 15314: | B:1 |
| 15315: | B:1 |
| 15316: | B:1 |
| 15317: | B:1 |
| 15318: | B:1 |
| 15319: | B:1 |
| 15320: | B:1 |
| 15321: | B:1 |
| 15322: | B:1 |
| 15323: | B:1 |
| 15324: | B:1 |
| 15325: | B:1 |
| 15326: | B:1 |
| 15327: | B:1 |
| 15328: | B:1 |
| 15329: | B:1 |
| 15330: | B:1 |
| 15331: | B:1 |
| 15332: | B:1 |
| 15333: | B:1 |
| 15334: | B:1 |
| 15335: | B:1 |
| 15336: | B:1 |
| 15337: | B:1 |
| 15338: | B:1 |
| 15339: | B:1 |
| 15340: | B:1 |
| 15341: | B:1 |
| 15342: | B:1 |
| 15343: | B:1 |
| 15344: | B:1 |
| 15345: | B:1 |
| 15346: | B:1 |
| 15347: | B:1 |
| 15348: | B:1 |
| 15349: | B:1 |
| 15350: | B:1 |
| 15351: | B:1 |
| 15352: | B:1 |
| 15353: | B:1 |
| 15354: | B:1 |
| 15355: | B:1 |
| 15356: | B:1 |
| 15357: | B:1 |
| 15358: | B:1 |
| 15359: | B:1 |
| 15360: | B:1 |
| 15361: | B:1 |
| 15362: | B:1 |
| 15363: | B:1 |
| 15364: | B:1 |
| 15365: | B:1 |

TABLE II-continued

| SEQ ID NO. | Spatial Distribution |
|---|---|
| 15366: | B:1 |
| 15367: | B:1 |
| 15368: | B:1 |
| 15369: | B:1 |
| 15370: | B:1 |
| 15371: | B:1 |
| 15372: | B:1 |
| 15373: | B:1 |
| 15374: | B:1 |
| 15375: | B:1 |
| 15376: | B:1 |
| 15377: | B:1 |
| 15378: | B:1 |
| 15379: | B:1 |
| 15380: | B:1 |
| 15381: | B:1 |
| 15382: | B:1 |
| 15383: | B:1 |
| 15384: | B:1 |
| 15385: | B:1 |
| 15386: | B:1 |
| 15387: | B:1 |
| 15388: | B:1 |
| 15389: | B:1 |
| 15390: | B:1 |
| 15391: | B:1 |
| 15392: | B:1 |
| 15393: | B:1 |
| 15394: | B:1 |
| 15395: | B:1 |
| 15396: | B:1 |
| 15397: | B:1 |
| 15398: | B:1 |
| 15399: | B:1 |
| 15400: | B:1 |
| 15401: | B:1 |
| 15402: | B:1 |
| 15403: | B:1 |
| 15404: | B:1 |
| 15405: | B:1 |
| 15406: | B:1 |
| 15407: | B:1 |
| 15408: | B:1 |
| 15409: | B:1 |
| 15410: | B:1 |
| 15411: | B:1 |
| 15412: | B:1 |
| 15413: | B:1 |
| 15414: | B:1 |
| 15415: | B:1 |
| 15416: | B:1 |
| 15417: | B:1 |
| 15418: | B:1 |
| 15419: | B:1 |
| 15420: | B:1 |
| 15421: | B:1 |
| 15422: | B:1 |
| 15423: | B:1 |
| 15424: | B:1 |
| 15425: | B:1 |
| 15426: | B:1 |
| 15427: | B:1 |
| 15428: | B:1 |
| 15429: | B:1 |
| 15430: | B:1 |
| 15431: | B:1 |
| 15432: | B:1 |
| 15433: | B:1 |
| 15434: | B:1 |
| 15435: | B:1 |
| 15436: | B:1 |
| 15437: | B:1 |
| 15438: | B:1 |
| 15439: | B:1 |
| 15440: | B:1 |
| 15441: | B:1 |
| 15442: | B:1 |
| 15443: | B:1 |
| 15444: | B:1 |
| 15445: | B:1 |
| 15446: | B:1 |
| 15447: | B:1 |
| 15448: | B:1 |
| 15449: | B:1 |
| 15450: | B:1 |
| 15451: | B:1 |
| 15452: | B:1 |
| 15453: | B:1 |
| 15454: | B:1 |
| 15455: | B:1 |
| 15456: | B:1 |
| 15457: | B:1 |
| 15458: | B:1 |
| 15459: | B:1 |
| 15460: | B:1 |
| 15461: | B:1 |
| 15462: | B:1 |
| 15463: | B:1 |
| 15464: | B:1 |
| 15465: | B:1 |
| 15466: | B:1 |
| 15467: | B:1 |
| 15468: | B:1 |
| 15469: | B:1 |
| 15470: | B:1 |
| 15471: | B:1 |
| 15472: | B:1 |
| 15473: | B:1 |
| 15474: | B:1 |
| 15475: | B:1 |
| 15476: | B:1 |
| 15477: | B:1 |
| 15478: | B:1 |
| 15479: | B:1 |
| 15480: | B:1 |
| 15481: | B:1 |
| 15482: | B:1 |
| 15483: | B:1 |
| 15484: | B:1 |
| 15485: | B:1 |
| 15486: | B:1 |
| 15487: | B:1 |
| 15488: | B:1 |
| 15489: | B:1 |
| 15490: | B:1 |
| 15491: | B:1 |
| 15492: | B:1 |
| 15493: | B:1 |
| 15494: | B:1 |
| 15495: | B:1 |
| 15496: | B:1 |
| 15497: | B:1 |
| 15498: | B:1 |
| 15499: | B:1 |
| 15500: | B:1 |
| 15501: | B:1 |
| 15502: | B:1 |
| 15503: | B:1 |
| 15504: | B:1 |
| 15505: | B:1 |
| 15506: | B:1 |
| 15507: | B:1 |
| 15508: | B:1 |
| 15509: | B:1 |
| 15510: | B:1 |
| 15511: | B:1 |
| 15512: | B:1 |
| 15513: | B:1 |
| 15514: | B:1 |
| 15515: | B:1 |
| 15516: | B:1 |
| 15517: | B:1 |
| 15518: | B:1 |
| 15519: | B:1 |

TABLE II-continued

| SEQ ID NO. | Spatial Distribution |
|---|---|
| 15520: | B:1 |
| 15521: | B:1 |
| 15522: | B:1 |
| 15523: | B:1 |
| 15524: | B:1 |
| 15525: | B:1 |
| 15526: | B:1 |
| 15527: | B:1 |
| 15528: | B:1 |
| 15529: | B:1 |
| 15530: | B:1 |
| 15531: | B:1 |
| 15532: | B:1 |
| 15533: | B:1 |
| 15534: | B:1 |
| 15535: | B:1 |
| 15536: | B:1 |
| 15537: | B:1 |
| 15538: | B:1 |
| 15539: | B:1 |
| 15540: | B:1 |
| 15541: | B:1 |
| 15542: | B:1 |
| 15543: | B:1 |
| 15544: | B:1 |
| 15545: | B:1 |
| 15546: | B:1 |
| 15547: | B:1 |
| 15548: | B:1 |
| 15549: | B:1 |
| 15550: | B:1 |
| 15551: | B:1 |
| 15552: | B:1 |
| 15553: | B:1 |
| 15554: | B:1 |
| 15555: | B:1 |
| 15556: | B:1 |
| 15557: | B:1 |
| 15558: | B:1 |
| 15559: | B:1 |
| 15560: | B:1 |
| 15561: | B:1 |
| 15562: | B:1 |
| 15563: | B:1 |
| 15564: | B:1 |
| 15565: | B:1 |
| 15566: | B:1 |
| 15567: | B:1 |
| 15568: | B:1 |
| 15569: | B:1 |
| 15570: | B:1 |
| 15571: | B:1 |
| 15572: | B:1 |
| 15573: | B:1 |
| 15574: | B:1 |
| 15575: | B:1 |
| 15576: | B:1 |
| 15577: | B:1 |
| 15578: | B:1 |
| 15579: | B:1 |
| 15580: | B:1 |
| 15581: | B:1 |
| 15582: | B:1 |
| 15583: | B:1 |
| 15584: | B:1 |
| 15585: | B:1 |
| 15586: | B:1 |
| 15587: | B:1 |
| 15588: | B:1 |
| 15589: | B:1 |
| 15590: | B:1 |
| 15591: | B:1 |
| 15592: | B:1 |
| 15593: | B:1 |
| 15594: | B:1 |
| 15595: | B:1 |
| 15596: | B:1 |
| 15597: | B:1 |
| 15598: | B:1 |
| 15599: | B:1 |
| 15600: | B:1 |
| 15601: | B:1 |
| 15602: | B:1 |
| 15603: | B:1 |
| 15604: | B:1 |
| 15605: | B:1 |
| 15606: | B:1 |
| 15607: | B:1 |
| 15608: | B:1 |
| 15609: | B:1 |
| 15610: | B:1 |
| 15611: | B:1 |
| 15612: | B:1 |
| 15613: | B:1 |
| 15614: | B:1 |
| 15615: | B:1 |
| 15616: | B:1 |
| 15617: | B:1 |
| 15618: | B:1 |
| 15619: | B:1 |
| 15620: | B:1 |
| 15621: | B:1 |
| 15622: | B:1 |
| 15623: | B:1 |
| 15624: | B:1 |
| 15625: | B:1 |
| 15626: | B:1 |
| 15627: | B:1 |
| 15628: | B:1 |
| 15629: | B:1 |
| 15630: | B:1 |
| 15631: | B:1 |
| 15632: | B:1 |
| 15633: | B:1 |
| 15634: | B:1 |
| 15635: | B:1 |
| 15636: | B:1 |
| 15637: | B:1 |
| 15638: | B:1 |
| 15639: | B:1 |
| 15640: | U:1 |
| 15641: | U:1 |
| 15642: | U:1 |
| 15643: | U:1 |
| 15644: | U:1 |
| 15645: | U:1 |
| 15646: | U:1 |
| 15647: | U:1 |
| 15648: | U:1 |
| 15649: | U:1 |
| 15650: | U:1 |
| 15651: | U:1 |
| 15652: | U:1 |
| 15653: | U:1 |
| 15654: | U:1 |
| 15655: | U:1 |
| 15656: | U:1 |
| 15657: | U:1 |
| 15658: | U:1 |
| 15659: | U:1 |
| 15660: | U:1 |
| 15661: | U:1 |
| 15662: | U:1 |
| 15663: | U:1 |
| 15664: | U:1 |
| 15665: | U:1 |
| 15666: | U:1 |
| 15667: | U:1 |
| 15668: | U:1 |
| 15669: | U:1 |
| 15670: | U:1 |
| 15671: | U:1 |
| 15672: | U:1 |
| 15673: | U:1 |

TABLE II-continued

| SEQ ID NO. | Spatial Distribution |
|---|---|
| 15674: | U:1 |
| 15675: | U:1 |
| 15676: | U:1 |
| 15677: | U:1 |
| 15678: | U:1 |
| 15679: | U:1 |
| 15680: | U:1 |
| 15681: | U:1 |
| 15682: | U:1 |
| 15683: | U:1 |
| 15684: | U:1 |
| 15685: | U:1 |
| 15686: | U:1 |
| 15687: | U:1 |
| 15688: | U:1 |
| 15689: | U:1 |
| 15690: | U:1 |
| 15691: | U:1 |
| 15692: | U:1 |
| 15693: | U:1 |
| 15694: | U:1 |
| 15695: | U:1 |
| 15696: | U:1 |
| 15697: | U:1 |
| 15698: | U:1 |
| 15699: | U:1 |
| 15700: | U:1 |
| 15701: | U:1 |
| 15702: | U:1 |
| 15703: | U:1 |
| 15704: | U:1 |
| 15705: | U:1 |
| 15706: | U:1 |
| 15707: | U:1 |
| 15708: | U:1 |
| 15709: | U:1 |
| 15710: | U:1 |
| 15711: | U:1 |
| 15712: | U:1 |
| 15713: | U:1 |
| 15714: | U:1 |
| 15715: | U:1 |
| 15716: | U:1 |
| 15717: | U:1 |
| 15718: | U:1 |
| 15719: | U:1 |
| 15720: | U:1 |
| 15721: | U:1 |
| 15722: | U:1 |
| 15723: | U:1 |
| 15724: | U:1 |
| 15725: | U:1 |
| 15726: | U:1 |
| 15727: | U:1 |
| 15728: | U:1 |
| 15729: | U:1 |
| 15730: | U:1 |
| 15731: | U:1 |
| 15732: | U:1 |
| 15733: | U:1 |
| 15734: | U:1 |
| 15735: | U:1 |
| 15736: | U:1 |
| 15737: | U:1 |
| 15738: | U:1 |
| 15739: | U:1 |
| 15740: | U:1 |
| 15741: | U:1 |
| 15742: | U:1 |
| 15743: | U:1 |
| 15744: | U:1 |
| 15745: | U:1 |
| 15746: | U:1 |
| 15747: | U:1 |
| 15748: | U:1 |
| 15749: | X:1 |
| 15750: | X:1 |
| 15751: | X:1 |
| 15752: | X:1 |
| 15753: | X:1 |
| 15754: | X:1 |
| 15755: | X:1 |
| 15756: | X:1 |
| 15757: | X:1 |
| 15758: | X:1 |
| 15759: | X:1 |
| 15760: | X:1 |
| 15761: | X:1 |
| 15762: | X:1 |
| 15763: | X:1 |
| 15764: | X:1 |
| 15765: | X:1 |
| 15766: | X:1 |
| 15767: | X:1 |
| 15768: | X:1 |
| 15769: | X:1 |
| 15770: | X:1 |
| 15771: | X:1 |
| 15772: | X:1 |
| 15773: | X:1 |
| 15774: | X:1 |
| 15775: | X:1 |
| 15776: | X:1 |
| 15777: | X:1 |
| 15778: | X:1 |
| 15779: | X:1 |
| 15780: | X:1 |
| 15781: | X:1 |
| 15782: | X:1 |
| 15783: | X:1 |
| 15784: | X:1 |
| 15785: | X:1 |
| 15786: | X:1 |
| 15787: | X:1 |
| 15788: | X:1 |
| 15789: | X:1 |
| 15790: | X:1 |
| 15791: | X:1 |
| 15792: | X:1 |
| 15793: | X:1 |
| 15794: | X:1 |
| 15795: | X:1 |
| 15796: | X:1 |
| 15797: | X:1 |
| 15798: | X:1 |
| 15799: | X:1 |
| 15800: | X:1 |
| 15801: | X:1 |
| 15802: | X:1 |
| 15803: | X:1 |
| 15804: | X:1 |
| 15805: | X:1 |
| 15806: | X:1 |
| 15807: | X:1 |
| 15808: | X:1 |
| 15809: | X:1 |
| 15810: | X:1 |
| 15811: | X:1 |
| 15812: | X:1 |
| 15813: | X:1 |
| 15814: | X:1 |
| 15815: | X:1 |
| 15816: | X:1 |
| 15817: | X:1 |
| 15818: | X:1 |
| 15819: | X:1 |
| 15820: | X:1 |
| 15821: | X:1 |
| 15822: | X:1 |
| 15823: | X:1 |
| 15824: | X:1 |
| 15825: | X:1 |
| 15826: | X:1 |
| 15827: | X:1 |

TABLE II-continued

| SEQ ID NO. | Spatial Distribution |
|---|---|
| 15828: | X:1 |
| 15829: | X:1 |
| 15830: | X:1 |
| 15831: | X:1 |
| 15832: | X:1 |
| 15833: | X:1 |
| 15834: | X:1 |
| 15835: | X:1 |
| 15836: | X:1 |
| 15837: | X:1 |
| 15838: | X:1 |
| 15839: | X:1 |
| 15840: | X:1 |
| 15841: | X:1 |
| 15842: | X:1 |
| 15843: | X:1 |
| 15844: | X:1 |
| 15845: | X:1 |
| 15846: | X:1 |
| 15847: | X:1 |
| 15848: | X:1 |
| 15849: | X:1 |
| 15850: | X:1 |
| 15851: | X:1 |
| 15852: | X:1 |
| 15853: | X:1 |
| 15854: | X:1 |
| 15855: | X:1 |
| 15856: | X:1 |
| 15857: | X:1 |
| 15858: | X:1 |
| 15859: | X:1 |
| 15860: | X:1 |
| 15861: | X:1 |
| 15862: | X:1 |
| 15863: | X:1 |
| 15864: | X:1 |
| 15865: | X:1 |
| 15866: | X:1 |
| 15867: | X:1 |
| 15868: | X:1 |
| 15869: | X:1 |
| 15870: | X:1 |
| 15871: | X:1 |
| 15872: | X:1 |
| 15873: | X:1 |
| 15874: | X:1 |
| 15875: | X:1 |
| 15876: | X:1 |
| 15877: | X:1 |
| 15878: | X:1 |
| 15879: | X:1 |
| 15880: | X:1 |
| 15881: | X:1 |
| 15882: | X:1 |
| 15883: | X:1 |
| 15884: | X:1 |
| 15885: | X:1 |
| 15886: | X:1 |
| 15887: | X:1 |
| 15888: | X:1 |
| 15889: | X:1 |
| 15890: | X:1 |
| 15891: | X:1 |
| 15892: | X:1 |
| 15893: | X:1 |
| 15894: | X:1 |
| 15895: | X:1 |
| 15896: | X:1 |
| 15897: | X:1 |
| 15898: | X:1 |
| 15899: | X:1 |
| 15900: | X:1 |
| 15901: | X:1 |
| 15902: | X:1 |
| 15903: | X:1 |
| 15904: | X:1 |
| 15905: | X:1 |
| 15906: | X:1 |
| 15907: | X:1 |
| 15908: | X:1 |
| 15909: | X:1 |
| 15910: | X:1 |
| 15911: | X:1 |
| 15912: | X:1 |
| 15913: | X:1 |
| 15914: | X:1 |
| 15915: | X:1 |
| 15916: | X:1 |
| 15917: | X:1 |
| 15918: | X:1 |
| 15919: | X:1 |
| 15920: | X:1 |
| 15921: | X:1 |
| 15922: | X:1 |
| 15923: | X:1 |
| 15924: | X:1 |
| 15925: | X:1 |
| 15926: | X:1 |
| 15927: | X:1 |
| 15928: | X:1 |
| 15929: | X:1 |
| 15930: | X:1 |
| 15931: | X:1 |
| 15932: | X:1 |
| 15933: | X:1 |
| 15934: | X:1 |
| 15935: | X:1 |
| 15936: | X:1 |
| 15937: | X:1 |
| 15938: | X:1 |
| 15939: | X:1 |
| 15940: | X:1 |
| 15941: | X:1 |
| 15942: | X:1 |
| 15943: | X:1 |
| 15944: | X:1 |
| 15945: | X:1 |
| 15946: | X:1 |
| 15947: | X:1 |
| 15948: | X:1 |
| 15949: | X:1 |
| 15950: | X:1 |
| 15951: | X:1 |
| 15952: | X:1 |
| 15953: | X:1 |
| 15954: | X:1 |
| 15955: | X:1 |
| 15956: | X:1 |
| 15957: | X:1 |
| 15958: | X:1 |
| 15959: | X:1 |
| 15960: | X:1 |
| 15961: | X:1 |
| 15962: | X:1 |
| 15963: | X:1 |
| 15964: | X:1 |
| 15965: | X:1 |
| 15966: | X:1 |
| 15967: | X:1 |
| 15968: | X:1 |
| 15969: | X:1 |
| 15970: | X:1 |
| 15971: | X:1 |
| 15972: | X:1 |
| 15973: | X:1 |
| 15974: | X:1 |
| 15975: | X:1 |
| 15976: | X:1 |
| 15977: | X:1 |
| 15978: | X:1 |
| 15979: | X:1 |
| 15980: | X:1 |
| 15981: | X:1 |

TABLE II-continued

| SEQ ID NO. | Spatial Distribution |
|---|---|
| 15982: | X:1 |
| 15983: | X:1 |
| 15984: | X:1 |
| 15985: | X:1 |
| 15986: | X:1 |
| 15987: | X:1 |
| 15988: | X:1 |
| 15989: | X:1 |
| 15990: | X:1 |
| 15991: | X:1 |
| 15992: | X:1 |
| 15993: | X:1 |
| 15994: | X:1 |
| 15995: | X:1 |
| 15996: | X:1 |
| 15997: | X:1 |
| 15998: | X:1 |
| 15999: | X:1 |
| 16000: | X:1 |
| 16001: | X:1 |
| 16002: | L:1 |
| 16003: | L:1 |
| 16004: | L:1 |
| 16005: | L:1 |
| 16006: | L:1 |
| 16007: | L:1 |
| 16008: | L:1 |
| 16009: | L:1 |
| 16010: | L:1 |
| 16011: | L:1 |
| 16012: | L:1 |
| 16013: | L:1 |
| 16014: | L:1 |
| 16015: | L:1 |
| 16016: | L:1 |
| 16017: | L:1 |
| 16018: | L:1 |
| 16019: | L:1 |
| 16020: | L:1 |
| 16021: | L:1 |
| 16022: | L:1 |
| 16023: | L:1 |
| 16024: | L:1 |
| 16025: | L:1 |
| 16026: | L:1 |
| 16027: | L:1 |
| 16028: | L:1 |
| 16029: | L:1 |
| 16030: | L:1 |
| 16031: | L:1 |
| 16032: | L:1 |
| 16033: | L:1 |
| 16034: | L:1 |
| 16035: | L:1 |
| 16036: | L:1 |
| 16037: | L:1 |
| 16038: | L:1 |
| 16039: | L:1 |
| 16040: | L:1 |
| 16041: | L:1 |
| 16042: | L:1 |
| 16043: | L:1 |
| 16044: | L:1 |
| 16045: | L:1 |
| 16046: | L:1 |
| 16047: | L:1 |
| 16048: | L:1 |
| 16049: | L:1 |
| 16050: | L:1 |
| 16051: | L:1 |
| 16052: | L:1 |
| 16053: | L:1 |
| 16054: | L:1 |
| 16055: | L:1 |
| 16056: | L:1 |
| 16057: | L:1 |
| 16058: | L:1 |
| 16059: | L:1 |
| 16060: | L:1 |
| 16061: | L:1 |
| 16062: | L:1 |
| 16063: | L:1 |
| 16064: | L:1 |
| 16065: | L:1 |
| 16066: | L:1 |
| 16067: | L:1 |
| 16068: | L:1 |
| 16069: | L:1 |
| 16070: | L:1 |
| 16071: | L:1 |
| 16072: | L:1 |
| 16073: | L:1 |
| 16074: | L:1 |
| 16075: | L:1 |
| 16076: | L:1 |
| 16077: | L:1 |
| 16078: | L:1 |
| 16079: | L:1 |
| 16080: | L:1 |
| 16081: | L:1 |
| 16082: | L:1 |
| 16083: | L:1 |
| 16084: | L:1 |
| 16085: | L:1 |
| 16086: | L:1 |
| 16087: | L:1 |
| 16088: | L:1 |
| 16089: | L:1 |
| 16090: | L:1 |
| 16091: | L:1 |
| 16092: | L:1 |
| 16093: | L:1 |
| 16094: | L:1 |
| 16095: | L:1 |
| 16096: | L:1 |
| 16097: | L:1 |
| 16098: | L:1 |
| 16099: | L:1 |
| 16100: | L:1 |
| 16101: | L:1 |
| 16102: | L:1 |
| 16103: | L:1 |
| 16104: | L:1 |
| 16105: | L:1 |
| 16106: | L:1 |
| 16107: | L:1 |
| 16108: | L:1 |
| 16109: | L:1 |
| 16110: | L:1 |
| 16111: | L:1 |
| 16112: | L:1 |
| 16113: | L:1 |
| 16114: | L:1 |
| 16115: | L:1 |
| 16116: | L:1 |
| 16117: | L:1 |
| 16118: | L:1 |
| 16119: | L:1 |
| 16120: | L:1 |
| 16121: | L:1 |
| 16122: | L:1 |
| 16123: | L:1 |
| 16124: | L:1 |
| 16125: | L:1 |
| 16126: | L:1 |
| 16127: | L:1 |
| 16128: | L:1 |
| 16129: | L:1 |
| 16130: | L:1 |
| 16131: | L:1 |
| 16132: | L:1 |
| 16133: | L:1 |
| 16134: | L:1 |
| 16135: | L:1 |

TABLE II-continued

| SEQ ID NO. | Spatial Distribution |
|---|---|
| 16136: | L:1 |
| 16137: | L:1 |
| 16138: | L:1 |
| 16139: | L:1 |
| 16140: | L:1 |
| 16141: | L:1 |
| 16142: | L:1 |
| 16143: | L:1 |
| 16144: | L:1 |
| 16145: | L:1 |
| 16146: | L:1 |
| 16147: | L:1 |
| 16148: | L:1 |
| 16149: | L:1 |
| 16150: | L:1 |
| 16151: | L:1 |
| 16152: | L:1 |
| 16153: | L:1 |
| 16154: | L:1 |
| 16155: | L:1 |
| 16156: | L:1 |
| 16157: | L:1 |
| 16158: | L:1 |
| 16159: | L:1 |
| 16160: | L:1 |
| 16161: | L:1 |
| 16162: | L:1 |
| 16163: | L:1 |
| 16164: | L:1 |
| 16165: | L:1 |
| 16166: | L:1 |
| 16167: | L:1 |
| 16168: | L:1 |
| 16169: | L:1 |
| 16170: | L:1 |
| 16171: | L:1 |
| 16172: | L:1 |
| 16173: | L:1 |
| 16174: | L:1 |
| 16175: | L:1 |
| 16176: | L:1 |
| 16177: | L:1 |
| 16178: | L:1 |
| 16179: | L:1 |
| 16180: | L:1 |
| 16181: | L:1 |
| 16182: | L:1 |
| 16183: | L:1 |
| 16184: | L:1 |
| 16185: | L:1 |
| 16186: | L:1 |
| 16187: | L:1 |
| 16188: | L:1 |
| 16189: | L:1 |
| 16190: | L:1 |
| 16191: | L:1 |
| 16192: | L:1 |
| 16193: | L:1 |
| 16194: | L:1 |
| 16195: | L:1 |
| 16196: | L:1 |
| 16197: | L:1 |
| 16198: | L:1 |
| 16199: | L:1 |
| 16200: | L:1 |
| 16201: | L:1 |
| 16202: | L:1 |
| 16203: | L:1 |
| 16204: | L:1 |
| 16205: | L:1 |
| 16206: | L:1 |
| 16207: | L:1 |
| 16208: | L:1 |
| 16209: | L:1 |
| 16210: | L:1 |
| 16211: | L:1 |
| 16212: | L:1 |
| 16213: | L:1 |
| 16214: | L:1 |
| 16215: | L:1 |
| 16216: | L:1 |
| 16217: | L:1 |
| 16218: | L:1 |
| 16219: | L:1 |
| 16220: | L:1 |
| 16221: | L:1 |
| 16222: | L:1 |
| 16223: | L:1 |
| 16224: | L:1 |
| 16225: | L:1 |
| 16226: | L:1 |
| 16227: | L:1 |
| 16228: | L:1 |
| 16229: | L:1 |
| 16230: | L:1 |
| 16231: | L:1 |
| 16232: | L:1 |
| 16233: | L:1 |
| 16234: | L:1 |
| 16235: | L:1 |
| 16236: | L:1 |
| 16237: | L:1 |
| 16238: | L:1 |
| 16239: | L:1 |
| 16240: | L:1 |
| 16241: | L:1 |
| 16242: | L:1 |
| 16243: | L:1 |
| 16244: | L:1 |
| 16245: | L:1 |
| 16246: | L:1 |
| 16247: | L:1 |
| 16248: | L:1 |
| 16249: | L:1 |
| 16250: | L:1 |
| 16251: | L:1 |
| 16252: | L:1 |
| 16253: | L:1 |
| 16254: | L:1 |
| 16255: | L:1 |
| 16256: | L:1 |
| 16257: | L:1 |
| 16258: | L:1 |
| 16259: | L:1 |
| 16260: | L:1 |
| 16261: | L:1 |
| 16262: | L:1 |
| 16263: | L:1 |
| 16264: | L:1 |
| 16265: | L:1 |
| 16266: | L:1 |
| 16267: | L:1 |
| 16268: | L:1 |
| 16269: | N:1 |
| 16270: | N:1 |
| 16271: | N:1 |
| 16272: | N:1 |
| 16273: | N:1 |
| 16274: | N:1 |
| 16275: | N:1 |
| 16276: | N:1 |
| 16277: | N:1 |
| 16278: | N:1 |
| 16279: | N:1 |
| 16280: | N:1 |
| 16281: | N:1 |
| 16282: | N:1 |
| 16283: | N:1 |
| 16284: | N:1 |
| 16285: | N:1 |
| 16286: | N:1 |
| 16287: | N:1 |
| 16288: | N:1 |
| 16289: | N:1 |

TABLE II-continued

| SEQ ID NO. | Spatial Distribution |
|---|---|
| 16290: | N:1 |
| 16291: | N:1 |
| 16292: | N:1 |
| 16293: | N:1 |
| 16294: | N:1 |
| 16295: | N:1 |
| 16296: | N:1 |
| 16297: | N:1 |
| 16298: | N:1 |
| 16299: | N:1 |
| 16300: | N:1 |
| 16301: | N:1 |
| 16302: | N:1 |
| 16303: | N:1 |
| 16304: | N:1 |
| 16305: | N:1 |
| 16306: | N:1 |
| 16307: | N:1 |
| 16308: | N:1 |
| 16309: | N:1 |
| 16310: | N:1 |
| 16311: | N:1 |
| 16312: | N:1 |
| 16313: | N:1 |
| 16314: | N:1 |
| 16315: | N:1 |
| 16316: | N:1 |
| 16317: | N:1 |
| 16318: | N:1 |
| 16319: | N:1 |
| 16320: | N:1 |
| 16321: | N:1 |
| 16322: | N:1 |
| 16323: | N:1 |
| 16324: | N:1 |
| 16325: | N:1 |
| 16326: | N:1 |
| 16327: | N:1 |
| 16328: | N:1 |
| 16329: | N:1 |
| 16330: | N:1 |
| 16331: | N:1 |
| 16332: | N:1 |
| 16333: | N:1 |
| 16334: | N:1 |
| 16335: | N:1 |
| 16336: | N:1 |
| 16337: | N:1 |
| 16338: | N:1 |
| 16339: | N:1 |
| 16340: | N:1 |
| 16341: | N:1 |
| 16342: | N:1 |
| 16343: | N:1 |
| 16344: | N:1 |
| 16345: | N:1 |
| 16346: | N:1 |
| 16347: | N:1 |
| 16348: | N:1 |
| 16349: | N:1 |
| 16350: | N:1 |
| 16351: | N:1 |
| 16352: | N:1 |
| 16353: | N:1 |
| 16354: | N:1 |
| 16355: | N:1 |
| 16356: | N:1 |
| 16357: | N:1 |
| 16358: | N:1 |
| 16359: | N:1 |
| 16360: | N:1 |
| 16361: | N:1 |
| 16362: | N:1 |
| 16363: | N:1 |
| 16364: | N:1 |
| 16365: | N:1 |
| 16366: | N:1 |
| 16367: | N:1 |
| 16368: | N:1 |
| 16369: | N:1 |
| 16370: | N:1 |
| 16371: | N:1 |
| 16372: | N:1 |
| 16373: | N:1 |
| 16374: | N:1 |
| 16375: | N:1 |
| 16376: | N:1 |
| 16377: | N:1 |
| 16378: | N:1 |
| 16379: | N:1 |
| 16380: | N:1 |
| 16381: | N:1 |
| 16382: | N:1 |
| 16383: | N:1 |
| 16384: | N:1 |
| 16385: | N:1 |
| 16386: | N:1 |
| 16387: | N:1 |
| 16388: | N:1 |
| 16389: | N:1 |
| 16390: | N:1 |
| 16391: | N:1 |
| 16392: | N:1 |
| 16393: | N:1 |
| 16394: | N:1 |
| 16395: | N:1 |
| 16396: | N:1 |
| 16397: | N:1 |
| 16398: | N:1 |
| 16399: | N:1 |
| 16400: | N:1 |
| 16401: | N:1 |
| 16402: | N:1 |
| 16403: | N:1 |
| 16404: | N:1 |
| 16405: | N:1 |
| 16406: | N:1 |
| 16407: | N:1 |
| 16408: | N:1 |
| 16409: | N:1 |
| 16410: | N:1 |
| 16411: | N:1 |
| 16412: | N:1 |
| 16413: | N:1 |
| 16414: | N:1 |
| 16415: | N:1 |
| 16416: | N:1 |
| 16417: | N:1 |
| 16418: | N:1 |
| 16419: | N:1 |
| 16420: | N:1 |
| 16421: | N:1 |
| 16422: | N:1 |
| 16423: | N:1 |
| 16424: | N:1 |
| 16425: | N:1 |
| 16426: | N:1 |
| 16427: | N:1 |
| 16428: | N:1 |
| 16429: | N:1 |
| 16430: | N:1 |
| 16431: | N:1 |
| 16432: | N:1 |
| 16433: | N:1 |
| 16434: | N:1 |
| 16435: | N:1 |
| 16436: | N:1 |
| 16437: | N:1 |
| 16438: | N:1 |
| 16439: | N:1 |
| 16440: | N:1 |
| 16441: | N:1 |
| 16442: | N:1 |
| 16443: | N:1 |

TABLE II-continued

| SEQ ID NO. | Spatial Distribution |
|---|---|
| 16444: | N:1 |
| 16445: | N:1 |
| 16446: | N:1 |
| 16447: | N:1 |
| 16448: | N:1 |
| 16449: | N:1 |
| 16450: | N:1 |
| 16451: | N:1 |
| 16452: | N:1 |
| 16453: | N:1 |
| 16454: | N:1 |
| 16455: | N:1 |
| 16456: | N:1 |
| 16457: | N:1 |
| 16458: | N:1 |
| 16459: | N:1 |
| 16460: | N:1 |
| 16461: | N:1 |
| 16462: | N:1 |
| 16463: | N:1 |
| 16464: | N:1 |
| 16465: | N:1 |
| 16466: | N:1 |
| 16467: | N:1 |
| 16468: | N:1 |
| 16469: | N:1 |
| 16470: | N:1 |
| 16471: | N:1 |
| 16472: | N:1 |
| 16473: | N:1 |
| 16474: | N:1 |
| 16475: | N:1 |
| 16476: | N:1 |
| 16477: | N:1 |
| 16478: | N:1 |
| 16479: | N:1 |
| 16480: | N:1 |
| 16481: | N:1 |
| 16482: | N:1 |
| 16483: | N:1 |
| 16484: | N:1 |
| 16485: | N:1 |
| 16486: | N:1 |
| 16487: | N:1 |
| 16488: | N:1 |
| 16489: | N:1 |
| 16490: | N:1 |
| 16491: | N:1 |
| 16492: | N:1 |
| 16493: | N:1 |
| 16494: | N:1 |
| 16495: | N:1 |
| 16496: | N:1 |
| 16497: | N:1 |
| 16498: | N:1 |
| 16499: | N:1 |
| 16500: | N:1 |
| 16501: | N:1 |
| 16502: | N:1 |
| 16503: | N:1 |
| 16504: | N:1 |
| 16505: | N:1 |
| 16506: | N:1 |
| 16507: | N:1 |
| 16508: | N:1 |
| 16509: | N:1 |
| 16510: | N:1 |
| 16511: | N:1 |
| 16512: | N:1 |
| 16513: | N:1 |
| 16514: | N:1 |
| 16515: | N:1 |
| 16516: | N:1 |
| 16517: | N:1 |
| 16518: | N:1 |
| 16519: | N:1 |
| 16520: | N:1 |
| 16521: | N:1 |
| 16522: | N:1 |
| 16523: | N:1 |
| 16524: | N:1 |
| 16525: | N:1 |
| 16526: | N:1 |
| 16527: | N:1 |
| 16528: | N:1 |
| 16529: | N:1 |
| 16530: | N:1 |
| 16531: | N:1 |
| 16532: | N:1 |
| 16533: | N:1 |
| 16534: | N:1 |
| 16535: | E:1 |
| 16536: | E:1 |
| 16537: | E:1 |
| 16538: | E:1 |
| 16539: | E:1 |
| 16540: | E:1 |
| 16541: | E:1 |
| 16542: | E:1 |
| 16543: | E:1 |
| 16544: | E:1 |
| 16545: | E:1 |
| 16546: | E:1 |
| 16547: | E:1 |
| 16548: | E:1 |
| 16549: | E:1 |
| 16550: | E:1 |
| 16551: | E:1 |
| 16552: | E:1 |
| 16553: | E:1 |
| 16554: | E:1 |
| 16555: | E:1 |
| 16556: | E:1 |
| 16557: | E:1 |
| 16558: | E:1 |
| 16559: | E:1 |
| 16560: | E:1 |
| 16561: | E:1 |
| 16562: | E:1 |
| 16563: | E:1 |
| 16564: | E:1 |
| 16565: | E:1 |
| 16566: | E:1 |
| 16567: | E:1 |
| 16568: | E:1 |
| 16569: | E:1 |
| 16570: | E:1 |
| 16571: | E:1 |
| 16572: | E:1 |
| 16573: | E:1 |
| 16574: | E:1 |
| 16575: | E:1 |
| 16576: | E:1 |
| 16577: | E:1 |
| 16578: | E:1 |
| 16579: | E:1 |
| 16580: | E:1 |
| 16581: | E:1 |
| 16582: | E:1 |
| 16583: | E:1 |
| 16584: | E:1 |
| 16585: | E:1 |
| 16586: | E:1 |
| 16587: | E:1 |
| 16588: | E:1 |
| 16589: | E:1 |
| 16590: | E:1 |
| 16591: | E:1 |
| 16592: | E:1 |
| 16593: | E:1 |
| 16594: | E:1 |
| 16595: | E:1 |
| 16596: | E:1 |
| 16597: | E:1 |

TABLE II-continued

| SEQ ID NO. | Spatial Distribution |
|---|---|
| 16598: | E:1 |
| 16599: | E:1 |
| 16600: | E:1 |
| 16601: | E:1 |
| 16602: | E:1 |
| 16603: | E:1 |
| 16604: | E:1 |
| 16605: | E:1 |
| 16606: | E:1 |
| 16607: | E:1 |
| 16608: | E:1 |
| 16609: | E:1 |
| 16610: | E:1 |
| 16611: | E:1 |
| 16612: | E:1 |
| 16613: | E:1 |
| 16614: | E:1 |
| 16615: | E:1 |
| 16616: | E:1 |
| 16617: | E:1 |
| 16618: | E:1 |
| 16619: | E:1 |
| 16620: | E:1 |
| 16621: | E:1 |
| 16622: | E:1 |
| 16623: | E:1 |
| 16624: | E:1 |
| 16625: | E:1 |
| 16626: | E:1 |
| 16627: | E:1 |
| 16628: | E:1 |
| 16629: | E:1 |
| 16630: | E:1 |
| 16631: | E:1 |
| 16632: | E:1 |
| 16633: | E:1 |
| 16634: | E:1 |
| 16635: | E:1 |
| 16636: | E:1 |
| 16637: | E:1 |
| 16638: | E:1 |
| 16639: | E:1 |
| 16640: | E:1 |
| 16641: | E:1 |
| 16642: | E:1 |
| 16643: | E:1 |
| 16644: | E:1 |
| 16645: | E:1 |
| 16646: | E:1 |
| 16647: | E:1 |
| 16648: | E:1 |
| 16649: | E:1 |
| 16650: | E:1 |
| 16651: | E:1 |
| 16652: | E:1 |
| 16653: | E:1 |
| 16654: | E:1 |
| 16655: | E:1 |
| 16656: | E:1 |
| 16657: | E:1 |
| 16658: | E:1 |
| 16659: | E:1 |
| 16660: | E:1 |
| 16661 | E:1 |
| 16662 | E:1 |
| 16663: | E:1 |
| 16664: | E:1 |
| 16665: | E:1 |
| 16666: | E:1 |
| 16667: | E:1 |
| 16668: | E:1 |
| 16669: | E:1 |
| 16670: | E:1 |
| 16671: | E:1 |
| 16672: | E:1 |
| 16673: | E:1 |
| 16674: | E:1 |
| 16675: | E:1 |
| 16676: | E:1 |
| 16677: | E:1 |
| 16678: | E:1 |
| 16679: | E:1 |
| 16680: | E:1 |
| 16681: | E:1 |
| 16682: | E:1 |
| 16683: | E:1 |
| 16684: | E:1 |
| 16685: | E:1 |
| 16686: | E:1 |
| 16687: | E:1 |
| 16688: | E:1 |
| 16689: | E:1 |
| 16690: | E:1 |
| 16691: | E:1 |
| 16692: | E:1 |
| 16693: | E:1 |
| 16694: | E:1 |
| 16695: | E:1 |
| 16696: | E:1 |
| 16697: | E:1 |
| 16698: | E:1 |
| 16699: | E:1 |
| 16700: | E:1 |
| 16701: | E:1 |
| 16702: | E:1 |
| 16703: | E:1 |
| 16704: | E:1 |
| 16705: | E:1 |
| 16706: | E:1 |
| 16707: | E:1 |
| 16708: | E:1 |
| 16709: | E:1 |
| 16710: | E:1 |
| 16711: | E:1 |
| 16712: | E:1 |
| 16713: | E:1 |
| 16714: | E:1 |
| 16715: | E:1 |
| 16716: | E:1 |
| 16717: | E:1 |
| 16718: | E:1 |
| 16719: | E:1 |
| 16720: | E:1 |
| 16721: | E:1 |
| 16722: | E:1 |
| 16723: | E:1 |
| 16724: | E:1 |
| 16725: | E:1 |
| 16726: | E:1 |
| 16727: | E:1 |
| 16728: | E:1 |
| 16729: | E:1 |
| 16730: | E:1 |
| 16731: | E:1 |
| 16732: | E:1 |
| 16733: | E:1 |
| 16734: | E:1 |
| 16735: | E:1 |
| 16736: | E:1 |
| 16737: | E:1 |
| 16738: | E:1 |
| 16739: | E:1 |
| 16740: | E:1 |
| 16741: | E:1 |
| 16742: | E:1 |
| 16743: | E:1 |
| 16744: | E:1 |
| 16745: | E:1 |
| 16746: | Q:1 |
| 16747: | Q:1 |
| 16748: | Q:1 |
| 16749: | Q:1 |
| 16750: | Q:1 |
| 16751: | Q:1 |

TABLE II-continued

| SEQ ID NO. | Spatial Distribution |
|---|---|
| 16752: | Q:1 |
| 16753: | Q:1 |
| 16754: | Q:1 |
| 16755: | Q:1 |
| 16756: | Q:1 |
| 16757: | Q:1 |
| 16758: | Q:1 |
| 16759: | Q:1 |
| 16760: | Q:1 |
| 16761: | Q:1 |
| 16762: | Q:1 |
| 16763: | Q:1 |
| 16764: | Q:1 |
| 16765: | Q:1 |
| 16766: | Q:1 |
| 16767: | Q:1 |
| 16768: | Q:1 |
| 16769: | Q:1 |
| 16770: | Q:1 |
| 16771: | Q:1 |
| 16772: | Q:1 |
| 16773: | Q:1 |
| 16774: | Q:1 |
| 16775: | Q:1 |
| 16776: | Q:1 |
| 16777: | Q:1 |
| 16778: | Q:1 |
| 16779: | Q:1 |
| 16780: | Q:1 |
| 16781: | Q:1 |
| 16782: | Q:1 |
| 16783: | Q:1 |
| 16784: | Q:1 |
| 16785: | Q:1 |
| 16786: | Q:1 |
| 16787: | Q:1 |
| 16788: | Q:1 |
| 16789: | Q:1 |
| 16790: | Q:1 |
| 16791: | Q:1 |
| 16792: | Q:1 |
| 16793: | Q:1 |
| 16794: | Q:1 |
| 16795: | Q:1 |
| 16796: | Q:1 |
| 16797: | Q:1 |
| 16798: | Q:1 |
| 16799: | Q:1 |
| 16800: | Q:1 |
| 16801: | Q:1 |
| 16802: | Q:1 |
| 16803: | Q:1 |
| 16804: | Q:1 |
| 16805: | Q:1 |
| 16806: | Q:1 |
| 16807: | Q:1 |
| 16808: | Q:1 |
| 16809: | Q:1 |
| 16810: | Q:1 |
| 16811: | Q:1 |
| 16812: | Q:1 |
| 16813: | Q:1 |
| 16814: | Q:1 |
| 16815: | Q:1 |
| 16816: | Q:1 |
| 16817: | Q:1 |
| 16818: | J:1 |
| 16819: | J:1 |
| 16820: | J:1 |
| 16821: | J:1 |
| 16822: | J:1 |
| 16823: | J:1 |
| 16824: | J:1 |
| 16825: | J:1 |
| 16826: | J:1 |
| 16827: | J:1 |
| 16828: | J:1 |
| 16829: | J:1 |
| 16830: | J:1 |
| 16831: | J:1 |
| 16832: | J:1 |
| 16833: | J:1 |
| 16834: | J:1 |
| 16835: | J:1 |
| 16836: | J:1 |
| 16837: | J:1 |
| 16838: | J:1 |
| 16839: | J:1 |
| 16840: | J:1 |
| 16841: | J:1 |
| 16842: | J:1 |
| 16843: | J:1 |
| 16844: | J:1 |
| 16845: | J:1 |
| 16846: | J:1 |
| 16847: | J:1 |
| 16848: | J:1 |
| 16849: | J:1 |
| 16850: | J:1 |
| 16851: | J:1 |
| 16852: | J:1 |
| 16853: | J:1 |
| 16854: | J:1 |
| 16855: | J:1 |
| 16856: | J:1 |
| 16857: | J:1 |
| 16858: | J:1 |
| 16859: | J:1 |
| 16860: | J:1 |
| 16861: | J:1 |
| 16862: | J:1 |
| 16863: | J:1 |
| 16864: | J:1 |
| 16865: | J:1 |
| 16866: | J:1 |
| 16867: | J:1 |
| 16868: | J:1 |
| 16869: | J:1 |
| 16870: | J:1 |
| 16871: | J:1 |
| 16872: | J:1 |
| 16873: | J:1 |
| 16874: | J:1 |
| 16875: | J:1 |
| 16876: | J:1 |
| 16877: | J:1 |
| 16878: | J:1 |
| 16879: | J:1 |
| 16880: | J:1 |
| 16881: | J:1 |
| 16882: | J:1 |
| 16883: | J:1 |
| 16884: | J:1 |
| 16885: | J:1 |
| 16886: | J:1 |
| 16887: | J:1 |
| 16888: | J:1 |
| 16889: | J:1 |
| 16890: | J:1 |
| 16891: | J:1 |
| 16892: | J:1 |
| 16893: | J:1 |
| 16894: | J:1 |
| 16895: | J:1 |
| 16896: | J:1 |
| 16897: | J:1 |
| 16898: | J:1 |
| 16899: | J:1 |
| 16900: | J:1 |
| 16901: | J:1 |
| 16902: | J:1 |
| 16903: | J:1 |
| 16904: | J:1 |
| 16905: | J:1 |

TABLE II-continued

| SEQ ID NO. | Spatial Distribution |
|---|---|
| 16906: | J:1 |
| 16907: | J:1 |
| 16908: | J:1 |
| 16909: | J:1 |
| 16910: | J:1 |
| 16911: | J:1 |
| 16912: | J:1 |
| 16913: | J:1 |
| 16914: | J:1 |
| 16915: | J:1 |
| 16916: | J:1 |
| 16917: | J:1 |
| 16918: | J:1 |
| 16919: | J:1 |
| 16920: | J:1 |
| 16921: | J:1 |
| 16922: | J:1 |
| 16923: | J:1 |
| 16924: | J:1 |
| 16925: | J:1 |
| 16926: | J:1 |
| 16927: | J:1 |
| 16928: | J:1 |
| 16929: | J:1 |
| 16930: | J:1 |
| 16931: | J:1 |
| 16932: | J:1 |
| 16933: | J:1 |
| 16934: | J:1 |
| 16935: | J:1 |
| 16936: | J:1 |
| 16937: | J:1 |
| 16938: | J:1 |
| 16939: | J:1 |
| 16940: | J:1 |
| 16941: | J:1 |
| 16942: | J:1 |
| 16943: | J:1 |
| 16944: | J:1 |
| 16945: | J:1 |
| 16946: | J:1 |
| 16947: | J:1 |
| 16948: | J:1 |
| 16949: | J:1 |
| 16950: | J:1 |
| 16951: | J:1 |
| 16952: | J:1 |
| 16953: | J:1 |
| 16954: | J:1 |
| 16955: | J:1 |
| 16956: | J:1 |
| 16957: | J:1 |
| 16958: | J:1 |
| 16959: | J:1 |
| 16960: | J:1 |
| 16961: | J:1 |
| 16962: | J:1 |
| 16963: | J:1 |
| 16964: | J:1 |
| 16965: | J:1 |
| 16966: | J:1 |
| 16967: | J:1 |
| 16968: | J:1 |
| 16969: | J:1 |
| 16970: | J:1 |
| 16971: | J:1 |
| 16972: | J:1 |
| 16973: | J:1 |
| 16974: | J:1 |
| 16975: | J:1 |
| 16976: | J:1 |
| 16977: | J:1 |
| 16978: | J:1 |
| 16979: | J:1 |
| 16980: | J:1 |
| 16981: | J:1 |
| 16982: | J:1 |
| 16983: | J:1 |
| 16984: | J:1 |
| 16985: | J:1 |
| 16986: | J:1 |
| 16987: | J:1 |
| 16988: | J:1 |
| 16989: | J:1 |
| 16990: | J:1 |
| 16991: | J:1 |
| 16992: | J:1 |
| 16993: | J:1 |
| 16994: | J:1 |
| 16995: | J:1 |
| 16996: | J:1 |
| 16997: | J:1 |
| 16998: | J:1 |
| 16999: | J:1 |
| 17000: | J:1 |
| 17001: | J:1 |
| 17002: | J:1 |
| 17003: | J:1 |
| 17004: | J:1 |
| 17005: | J:1 |
| 17006: | J:1 |
| 17007: | J:1 |
| 17008: | J:1 |
| 17009: | J:1 |
| 17010: | J:1 |
| 17011: | J:1 |
| 17012: | J:1 |
| 17013: | J:1 |
| 17014: | J:1 |
| 17015: | J:1 |
| 17016: | J:1 |
| 17017: | J:1 |
| 17018: | J:1 |
| 17019: | J:1 |
| 17020: | J:1 |
| 17021: | J:1 |
| 17022: | J:1 |
| 17023: | J:1 |
| 17024: | J:1 |
| 17025: | J:1 |
| 17026: | J:1 |
| 17027: | J:1 |
| 17028: | J:1 |
| 17029: | J:1 |
| 17030: | J:1 |
| 17031: | J:1 |
| 17032: | J:1 |
| 17033: | J:1 |
| 17034: | J:1 |
| 17035: | J:1 |
| 17036: | J:1 |
| 17037: | J:1 |
| 17038: | J:1 |
| 17039: | J:1 |
| 17040: | J:1 |
| 17041: | J:1 |
| 17042: | J:1 |
| 17043: | J:1 |
| 17044: | J:1 |
| 17045: | J:1 |
| 17046: | J:1 |
| 17047: | J:1 |
| 17048: | J:1 |
| 17049: | J:1 |
| 17050: | J:1 |
| 17051: | J:1 |
| 17052: | J:1 |
| 17053: | J:1 |
| 17054: | J:1 |
| 17055: | J:1 |
| 17056: | J:1 |
| 17057: | J:1 |
| 17058: | J:1 |
| 17059: | T:1 |

TABLE II-continued

| SEQ ID NO. | Spatial Distribution |
|---|---|
| 17060: | T:1 |
| 17061: | T:1 |
| 17062: | T:1 |
| 17063: | T:1 |
| 17064: | T:1 |
| 17065: | T:1 |
| 17066: | T:1 |
| 17067: | T:1 |
| 17068: | T:1 |
| 17069: | T:1 |
| 17070: | T:1 |
| 17071: | T:1 |
| 17072: | T:1 |
| 17073: | T:1 |
| 17074: | T:1 |
| 17075: | T:1 |
| 17076: | T:1 |
| 17077: | T:1 |
| 17078: | T:1 |
| 17079: | T:1 |
| 17080: | T:1 |
| 17081: | T:1 |
| 17082: | T:1 |
| 17083: | T:1 |
| 17084: | T:1 |
| 17085: | T:1 |
| 17086: | T:1 |
| 17087: | T:1 |
| 17088: | T:1 |
| 17089: | T:1 |
| 17090: | T:1 |
| 17091: | T:1 |
| 17092: | T:1 |
| 17093: | T:1 |
| 17094: | T:1 |
| 17095: | T:1 |
| 17096: | T:1 |
| 17097: | T:1 |
| 17098: | T:1 |
| 17099: | T:1 |
| 17100: | T:1 |
| 17101: | T:1 |
| 17102: | T:1 |
| 17103: | T:1 |
| 17104: | T:1 |
| 17105: | T:1 |
| 17106: | T:1 |
| 17107: | T:1 |
| 17108: | T:1 |
| 17109: | T:1 |
| 17110: | T:1 |
| 17111: | T:1 |
| 17112: | T:1 |
| 17113: | T:1 |
| 17114: | T:1 |
| 17115: | T:1 |
| 17116: | T:1 |
| 17117: | T:1 |
| 17118: | T:1 |
| 17119: | T:1 |
| 17120: | T:1 |
| 17121: | T:1 |
| 17122: | T:1 |
| 17123: | T:1 |
| 17124: | T:1 |
| 17125: | T:1 |
| 17126: | T:1 |
| 17127: | T:1 |
| 17128: | T:1 |
| 17129: | T:1 |
| 17130: | T:1 |
| 17131: | T:1 |
| 17132: | T:1 |
| 17133: | T:1 |
| 17134: | T:1 |
| 17135: | T:1 |
| 17136: | T:1 |
| 17137: | T:1 |
| 17138: | T:1 |
| 17139: | T:1 |
| 17140: | T:1 |
| 17141: | T:1 |
| 17142: | T:1 |
| 17143: | T:1 |
| 17144: | T:1 |
| 17145: | T:1 |
| 17146: | T:1 |
| 17147: | T:1 |
| 17148: | T:1 |
| 17149: | T:1 |
| 17150: | T:1 |
| 17151: | T:1 |
| 17152: | T:1 |
| 17153: | T:1 |
| 17154: | T:1 |
| 17155: | T:1 |
| 17156: | T:1 |
| 17157: | T:1 |
| 17158: | T:1 |
| 17159: | T:1 |
| 17160: | T:1 |
| 17161: | T:1 |
| 17162: | T:1 |
| 17163: | T:1 |
| 17164: | T:1 |
| 17165: | T:1 |
| 17166: | T:1 |
| 17167: | T:1 |
| 17168: | T:1 |
| 17169: | T:1 |
| 17170: | T:1 |
| 17171: | T:1 |
| 17172: | T:1 |
| 17173: | T:1 |
| 17174: | T:1 |
| 17175: | T:1 |
| 17176: | T:1 |
| 17177: | T:1 |
| 17178: | T:1 |
| 17179: | T:1 |
| 17180: | T:1 |
| 17181: | T:1 |
| 17182: | T:1 |
| 17183: | T:1 |
| 17184: | T:1 |
| 17185: | T:1 |
| 17186: | T:1 |
| 17187: | T:1 |
| 17188: | T:1 |
| 17189: | T:1 |
| 17190: | T:1 |
| 17191: | T:1 |
| 17192: | T:1 |
| 17193: | T:1 |
| 17194: | T:1 |
| 17195: | T:1 |
| 17196: | T:1 |
| 17197: | T:1 |
| 17198: | T:1 |
| 17199: | T:1 |
| 17200: | T:1 |
| 17201: | T:1 |
| 17202: | T:1 |
| 17203: | T:1 |
| 17204: | T:1 |
| 17205: | T:1 |
| 17206: | T:1 |
| 17207: | T:1 |
| 17208: | T:1 |
| 17209: | T:1 |
| 17210: | T:1 |
| 17211: | T:1 |
| 17212: | T:1 |
| 17213: | T:1 |

TABLE II-continued

| SEQ ID NO. | Spatial Distribution |
|---|---|
| 17214: | T:1 |
| 17215: | T:1 |
| 17216: | T:1 |
| 17217: | T:1 |
| 17218: | T:1 |
| 17219: | T:1 |
| 17220: | T:1 |
| 17221: | T:1 |
| 17222: | T:1 |
| 17223: | T:1 |
| 17224: | T:1 |
| 17225: | T:1 |
| 17226: | T:1 |
| 17227: | T:1 |
| 17228: | T:1 |
| 17229: | T:1 |
| 17230: | T:1 |
| 17231: | T:1 |
| 17232: | T:1 |
| 17233: | T:1 |
| 17234: | T:1 |
| 17235: | T:1 |
| 17236: | T:1 |
| 17237: | T:1 |
| 17238: | T:1 |
| 17239: | T:1 |
| 17240: | T:1 |
| 17241: | T:1 |
| 17242: | T:1 |
| 17243: | T:1 |
| 17244: | T:1 |
| 17245: | T:1 |
| 17246: | T:1 |
| 17247: | T:1 |
| 17248: | T:1 |
| 17249: | T:1 |
| 17250: | T:1 |
| 17251: | T:1 |
| 17252: | T:1 |
| 17253: | T:1 |
| 17254: | T:1 |
| 17255: | T:1 |
| 17256: | T:1 |
| 17257: | T:1 |
| 17258: | T:1 |
| 17259: | T:1 |
| 17260: | T:1 |
| 17261: | T:1 |
| 17262: | T:1 |
| 17263: | T:1 |
| 17264: | T:1 |
| 17265: | T:1 |
| 17266: | T:1 |
| 17267: | T:1 |
| 17268: | T:1 |
| 17269: | T:1 |
| 17270: | T:1 |
| 17271: | T:1 |
| 17272: | T:1 |
| 17273: | T:1 |
| 17274: | T:1 |
| 17275: | T:1 |
| 17276: | T:1 |
| 17277: | T:1 |
| 17278: | T:1 |
| 17279: | T:1 |
| 17280: | T:1 |
| 17281: | T:1 |
| 17282: | T:1 |
| 17283: | T:1 |
| 17284: | T:1 |
| 17285: | T:1 |
| 17286: | T:1 |
| 17287: | T:1 |
| 17288: | T:1 |
| 17289: | T:1 |
| 17290: | T:1 |
| 17291: | T:1 |
| 17292: | T:1 |
| 17293: | T:1 |
| 17294: | T:1 |
| 17295: | T:1 |
| 17296: | T:1 |
| 17297: | T:1 |
| 17298: | T:1 |
| 17299: | T:1 |
| 17300: | T:1 |
| 17301: | T:1 |
| 17302: | T:1 |
| 17303: | T:1 |
| 17304: | T:1 |
| 17305: | T:1 |
| 17306: | T:1 |
| 17307: | T:1 |
| 17308: | T:1 |
| 17309: | T:1 |
| 17310: | T:1 |
| 17311: | T:1 |
| 17312: | T:1 |
| 17313: | T:1 |
| 17314: | T:1 |
| 17315: | T:1 |
| 17316: | T:1 |
| 17317: | T:1 |
| 17318: | T:1 |
| 17319: | T:1 |
| 17320: | T:1 |
| 17321: | T:1 |
| 17322: | T:1 |
| 17323: | T:1 |
| 17324: | T:1 |
| 17325: | T:1 |
| 17326: | T:1 |
| 17327: | T:1 |
| 17328: | T:1 |
| 17329: | T:1 |
| 17330: | T:1 |
| 17331: | T:1 |
| 17332: | T:1 |
| 17333: | T:1 |
| 17334: | T:1 |
| 17335: | T:1 |
| 17336: | T:1 |
| 17337: | T:1 |
| 17338: | T:1 |
| 17339: | T:1 |
| 17340: | T:1 |
| 17341: | T:1 |
| 17342: | T:1 |
| 17343: | T:1 |
| 17344: | T:1 |
| 17345: | T:1 |
| 17346: | T:1 |
| 17347: | T:1 |
| 17348: | T:1 |
| 17349: | T:1 |
| 17350: | T:1 |
| 17351: | T:1 |
| 17352: | T:1 |
| 17353: | T:1 |
| 17354: | T:1 |
| 17355: | T:1 |
| 17356: | T:1 |
| 17357: | T:1 |
| 17358: | T:1 |
| 17359: | T:1 |
| 17360: | T:1 |
| 17361: | T:1 |
| 17362: | T:1 |
| 17363: | T:1 |
| 17364: | T:1 |
| 17365: | T:1 |
| 17366: | T:1 |
| 17367: | T:1 |

TABLE II-continued

| SEQ ID NO. | Spatial Distribution |
|---|---|
| 17368: | T:1 |
| 17369: | T:1 |
| 17370: | T:1 |
| 17371: | T:1 |
| 17372: | T:1 |
| 17373: | T:1 |
| 17374: | T:1 |
| 17375: | T:1 |
| 17376: | T:1 |
| 17377: | T:1 |
| 17378: | T:1 |
| 17379: | T:1 |
| 17380: | T:1 |
| 17381: | T:1 |
| 17382: | T:1 |
| 17383: | T:1 |
| 17384: | T:1 |
| 17385: | T:1 |
| 17386: | T:1 |
| 17387: | T:1 |
| 17388: | T:1 |
| 17389: | T:1 |
| 17390: | T:1 |
| 17391: | T:1 |
| 17392: | T:1 |
| 17393: | T:1 |
| 17394: | T:1 |
| 17395: | T:1 |
| 17396: | T:1 |
| 17397: | T:1 |
| 17398: | T:1 |
| 17399: | T:1 |
| 17400: | T:1 |
| 17401: | T:1 |
| 17402: | T:1 |
| 17403: | T:1 |
| 17404: | T:1 |
| 17405: | T:1 |
| 17406: | T:1 |
| 17407: | T:1 |
| 17408: | T:1 |
| 17409: | T:1 |
| 17410: | T:1 |
| 17411: | T:1 |
| 17412: | T:1 |
| 17413: | T:1 |
| 17414: | T:1 |
| 17415: | T:1 |
| 17416: | T:1 |
| 17417: | T:1 |
| 17418: | T:1 |
| 17419: | T:1 |
| 17420: | T:1 |
| 17421: | T:1 |
| 17422: | T:1 |
| 17423: | T:1 |
| 17424: | T:1 |
| 17425: | T:1 |
| 17426: | T:1 |
| 17427: | T:1 |
| 17428: | T:1 |
| 17429: | T:1 |
| 17430: | T:1 |
| 17431: | T:1 |
| 17432: | T:1 |
| 17433: | T:1 |
| 17434: | T:1 |
| 17435: | T:1 |
| 17436: | T:1 |
| 17437: | T:1 |
| 17438: | T:1 |
| 17439: | T:1 |
| 17440: | T:1 |
| 17441: | T:1 |
| 17442: | T:1 |
| 17443: | T:1 |
| 17444: | T:1 |
| 17445: | T:1 |
| 17446: | T:1 |
| 17447: | T:1 |
| 17448: | T:1 |
| 17449: | T:1 |
| 17450: | T:1 |
| 17451: | T:1 |
| 17452: | T:1 |
| 17453: | T:1 |
| 17454: | T:1 |
| 17455: | T:1 |
| 17456: | T:1 |
| 17457: | T:1 |
| 17458: | T:1 |
| 17459: | T:1 |
| 17460: | T:1 |
| 17461: | T:1 |
| 17462: | T:1 |
| 17463: | T:1 |
| 17464: | T:1 |
| 17465: | T:1 |
| 17466: | T:1 |
| 17467: | T:1 |
| 17468: | T:1 |
| 17469: | T:1 |
| 17470: | T:1 |
| 17471: | T:1 |
| 17472: | T:1 |
| 17473: | T:1 |
| 17474: | T:1 |
| 17475: | T:1 |
| 17476: | T:1 |
| 17477: | T:1 |
| 17478: | T:1 |
| 17479: | T:1 |
| 17480: | T:1 |
| 17481: | T:1 |
| 17482: | T:1 |
| 17483: | T:1 |
| 17484: | T:1 |
| 17485: | T:1 |
| 17486: | T:1 |
| 17487: | T:1 |
| 17488: | T:1 |
| 17489: | T:1 |
| 17490: | T:1 |
| 17491: | T:1 |
| 17492: | T:1 |
| 17493: | T:1 |
| 17494: | T:1 |
| 17495: | T:1 |
| 17496: | T:1 |
| 17497: | T:1 |
| 17498: | T:1 |
| 17499: | T:1 |
| 17500: | T:1 |
| 17501: | T:1 |
| 17502: | T:1 |
| 17503: | T:1 |
| 17504: | T:1 |
| 17505: | T:1 |
| 17506: | T:1 |
| 17507: | T:1 |
| 17508: | T:1 |
| 17509: | T:1 |
| 17510: | T:1 |
| 17511: | T:1 |
| 17512: | T:1 |
| 17513: | T:1 |
| 17514: | T:1 |
| 17515: | T:1 |
| 17516: | T:1 |
| 17517: | T:1 |
| 17518: | T:1 |
| 17519: | T:1 |
| 17520: | T:1 |
| 17521: | T:1 |

TABLE II-continued

| SEQ ID NO. | Spatial Distribution |
|---|---|
| 17522: | T:1 |
| 17523: | T:1 |
| 17524: | T:1 |
| 17525: | T:1 |
| 17526: | T:1 |
| 17527: | T:1 |
| 17528: | T:1 |
| 17529: | T:1 |
| 17530: | T:1 |
| 17531: | T:1 |
| 17532: | T:1 |
| 17533: | T:1 |
| 17534: | T:1 |
| 17535: | T:1 |
| 17536: | T:1 |
| 17537: | T:1 |
| 17538: | T:1 |
| 17539: | T:1 |
| 17540: | T:1 |
| 17541: | T:1 |
| 17542: | T:1 |
| 17543: | T:1 |
| 17544: | T:1 |
| 17545: | T:1 |
| 17546: | T:1 |
| 17547: | T:1 |
| 17548: | T:1 |
| 17549: | T:1 |
| 17550: | T:1 |
| 17551: | T:1 |
| 17552: | T:1 |
| 17553: | T:1 |
| 17554: | T:1 |
| 17555: | T:1 |
| 17556: | T:1 |
| 17557: | T:1 |
| 17558: | T:1 |
| 17559: | T:1 |
| 17560: | T:1 |
| 17561: | T:1 |
| 17562: | T:1 |
| 17563: | T:1 |
| 17564: | T:1 |
| 17565: | T:1 |
| 17566: | T:1 |
| 17567: | T:1 |
| 17568: | T:1 |
| 17569: | T:1 |
| 17570: | T:1 |
| 17571: | T:1 |
| 17572: | T:1 |
| 17573: | T:1 |
| 17574: | T:1 |
| 17575: | T:1 |
| 17576: | T:1 |
| 17577: | T:1 |
| 17578: | T:1 |
| 17579: | T:1 |
| 17580: | T:1 |
| 17581: | T:1 |
| 17582: | T:1 |
| 17583: | T:1 |
| 17584: | T:1 |
| 17585: | T:1 |
| 17586: | T:1 |
| 17587: | T:1 |
| 17588: | T:1 |
| 17589: | T:1 |
| 17590: | T:1 |
| 17591: | T:1 |
| 17592: | T:1 |
| 17593: | T:1 |
| 17594: | T:1 |
| 17595: | T:1 |
| 17596: | T:1 |
| 17597: | T:1 |
| 17598: | T:1 |
| 17599: | T:1 |
| 17600: | T:1 |
| 17601: | T:1 |
| 17602: | T:1 |
| 17603: | T:1 |
| 17604: | T:1 |
| 17605: | T:1 |
| 17606: | T:1 |
| 17607: | T:1 |
| 17608: | T:1 |
| 17609: | T:1 |
| 17610: | T:1 |
| 17611: | T:1 |
| 17612: | T:1 |
| 17613: | T:1 |
| 17614: | T:1 |
| 17615: | T:1 |
| 17616: | T:1 |
| 17617: | T:1 |
| 17618: | T:1 |
| 17619: | T:1 |
| 17620: | T:1 |
| 17621: | T:1 |
| 17622: | T:1 |
| 17623: | T:1 |
| 17624: | T:1 |
| 17625: | T:1 |
| 17626: | T:1 |
| 17627: | T:1 |
| 17628: | T:1 |
| 17629: | T:1 |
| 17630: | T:1 |
| 17631: | T:1 |
| 17632: | T:1 |
| 17633: | T:1 |
| 17634: | T:1 |
| 17635: | T:1 |
| 17636: | T:1 |
| 17637: | T:1 |
| 17638: | T:1 |
| 17639: | T:1 |
| 17640: | T:1 |
| 17641: | T:1 |
| 17642: | T:1 |
| 17643: | T:1 |
| 17644: | T:1 |
| 17645: | T:1 |
| 17646: | T:1 |
| 17647: | T:1 |
| 17648: | T:1 |
| 17649: | T:1 |
| 17650: | T:1 |
| 17651: | T:1 |
| 17652: | T:1 |
| 17653: | T:1 |
| 17654: | T:1 |
| 17655: | T:1 |
| 17656: | T:1 |
| 17657: | T:1 |
| 17658: | T:1 |
| 17659: | T:1 |
| 17660: | T:1 |
| 17661: | T:1 |
| 17662: | T:1 |
| 17663: | T:1 |
| 17664: | T:1 |
| 17665: | T:1 |
| 17666: | T:1 |
| 17667: | T:1 |
| 17668: | T:1 |
| 17669: | T:1 |
| 17670: | T:1 |
| 17671: | T:1 |
| 17672: | T:1 |
| 17673: | T:1 |
| 17674: | T:1 |
| 17675: | T:1 |

TABLE II-continued

| SEQ ID NO. | Spatial Distribution |
|---|---|
| 17676: | T:1 |
| 17677: | T:1 |
| 17678: | T:1 |
| 17679: | T:1 |
| 17680: | T:1 |
| 17681: | T:1 |
| 17682: | T:1 |
| 17683: | T:1 |
| 17684: | T:1 |
| 17685: | T:1 |
| 17686: | T:1 |
| 17687: | T:1 |
| 17688: | T:1 |
| 17689: | T:1 |
| 17690: | T:1 |
| 17691: | T:1 |
| 17692: | T:1 |
| 17693: | T:1 |
| 17694: | T:1 |
| 17695: | T:1 |
| 17696: | T:1 |
| 17697: | T:1 |
| 17698: | T:1 |
| 17699: | T:1 |
| 17700: | T:1 |
| 17701: | T:1 |
| 17702: | T:1 |
| 17703: | T:1 |
| 17704: | T:1 |
| 17705: | T:1 |
| 17706: | T:1 |
| 17707: | T:1 |
| 17708: | T:1 |
| 17709: | T:1 |
| 17710: | T:1 |
| 17711: | T:1 |
| 17712: | T:1 |
| 17713: | T:1 |
| 17714: | T:1 |
| 17715: | T:1 |
| 17716: | T:1 |
| 17717: | T:1 |
| 17718: | T:1 |
| 17719: | T:1 |
| 17720: | T:1 |
| 17721: | T:1 |
| 17722: | T:1 |
| 17723: | T:1 |
| 17724: | T:1 |
| 17725: | T:1 |
| 17726: | T:1 |
| 17727: | T:1 |
| 17728: | T:1 |
| 17729: | T:1 |
| 17730: | T:1 |
| 17731: | T:1 |
| 17732: | T:1 |
| 17733: | T:1 |
| 17734: | T:1 |
| 17735: | T:1 |
| 17736: | T:1 |
| 17737: | T:1 |
| 17738: | T:1 |
| 17739: | T:1 |
| 17740: | T:1 |
| 17741: | T:1 |
| 17742: | T:1 |
| 17743: | T:1 |
| 17744: | T:1 |
| 17745: | T:1 |
| 17746: | T:1 |
| 17747: | T:1 |
| 17748: | T:1 |
| 17749: | T:1 |
| 17750: | T:1 |
| 17751: | T:1 |
| 17752: | T:1 |
| 17753: | T:1 |
| 17754: | T:1 |
| 17755: | T:1 |
| 17756: | T:1 |
| 17757: | T:1 |
| 17758: | T:1 |
| 17759: | T:1 |
| 17760: | T:1 |
| 17761: | T:1 |
| 17762: | T:1 |
| 17763: | T:1 |
| 17764: | T:1 |
| 17765: | T:1 |
| 17766: | T:1 |
| 17767: | T:1 |
| 17768: | T:1 |
| 17769: | T:1 |
| 17770: | T:1 |
| 17771: | T:1 |
| 17772: | T:1 |
| 17773: | T:1 |
| 17774: | T:1 |
| 17775: | T:1 |
| 17776: | T:1 |
| 17777: | T:1 |
| 17778: | T:1 |
| 17779: | T:1 |
| 17780: | T:1 |
| 17781: | T:1 |
| 17782: | T:1 |
| 17783: | T:1 |
| 17784: | T:1 |
| 17785: | T:1 |
| 17786: | T:1 |
| 17787: | T:1 |
| 17788: | T:1 |
| 17789: | T:1 |
| 17790: | T:1 |
| 17791: | T:1 |
| 17792: | T:1 |
| 17793: | T:1 |
| 17794: | T:1 |
| 17795: | T:1 |
| 17796: | T:1 |
| 17797: | T:1 |
| 17798: | T:1 |
| 17799: | T:1 |
| 17800: | T:1 |
| 17801: | T:1 |
| 17802: | T:1 |
| 17803: | T:1 |
| 17804: | T:1 |
| 17805: | T:1 |
| 17806: | T:1 |
| 17807: | T:1 |
| 17808: | T:1 |
| 17809: | T:1 |
| 17810: | T:1 |
| 17811: | T:1 |
| 17812: | T:1 |
| 17813: | T:1 |
| 17814: | T:1 |
| 17815: | T:1 |
| 17816: | T:1 |
| 17817: | T:1 |
| 17818: | T:1 |
| 17819: | T:1 |
| 17820: | T:1 |
| 17821: | T:1 |
| 17822: | T:1 |
| 17823: | T:1 |
| 17824: | T:1 |
| 17825: | T:1 |
| 17826: | T:1 |
| 17827: | T:1 |
| 17828: | T:1 |
| 17829: | T:1 |

TABLE II-continued

| SEQ ID NO. | Spatial Distribution |
|---|---|
| 17830: | T:1 |
| 17831: | T:1 |
| 17832: | T:1 |
| 17833: | T:1 |
| 17834: | T:1 |
| 17835: | T:1 |
| 17836: | T:1 |
| 17837: | T:1 |
| 17838: | T:1 |
| 17839: | T:1 |
| 17840: | T:1 |
| 17841: | T:1 |
| 17842: | T:1 |
| 17843: | T:1 |
| 17844: | T:1 |
| 17845: | T:1 |
| 17846: | T:1 |
| 17847: | T:1 |
| 17848: | T:1 |
| 17849: | T:1 |
| 17850: | T:1 |
| 17851: | T:1 |
| 17852: | T:1 |
| 17853: | T:1 |
| 17854: | T:1 |
| 17855: | T:1 |
| 17856: | T:1 |
| 17857: | T:1 |
| 17858: | T:1 |
| 17859: | T:1 |
| 17860: | T:1 |
| 17861: | T:1 |
| 17862: | T:1 |
| 17863: | T:1 |
| 17864: | T:1 |
| 17865: | T:1 |
| 17866: | T:1 |
| 17867: | T:1 |
| 17868: | T:1 |
| 17869: | T:1 |
| 17870: | T:1 |
| 17871: | T:1 |
| 17872: | T:1 |
| 17873: | T:1 |
| 17874: | T:1 |
| 17875: | T:1 |
| 17876: | T:1 |
| 17877: | T:1 |
| 17878: | T:1 |
| 17879: | T:1 |
| 17880: | T:1 |
| 17881: | T:1 |
| 17882: | T:1 |
| 17883: | T:1 |
| 17884: | T:1 |
| 17885: | T:1 |
| 17886: | T:1 |
| 17887: | T:1 |
| 17888: | T:1 |
| 17889: | T:1 |
| 17890: | T:1 |
| 17891: | T:1 |
| 17892: | T:1 |
| 17893: | T:1 |
| 17894: | T:1 |
| 17895: | T:1 |
| 17896: | T:1 |
| 17897: | T:1 |
| 17898: | T:1 |
| 17899: | T:1 |
| 17900: | T:1 |
| 17901: | T:1 |
| 17902: | T:1 |
| 17903: | T:1 |
| 17904: | T:1 |
| 17905: | T:1 |
| 17906: | T:1 |
| 17907: | T:1 |
| 17908: | T:1 |
| 17909: | T:1 |
| 17910: | T:1 |
| 17911: | T:1 |
| 17912: | T:1 |
| 17913: | T:1 |
| 17914: | T:1 |
| 17915: | T:1 |
| 17916: | T:1 |
| 17917: | T:1 |
| 17918: | T:1 |
| 17919: | T:1 |
| 17920: | T:1 |
| 17921: | T:1 |
| 17922: | T:1 |
| 17923: | T:1 |
| 17924: | T:1 |
| 17925: | T:1 |
| 17926: | T:1 |
| 17927: | T:1 |
| 17928: | T:1 |
| 17929: | T:1 |
| 17930: | T:1 |
| 17931: | T:1 |
| 17932: | T:1 |
| 17933: | T:1 |
| 17934: | T:1 |
| 17935: | T:1 |
| 17936: | T:1 |
| 17937: | T:1 |
| 17938: | T:1 |
| 17939: | T:1 |
| 17940: | T:1 |
| 17941: | T:1 |
| 17942: | T:1 |
| 17943: | T:1 |
| 17944: | T:1 |
| 17945: | T:1 |
| 17946: | T:1 |
| 17947: | T:1 |
| 17948: | T:1 |
| 17949: | T:1 |
| 17950: | T:1 |
| 17951: | T:1 |
| 17952: | T:1 |
| 17953: | T:1 |
| 17954: | T:1 |
| 17955: | T:1 |
| 17956: | T:1 |
| 17957: | T:1 |
| 17958: | T:1 |
| 17959: | T:1 |
| 17960: | T:1 |
| 17961: | T:1 |
| 17962: | T:1 |
| 17963: | T:1 |
| 17964: | T:1 |
| 17965: | T:1 |
| 17966: | T:1 |
| 17967: | T:1 |
| 17968: | T:1 |
| 17969: | T:1 |
| 17970: | T:1 |
| 17971: | T:1 |
| 17972: | T:1 |
| 17973: | T:1 |
| 17974: | T:1 |
| 17975: | T:1 |
| 17976: | T:1 |
| 17977: | T:1 |
| 17978: | T:1 |
| 17979: | T:1 |
| 17980: | T:1 |
| 17981: | T:1 |
| 17982: | T:1 |
| 17983: | T:1 |

TABLE II-continued

| SEQ ID NO. | Spatial Distribution |
|---|---|
| 17984: | T:1 |
| 17985: | T:1 |
| 17986: | T:1 |
| 17987: | T:1 |
| 17988: | T:1 |
| 17989: | T:1 |
| 17990: | T:1 |
| 17991: | T:1 |
| 17992: | T:1 |
| 17993: | T:1 |
| 17994: | T:1 |
| 17995: | T:1 |
| 17996: | T:1 |
| 17997: | T:1 |
| 17998: | T:1 |
| 17999: | T:1 |
| 18000: | T:1 |
| 18001: | T:1 |
| 18002: | T:1 |
| 18003: | T:1 |
| 18004: | T:1 |
| 18005: | T:1 |
| 18006: | T:1 |
| 18007: | T:1 |
| 18008: | T:1 |
| 18009: | T:1 |
| 18010: | T:1 |
| 18011: | T:1 |
| 18012: | T:1 |
| 18013: | T:1 |
| 18014: | T:1 |
| 18015: | T:1 |
| 18016: | T:1 |
| 18017: | T:1 |
| 18018: | T:1 |
| 18019: | T:1 |
| 18020: | T:1 |
| 18021: | T:1 |
| 18022: | T:1 |
| 18023: | T:1 |
| 18024: | T:1 |
| 18025: | T:1 |
| 18026: | T:1 |
| 18027: | T:1 |
| 18028: | T:1 |
| 18029: | T:1 |
| 18030: | T:1 |
| 18031: | T:1 |
| 18032: | T:1 |
| 18033: | T:1 |
| 18034: | T:1 |
| 18035: | T:1 |
| 18036: | T:1 |
| 18037: | T:1 |
| 18038: | T:1 |
| 18039: | T:1 |
| 18040: | T:1 |
| 18041: | T:1 |
| 18042: | T:1 |
| 18043: | T:1 |
| 18044: | T:1 |
| 18045: | T:1 |
| 18046: | T:1 |
| 18047: | T:1 |
| 18048: | T:1 |
| 18049: | T:1 |
| 18050: | T:1 |
| 18051: | T:1 |
| 13052: | T:1 |
| 18053: | T:1 |
| 18054: | T:1 |
| 18055: | T:1 |
| 18056: | T:1 |
| 18057: | T:1 |
| 18058: | T:1 |
| 18059: | T:1 |
| 18060: | T:1 |
| 18061: | T:1 |
| 18062: | T:1 |
| 18063: | T:1 |
| 18064: | T:1 |
| 18065: | T:1 |
| 18066: | T:1 |
| 18067: | T:1 |
| 18068: | T:1 |
| 18069: | T:1 |
| 18070: | T:1 |
| 18071: | T:1 |
| 18072: | T:1 |
| 18073: | T:1 |
| 18074: | T:1 |
| 18075: | T:1 |
| 18076: | T:1 |
| 18077: | T:1 |
| 18078: | T:1 |
| 18079: | T:1 |
| 18080: | T:1 |
| 18081: | T:1 |
| 18082: | T:1 |
| 18083: | T:1 |
| 18084: | T:1 |
| 18085: | T:1 |
| 18086: | T:1 |
| 18087: | T:1 |
| 18088: | T:1 |
| 18089: | T:1 |
| 18090: | T:1 |
| 18091: | T:1 |
| 18092: | T:1 |
| 18093: | T:1 |
| 18094: | T:1 |
| 18095: | T:1 |
| 18096: | T:1 |
| 18097: | T:1 |
| 18098: | T:1 |
| 18099: | T:1 |
| 18100: | T:1 |
| 18101: | T:1 |
| 18102: | T:1 |
| 18103: | T:1 |
| 18104: | T:1 |
| 18105: | T:1 |
| 18106: | T:1 |
| 18107: | T:1 |
| 18108: | T:1 |
| 18109: | T:1 |
| 18110: | T:1 |
| 18111: | T:1 |
| 18112: | T:1 |
| 18113: | T:1 |
| 18114: | T:1 |
| 18115: | T:1 |
| 18116: | T:1 |
| 18117: | T:1 |
| 18118: | T:1 |
| 18119: | T:1 |
| 18120: | T:1 |
| 18121: | T:1 |
| 18122: | T:1 |
| 18123: | T:1 |
| 18124: | T:1 |
| 18125: | T:1 |
| 18126: | T:1 |
| 18127: | T:1 |
| 18128: | T:1 |
| 18129: | T:1 |
| 18130: | T:1 |
| 18131: | T:1 |
| 18132: | T:1 |
| 18133: | T:1 |
| 18134: | T:1 |
| 18135: | T:1 |
| 18136: | T:1 |
| 18137: | T:1 |

TABLE II-continued

| SEQ ID NO. | Spatial Distribution |
|---|---|
| 18138: | T:1 |
| 18139: | T:1 |
| 18140: | T:1 |
| 18141: | T:1 |
| 18142: | T:1 |
| 18143: | T:1 |
| 18144: | T:1 |
| 18145: | T:1 |
| 18146: | T:1 |
| 18147: | T:1 |
| 18148: | T:1 |
| 18149: | T:1 |
| 18150: | T:1 |
| 18151: | T:1 |
| 18152: | T:1 |
| 18153: | T:1 |
| 18154: | T:1 |
| 18155: | T:1 |
| 18156: | T:1 |
| 18157: | T:1 |
| 18158: | T:1 |
| 18159: | T:1 |
| 18160: | T:1 |
| 18161: | T:1 |
| 18162: | T:1 |
| 18163: | T:1 |
| 18164: | T:1 |
| 18165: | T:1 |
| 18166: | T:1 |
| 18167: | T:1 |
| 18168: | T:1 |
| 18169: | T:1 |
| 18170: | T:1 |
| 18171: | T:1 |
| 18172: | T:1 |
| 18173: | T:1 |
| 18174: | T:1 |
| 18175: | T:1 |
| 18176: | T:1 |
| 18177: | T:1 |
| 18178: | T:1 |
| 18179: | T:1 |
| 18180: | T:1 |
| 18181: | T:1 |
| 18182: | T:1 |
| 18183: | T:1 |
| 18184: | T:1 |
| 18185: | T:1 |
| 18186: | T:1 |
| 18187: | T:1 |
| 18188: | T:1 |
| 18189: | T:1 |
| 18190: | T:1 |
| 18191: | T:1 |
| 18192: | T:1 |
| 18193: | T:1 |
| 18194: | T:1 |
| 18195: | T:1 |
| 18196: | T:1 |
| 18197: | T:1 |
| 18198: | T:1 |
| 18199: | T:1 |
| 18200: | T:1 |
| 18201: | T:1 |
| 18202: | T:1 |
| 18203: | T:1 |
| 18204: | T:1 |
| 18205: | T:1 |
| 18206: | T:1 |
| 18207: | T:1 |
| 18208: | T:1 |
| 18209: | T:1 |
| 18210: | T:1 |
| 18211: | T:1 |
| 18212: | T:1 |
| 18213: | T:1 |
| 18214: | T:1 |
| 18215: | T:1 |
| 18216: | T:1 |
| 18217: | T:1 |
| 18218: | T:1 |
| 18219: | T:1 |
| 18220: | T:1 |
| 18221: | T:1 |
| 18222: | T:1 |
| 18223: | T:1 |
| 18224: | T:1 |
| 18225: | T:1 |
| 18226: | T:1 |
| 18227: | T:1 |
| 18228: | T:1 |
| 18229: | T:1 |
| 18230: | T:1 |
| 18231: | T:1 |
| 18232: | T:1 |
| 18233: | T:1 |
| 18234: | T:1 |
| 18235: | T:1 |
| 18236: | T:1 |
| 18237: | T:1 |
| 18238: | T:1 |
| 18239: | T:1 |
| 18240: | T:1 |
| 18241: | T:1 |
| 18242: | T:1 |
| 18243: | T:1 |
| 18244: | T:1 |
| 18245: | T:1 |
| 18246: | T:1 |
| 18247: | T:1 |
| 18248: | T:1 |
| 18249: | T:1 |
| 18250: | T:1 |
| 18251: | T:1 |
| 18252: | T:1 |
| 18253: | T:1 |
| 18254: | T:1 |
| 18255: | T:1 |
| 18256: | T:1 |
| 18257: | T:1 |
| 18258: | T:1 |
| 18259: | T:1 |
| 18260: | T:1 |
| 18261: | T:1 |
| 18262: | T:1 |
| 18263: | T:1 |
| 18264: | T:1 |
| 18265: | T:1 |
| 18266: | T:1 |
| 18267: | T:1 |
| 18268: | T:1 |
| 18269: | T:1 |
| 18270: | T:1 |
| 18271: | T:1 |
| 18272: | T:1 |
| 18273: | T:1 |
| 18274: | T:1 |
| 18275: | T:1 |
| 18276: | T:1 |
| 18277: | T:1 |
| 18278: | T:1 |
| 18279: | T:1 |
| 18280: | T:1 |
| 18281: | T:1 |
| 18282: | T:1 |
| 18283: | T:1 |
| 18284: | T:1 |
| 18285: | T:1 |
| 18286: | T:1 |
| 18287: | T:1 |
| 18288: | T:1 |
| 18289: | T:1 |
| 18290: | T:1 |
| 18291: | T:1 |

TABLE II-continued

| SEQ ID NO. | Spatial Distribution |
|---|---|
| 18292: | T:1 |
| 18293: | T:1 |
| 18294: | T:1 |
| 18295: | T:1 |
| 18296: | T:1 |
| 18297: | T:1 |
| 18298: | T:1 |
| 18299: | T:1 |
| 18300: | T:1 |
| 18301: | T:1 |
| 18302: | T:1 |
| 18303: | T:1 |
| 18304: | T:1 |
| 18305: | T:1 |
| 18306: | T:1 |
| 18307: | T:1 |
| 18308: | T:1 |
| 18309: | T:1 |
| 18310: | T:1 |
| 18311: | T:1 |
| 18312: | T:1 |
| 18313: | T:1 |
| 18314: | T:1 |
| 18315: | T:1 |
| 18316: | T:1 |
| 18317: | T:1 |
| 18318: | T:1 |
| 18319: | T:1 |
| 18320: | T:1 |
| 18321: | T:1 |
| 18322: | T:1 |
| 18323: | T:1 |
| 18324: | T:1 |
| 18325: | T:1 |
| 18326: | T:1 |
| 18327: | T:1 |
| 18328: | T:1 |
| 18329: | T:1 |
| 18330: | T:1 |
| 18331: | T:1 |
| 18332: | T:1 |
| 18333: | T:1 |
| 18334: | T:1 |
| 18335: | T:1 |
| 18336: | T:1 |
| 18337: | T:1 |
| 18338: | T:1 |
| 18339: | T:1 |
| 18340: | T:1 |
| 18341: | T:1 |
| 18342: | T:1 |
| 18343: | T:1 |
| 18344: | T:1 |
| 18345: | T:1 |
| 18346: | T:1 |
| 18347: | T:1 |
| 18348: | T:1 |
| 18349: | T:1 |
| 18350: | T:1 |
| 18351: | T:1 |
| 18352: | T:1 |
| 18353: | T:1 |
| 18354: | T:1 |
| 18355: | T:1 |
| 18356: | T:1 |
| 18357: | T:1 |
| 18358: | T:1 |
| 18359: | T:1 |
| 18360: | T:1 |
| 18361: | T:1 |
| 18362: | T:1 |
| 18363: | T:1 |
| 18364: | T:1 |
| 18365: | T:1 |
| 18366: | T:1 |
| 18367: | T:1 |
| 18368: | T:1 |
| 18369: | T:1 |
| 18370: | T:1 |
| 18371: | T:1 |
| 18372: | T:1 |
| 18373: | T:1 |
| 18374: | T:1 |
| 18375: | T:1 |
| 18376: | T:1 |
| 18377: | T:1 |
| 18378: | T:1 |
| 18379: | T:1 |
| 18380: | T:1 |
| 18381: | T:1 |
| 18382: | T:1 |
| 18383: | T:1 |
| 18384: | T:1 |
| 18385: | T:1 |
| 18386: | T:1 |
| 18387: | T:1 |
| 18388: | T:1 |
| 18389: | T:1 |
| 18390: | T:1 |
| 18391: | T:1 |
| 18392: | T:1 |
| 18393: | T:1 |
| 18394: | T:1 |
| 18395: | T:1 |
| 18396: | T:1 |
| 18397: | T:1 |
| 18398: | T:1 |
| 18399: | T:1 |
| 18400: | T:1 |
| 18401: | T:1 |
| 18402: | T:1 |
| 18403: | T:1 |
| 18404: | T:1 |
| 18405: | T:1 |
| 18406: | T:1 |
| 18407: | T:1 |
| 18408: | T:1 |
| 18409: | T:1 |
| 18410: | T:1 |
| 18411: | T:1 |
| 18412: | T:1 |
| 18413: | T:1 |
| 18414: | T:1 |
| 18415: | T:1 |
| 18416: | T:1 |
| 18417: | T:1 |
| 18418: | T:1 |
| 18419: | T:1 |
| 18420: | T:1 |
| 18421: | T:1 |
| 18422: | T:1 |
| 18423: | T:1 |
| 18424: | T:1 |
| 18425: | T:1 |
| 18426: | T:1 |
| 18427: | T:1 |
| 18428: | T:1 |
| 18429: | T:1 |
| 18430: | T:1 |
| 18431: | T:1 |
| 18432: | T:1 |
| 18433: | T:1 |
| 18434: | T:1 |
| 18435: | T:1 |
| 18436: | T:1 |
| 18437: | T:1 |
| 18438: | T:1 |
| 18439: | T:1 |
| 18440: | T:1 |
| 18441: | T:1 |
| 18442: | T:1 |
| 18443: | T:1 |
| 18444: | T:1 |
| 18445: | T:1 |

TABLE II-continued

| SEQ ID NO. | Spatial Distribution |
|---|---|
| 18446: | T:1 |
| 18447: | T:1 |
| 18448: | T:1 |
| 18449: | T:1 |
| 18450: | T:1 |
| 18451: | T:1 |
| 18452: | T:1 |
| 18453: | T:1 |
| 18454: | T:1 |
| 18455: | T:1 |
| 18456: | T:1 |
| 18457: | T:1 |
| 18458: | T:1 |
| 18459: | T:1 |
| 18460: | T:1 |
| 18461: | T:1 |
| 18462: | T:1 |
| 18463: | T:1 |
| 18464: | T:1 |
| 18465: | T:1 |
| 18466: | T:1 |
| 18467: | T:1 |
| 18468: | T:1 |
| 18469: | T:1 |
| 18470: | T:1 |
| 18471: | T:1 |
| 18472: | T:1 |
| 18473: | T:1 |
| 18474: | T:1 |
| 18475: | T:1 |
| 18476: | T:1 |
| 18477: | T:1 |
| 18478: | T:1 |
| 18479: | T:1 |
| 18480: | T:1 |
| 18481: | T:1 |
| 18482: | T:1 |
| 18483: | T:1 |
| 18484: | T:1 |
| 18485: | T:1 |
| 18486: | T:1 |
| 18487: | T:1 |
| 18488: | T:1 |
| 18489: | T:1 |
| 18490: | T:1 |
| 18491: | T:1 |
| 18492: | T:1 |
| 18493: | T:1 |
| 18494: | T:1 |
| 18495: | T:1 |
| 18496: | T:1 |
| 18497: | T:1 |
| 18498: | T:1 |
| 18499: | T:1 |
| 18500: | T:1 |
| 18501: | T:1 |
| 18502: | T:1 |
| 18503: | T:1 |
| 18504: | T:1 |
| 18505: | T:1 |
| 18506: | T:1 |
| 18507: | T:1 |
| 18508: | T:1 |
| 18509: | T:1 |
| 18510: | T:1 |
| 18511: | T:1 |
| 18512: | T:1 |
| 18513: | T:1 |
| 18514: | T:1 |
| 18515: | T:1 |
| 18516: | T:1 |
| 18517: | T:1 |
| 18518: | T:1 |
| 18519: | T:1 |
| 18520: | T:1 |
| 18521: | T:1 |
| 18522: | T:1 |
| 18523: | T:1 |
| 18524: | T:1 |
| 18525: | T:1 |
| 18526: | T:1 |
| 18527: | T:1 |
| 18528: | T:1 |
| 18529: | T:1 |
| 18530: | T:1 |
| 18531: | T:1 |
| 18532: | T:1 |
| 18533: | T:1 |
| 18534: | T:1 |
| 18535: | T:1 |
| 18536: | T:1 |
| 18537: | T:1 |
| 18538: | T:1 |
| 18539: | T:1 |
| 18540: | T:1 |
| 18541: | T:1 |
| 18542: | T:1 |
| 18543: | T:1 |
| 18544: | T:1 |
| 18545: | T:1 |
| 18546: | T:1 |
| 18547: | T:1 |
| 18548: | T:1 |
| 18549: | T:1 |
| 18550: | T:1 |
| 18551: | T:1 |
| 18552: | T:1 |
| 18553: | T:1 |
| 18554: | T:1 |
| 18555: | T:1 |
| 18556: | T:1 |
| 18557: | T:1 |
| 18558: | T:1 |
| 18559: | T:1 |
| 18560: | T:1 |
| 18561: | T:1 |
| 18562: | T:1 |
| 18563: | T:1 |
| 18564: | T:1 |
| 18565: | T:1 |
| 18566: | T:1 |
| 18567: | T:1 |
| 18568: | T:1 |
| 18569: | T:1 |
| 18570: | T:1 |
| 18571: | T:1 |
| 18572: | T:1 |
| 18573: | T:1 |
| 18574: | T:1 |
| 18575: | T:1 |
| 18576: | T:1 |
| 18577: | T:1 |
| 18578: | T:1 |
| 18579: | T:1 |
| 18580: | T:1 |
| 18581: | T:1 |
| 18582: | T:1 |
| 18583: | T:1 |
| 18584: | T:1 |
| 18585: | T:1 |
| 18586: | T:1 |
| 18587: | T:1 |
| 18588: | T:1 |
| 18589: | T:1 |
| 18590: | T:1 |
| 18591: | T:1 |
| 18592: | T:1 |
| 18593: | T:1 |
| 18594: | T:1 |
| 18595: | T:1 |
| 18596: | T:1 |
| 18597: | T:1 |
| 18598: | T:1 |
| 18599: | T:1 |

TABLE II-continued

| SEQ ID NO. | Spatial Distribution |
|---|---|
| 18600: | T:1 |
| 18601: | T:1 |
| 18602: | T:1 |
| 18603: | T:1 |
| 18604: | T:1 |
| 18605: | T:1 |
| 18606: | T:1 |
| 18607: | T:1 |
| 18608: | T:1 |
| 18609: | T:1 |
| 18610: | T:1 |
| 18611: | T:1 |
| 18612: | T:1 |
| 18613: | T:1 |
| 18614: | T:1 |
| 18615: | T:1 |
| 18616: | T:1 |
| 18617: | T:1 |
| 18618: | T:1 |
| 18619: | T:1 |
| 18620: | T:1 |
| 18621: | T:1 |
| 18622: | T:1 |
| 18623: | T:1 |
| 18624: | T:1 |
| 18625: | T:1 |
| 18626: | T:1 |
| 18627: | T:1 |
| 18628: | T:1 |
| 18629: | T:1 |
| 18630: | T:1 |
| 18631: | T:1 |
| 18632: | T:1 |
| 18633: | T:1 |
| 18634: | T:1 |
| 18635: | T: |
| 18636: | T:1 |
| 18637: | T:1 |
| 18638: | T:1 |
| 18639: | T:1 |
| 18640: | T:1 |
| 18641: | T:1 |
| 18642: | T:1 |
| 18643: | T:1 |
| 18644: | T:1 |
| 18645: | T:1 |
| 18646: | T:1 |
| 18647: | T:1 |
| 18648: | T:1 |
| 18649: | T:1 |
| 18650: | T:1 |
| 18651: | T:1 |
| 18652: | T:1 |
| 18653: | T:1 |
| 18654: | T:1 |
| 18655: | T:1 |
| 18656: | T:1 |
| 18657: | T:1 |
| 18658: | T:1 |
| 18659: | T:1 |
| 18660: | T:1 |
| 18661: | T:1 |
| 18662: | T:1 |
| 18663: | T:1 |
| 18664: | T:1 |
| 18665: | T:1 |
| 18666: | T:1 |
| 18667: | T:1 |
| 18668: | T:1 |
| 18669: | T:1 |
| 18670: | T:1 |
| 18671: | T:1 |
| 18672: | T:1 |
| 18673: | T:1 |
| 18674: | T:1 |
| 18675: | T:1 |
| 18676: | T:1 |
| 18677: | T:1 |
| 18678: | T:1 |
| 18679: | T:1 |
| 18680: | T:1 |
| 18681: | T:1 |
| 18682: | T:1 |
| 18683: | T:1 |
| 18684: | T:1 |
| 18685: | T:1 |
| 18686: | T:1 |
| 18687: | T:1 |
| 18688: | T:1 |
| 18689: | T:1 |
| 18690: | T:1 |
| 18691: | T:1 |
| 18692: | T:1 |
| 18693: | T:1 |
| 18694: | T:1 |
| 18695: | T:1 |
| 18696: | T:1 |
| 18697: | T:1 |
| 18698: | T:1 |
| 18699: | T:1 |
| 18700: | T:1 |
| 18701: | T:1 |
| 18702: | T:1 |
| 18703: | T:1 |
| 18704: | T:1 |
| 18705: | T:1 |
| 18706: | T:1 |
| 18707: | T:1 |
| 18708: | T:1 |
| 18709: | T:1 |
| 18710: | T:1 |
| 18711: | T:1 |
| 18712: | T:1 |
| 18713: | T:1 |
| 18714: | T:1 |
| 18715: | T:1 |
| 18716: | T:1 |
| 18717: | T:1 |
| 18718: | T:1 |
| 18719: | T:1 |
| 18720: | T:1 |
| 18721: | T:1 |
| 18722: | T:1 |
| 18723: | T:1 |
| 18724: | T:1 |
| 18725: | T:1 |
| 18726: | T:1 |
| 18727: | T:1 |
| 18728: | T:1 |
| 18729: | T:1 |
| 18730: | T:1 |
| 18731: | T:1 |
| 18732: | T:1 |
| 18733: | T:1 |
| 18734: | T:1 |
| 18735: | T:1 |
| 18736: | T:1 |
| 18737: | T:1 |
| 18738: | T:1 |
| 18739: | T:1 |
| 18740: | T:1 |
| 18741: | T:1 |
| 18742: | T:1 |
| 18743: | T:1 |
| 18744: | T:1 |
| 18745: | T:1 |
| 18746: | T:1 |
| 18747: | T:1 |
| 18748: | T:1 |
| 18749: | T:1 |
| 18750: | T:1 |
| 18751: | T:1 |
| 18752: | T:1 |
| 18753: | T:1 |

TABLE II-continued

| SEQ ID NO. | Spatial Distribution |
|---|---|
| 18754: | T:1 |
| 18755: | T:1 |
| 18756: | T:1 |
| 18757: | T:1 |
| 18758: | T:1 |
| 18759: | T:1 |
| 18760: | T:1 |
| 18761: | T:1 |
| 18762: | T:1 |
| 18763: | T:1 |
| 18764: | T:1 |
| 18765: | T:1 |
| 18766: | T:1 |
| 18767: | T:1 |
| 18768: | T:1 |
| 18769: | T:1 |
| 18770: | T:1 |
| 18771: | T:1 |
| 18772: | T:1 |
| 18773: | T:1 |
| 18774: | T:1 |
| 18775: | T:1 |
| 18776: | T:1 |
| 18777: | T:1 |
| 18778: | T:1 |
| 18779: | T:1 |
| 18780: | T:1 |
| 18781: | T:1 |
| 18782: | T:1 |
| 18783: | T:1 |
| 18784: | T:1 |
| 18785: | T:1 |
| 18786: | T:1 |
| 18787: | T:1 |
| 18788: | T:1 |
| 18789: | T:1 |
| 18790: | T:1 |
| 18791: | T:1 |
| 18792: | T:1 |
| 18793: | T:1 |
| 18794: | T:1 |
| 18795: | T:1 |
| 18796: | T:1 |
| 18797: | T:1 |
| 18798: | T:1 |
| 18799: | T:1 |
| 18800: | T:1 |
| 18801: | T:1 |
| 18802: | T:1 |
| 18803: | T:1 |
| 18804: | T:1 |
| 18805: | T:1 |
| 18806: | T:1 |
| 18807: | T:1 |
| 18808: | T:1 |
| 18809: | T:1 |
| 18810: | T:1 |
| 18811: | T:1 |
| 18812: | T:1 |
| 18813: | T:1 |
| 18814: | T:1 |
| 18815: | T:1 |
| 18816: | T:1 |
| 18817: | T:1 |
| 18818: | T:1 |
| 18819: | T:1 |
| 18820: | T:1 |
| 18821: | T:1 |
| 18822: | T:1 |
| 18823: | T:1 |
| 18824: | T:1 |
| 18825: | T:1 |
| 18826: | T:1 |
| 18827: | T:1 |
| 18828: | T:1 |
| 18829: | T:1 |
| 18830: | T:1 |
| 18831: | T:1 |
| 18832: | T:1 |
| 18833: | T:1 |
| 18834: | T:1 |
| 18835: | T:1 |
| 18836: | T:1 |
| 18837: | T:1 |
| 18838: | T:1 |
| 18839: | T:1 |
| 18840: | T:1 |
| 18841: | T:1 |
| 18842: | T:1 |
| 18843: | T:1 |
| 18844: | T:1 |
| 18845: | T:1 |
| 18846: | T:1 |
| 18847: | T:1 |
| 18848: | T:1 |
| 18849: | T:1 |
| 18850: | T:1 |
| 18851: | T:1 |
| 18852: | T:1 |
| 18853: | T:1 |
| 18854: | T:1 |
| 18855: | T:1 |
| 18856: | T:1 |
| 18857: | T:1 |
| 18858: | T:1 |
| 18859: | T:1 |
| 18860: | T:1 |
| 18861: | T:1 |
| 18862: | T:1 |
| 18863: | T:1 |
| 18864: | T:1 |
| 18865: | T:1 |
| 18866: | T:1 |
| 18867: | T:1 |
| 18868: | T:1 |
| 18869: | T:1 |
| 18870: | T:1 |
| 18871: | T:1 |
| 18872: | T:1 |
| 18873: | T:1 |
| 18874: | T:1 |
| 18875: | T:1 |
| 18876: | T:1 |
| 18877: | T:1 |
| 18878: | T:1 |
| 18879: | T:1 |
| 18880: | T:1 |
| 18881: | T:1 |
| 18882: | T:1 |
| 18883: | T:1 |
| 18884: | T:1 |
| 18885: | T:1 |
| 18886: | T:1 |
| 18887: | T:1 |
| 18888: | T:1 |
| 18889: | T:1 |
| 18890: | T:1 |
| 18891: | T:1 |
| 18892: | T:1 |
| 18893: | T:1 |
| 18894: | T:1 |
| 18895: | T:1 |
| 18896: | T:1 |
| 18897: | T:1 |
| 18898: | T:1 |
| 18899: | T:1 |
| 18900: | T:1 |
| 18901: | T:1 |
| 18902: | T:1 |
| 18903: | T:1 |
| 18904: | T:1 |
| 18905: | T:1 |
| 18906: | T:1 |
| 18907: | T:1 |

TABLE II-continued

| SEQ ID NO. | Spatial Distribution |
|---|---|
| 18908: | T:1 |
| 18909: | T:1 |
| 18910: | T:1 |
| 18911: | T:1 |
| 18912: | T:1 |
| 18913: | T:1 |
| 18914: | T:1 |
| 18915: | T:1 |
| 18916: | T:1 |
| 18917: | T:1 |
| 18918: | T:1 |
| 18919: | T:1 |
| 18920: | T:1 |
| 18921: | T:1 |
| 18922: | T:1 |
| 18923: | T:1 |
| 18924: | T:1 |
| 18925: | T:1 |
| 18926: | T:1 |
| 18927: | T:1 |
| 18928: | T:1 |
| 18929: | T:1 |
| 18930: | T:1 |
| 18931: | T:1 |
| 18932: | T:1 |
| 18933: | T:1 |
| 18934: | T:1 |
| 18935: | T:1 |
| 18936: | T:1 |
| 18937: | T:1 |
| 18938: | T:1 |
| 18939: | T:1 |
| 18940: | T:1 |
| 18941: | T:1 |
| 18942: | T:1 |
| 18943: | T:1 |
| 18944: | T:1 |
| 18945: | T:1 |
| 18946: | T:1 |
| 18947: | T:1 |
| 18948: | T:1 |
| 18949: | T:1 |
| 18950: | T:1 |
| 18951: | T:1 |
| 18952: | T:1 |
| 18953: | T:1 |
| 18954: | T:1 |
| 18955: | T:1 |
| 18956: | T:1 |
| 18957: | T:1 |
| 18958: | T:1 |
| 18959: | T:1 |
| 18960: | T:1 |
| 18961: | T:1 |
| 18962: | T:1 |
| 18963: | T:1 |
| 18964: | T:1 |
| 18965: | T:1 |
| 18966: | T:1 |
| 18967: | T:1 |
| 18968: | T:1 |
| 18969: | T:1 |
| 18970: | T:1 |
| 18971: | T:1 |
| 18972: | T:1 |
| 18973: | T:1 |
| 18974: | T:1 |
| 18975: | T:1 |
| 18976: | T:1 |
| 18977: | T:1 |
| 18978: | T:1 |
| 18979: | T:1 |
| 18980: | T:1 |
| 18981: | T:1 |
| 18982: | T:1 |
| 18983: | T:1 |
| 18984: | T:1 |
| 18985: | T:1 |
| 18986: | T:1 |
| 18987: | T:1 |
| 18988: | T:1 |
| 18989: | T:1 |
| 18990: | T:1 |
| 18991: | T:1 |
| 18992: | T:1 |
| 18993: | T:1 |
| 18994: | T:1 |
| 18995: | T:1 |
| 18996: | T:1 |
| 18997: | T:1 |
| 18998: | T:1 |
| 18999: | T:1 |
| 19000: | T:1 |
| 19001: | T:1 |
| 19002: | T:1 |
| 19003: | T:1 |
| 19004: | T:1 |
| 19005: | T:1 |
| 19006: | T:1 |
| 19007: | T:1 |
| 19008: | T:1 |
| 19009: | T:1 |
| 19010: | T:1 |
| 19011: | T:1 |
| 19012: | T:1 |
| 19013: | T:1 |
| 19014: | T:1 |
| 19015: | T:1 |
| 19016: | T:1 |
| 19017: | T:1 |
| 19018: | T:1 |
| 19019: | T:1 |
| 19020: | T:1 |
| 19021: | T:1 |
| 19022: | T:1 |
| 19023: | T:1 |
| 19024: | T:1 |
| 19025: | T:1 |
| 19026: | T:1 |
| 19027: | T:1 |
| 19028: | T:1 |
| 19029: | T:1 |
| 19030: | T:1 |
| 19031: | T:1 |
| 19032: | T:1 |
| 19033: | T:1 |
| 19034: | T:1 |
| 19035: | T:1 |
| 19036: | T:1 |
| 19037: | T:1 |
| 19038: | T:1 |
| 19039: | T:1 |
| 19040: | T:1 |
| 19041: | T:1 |
| 19042: | T:1 |
| 19043: | T:1 |
| 19044: | T:1 |
| 19045: | T:1 |
| 19046: | T:1 |
| 19047: | T:1 |
| 19048: | T:1 |
| 19049: | T:1 |
| 19050: | T:1 |
| 19051: | T:1 |
| 19052: | T:1 |
| 19053: | T:1 |
| 19054: | T:1 |
| 19055: | T:1 |
| 19056: | T:1 |
| 19057: | T:1 |
| 19058: | T:1 |
| 19059: | T:1 |
| 19060: | T:1 |
| 19061: | T:1 |

TABLE II-continued

| SEQ ID NO. | Spatial Distribution |
|---|---|
| 19062: | T:1 |
| 19063: | T:1 |
| 19064: | T:1 |
| 19065: | T:1 |
| 19066: | T:1 |
| 19067: | T:1 |
| 19068: | T:1 |
| 19069: | T:1 |
| 19070: | T:1 |
| 19071: | T:1 |
| 19072: | T:1 |
| 19073: | T:1 |
| 19074: | T:1 |
| 19075: | T:1 |
| 19076: | T:1 |
| 19077: | T:1 |
| 19078: | T:1 |
| 19079: | T:1 |
| 19080: | T:1 |
| 19081: | T:1 |
| 19082: | T:1 |
| 19083: | T:1 |
| 19084: | T:1 |
| 19085: | T:1 |
| 19086: | T:1 |
| 19087: | T:1 |
| 19088: | T:1 |
| 19089: | T:1 |
| 19090: | T:1 |
| 19091: | T:1 |
| 19092: | T:1 |
| 19093: | T:1 |
| 19094: | T:1 |
| 19095: | T:1 |
| 19096: | T:1 |
| 19097: | T:1 |
| 19098: | T:1 |
| 19099: | T:1 |
| 19100: | T:1 |
| 19101: | T:1 |
| 19102: | T:1 |
| 19103: | T:1 |
| 19104: | T:1 |
| 19105: | T:1 |
| 19106: | T:1 |
| 19107: | T:1 |
| 19108: | T:1 |
| 19109: | T:1 |
| 19110: | T:1 |
| 19111: | T:1 |
| 19112: | T:1 |
| 19113: | T:1 |
| 19114: | T:1 |
| 19115: | T:1 |
| 19116: | T:1 |
| 19117: | T:1 |
| 19118: | T:1 |
| 19119: | T:1 |
| 19120: | T:1 |
| 19121: | T:1 |
| 19122: | T:1 |
| 19123: | T:1 |
| 19124: | T:1 |
| 19125: | T:1 |
| 19126: | T:1 |
| 19127: | T:1 |
| 19128: | T:1 |
| 19129: | T:1 |
| 19130: | T:1 |
| 19131: | T:1 |
| 19132: | T:1 |
| 19133: | T:1 |
| 19134: | T:1 |
| 19135: | T:1 |
| 19136: | T:1 |
| 19137: | T:1 |
| 19138: | T:1 |
| 19139: | T:1 |
| 19140: | T:1 |
| 19141: | T:1 |
| 19142: | T:1 |
| 19143: | T:1 |
| 19144: | T:1 |
| 19145: | T:1 |
| 19146: | T:1 |
| 19147: | T:1 |
| 19148: | T:1 |
| 19149: | T:1 |
| 19150: | T:1 |
| 19151: | T:1 |
| 19152: | T:1 |
| 19153: | T:1 |
| 19154: | T:1 |
| 19155: | T:1 |
| 19156: | T:1 |
| 19157: | T:1 |
| 19158: | T:1 |
| 19159: | T:1 |
| 19160: | T:1 |
| 19161: | T:1 |
| 19162: | T:1 |
| 19163: | T:1 |
| 19164: | T:1 |
| 19165: | T:1 |
| 19166: | T:1 |
| 19167: | T:1 |
| 19168: | T:1 |
| 19169: | T:1 |
| 19170: | T:1 |
| 19171: | T:1 |
| 19172: | T:1 |
| 19173: | T:1 |
| 19174: | T:1 |
| 19175: | T:1 |
| 19176: | T:1 |
| 19177: | T:1 |
| 19178: | T:1 |
| 19179: | T:1 |
| 19180: | T:1 |
| 19181: | T:1 |
| 19182: | T:1 |
| 19183: | T:1 |
| 19184: | T:1 |
| 19185: | T:1 |
| 19186: | T:1 |
| 19187: | T:1 |
| 19188: | T:1 |
| 19189: | T:1 |
| 19190: | T:1 |
| 19191: | T:1 |
| 19192: | T:1 |
| 19193: | T:1 |
| 19194: | T:1 |
| 19195: | T:1 |
| 19196: | T:1 |
| 19197: | T:1 |
| 19198: | T:1 |
| 19199: | T:1 |
| 19200: | T:1 |
| 19201: | T:1 |
| 19202: | T:1 |
| 19203: | T:1 |
| 19204: | T:1 |
| 19205: | T:1 |
| 19206: | T:1 |
| 19207: | T:1 |
| 19208: | T:1 |
| 19209: | T:1 |
| 19210: | T:1 |
| 19211: | T:1 |
| 19212: | T:1 |
| 19213: | T:1 |
| 19214: | T:1 |
| 19215: | T:1 |

TABLE II-continued

| SEQ ID NO. | Spatial Distribution |
|---|---|
| 19216: | T:1 |
| 19217: | T:1 |
| 19218: | T:1 |
| 19219: | T:1 |
| 19220: | T:1 |
| 19221: | T:1 |
| 19222: | T:1 |
| 19223: | T:1 |
| 19224: | T:1 |
| 19225: | T:1 |
| 19226: | T:1 |
| 19227: | T:1 |
| 19228: | T:1 |
| 19229: | T:1 |
| 19230: | T:1 |
| 19231: | T:1 |
| 19232: | T:1 |
| 19233: | T:1 |
| 19234: | T:1 |
| 19235: | T:1 |
| 19236: | T:1 |
| 19237: | T:1 |
| 19238: | T:1 |
| 19239: | T:1 |
| 19240: | T:1 |
| 19241: | T:1 |
| 19242: | T:1 |
| 19243: | T:1 |
| 19244: | T:1 |
| 19245: | T:1 |
| 19246: | T:1 |
| 19247: | T:1 |
| 19248: | T:1 |
| 19249: | T:1 |
| 19250: | T:1 |
| 19251: | T:1 |
| 19252: | T:1 |
| 19253: | T:1 |
| 19254: | T:1 |
| 19255: | T:1 |
| 19256: | T:1 |
| 19257: | T:1 |
| 19258: | T:1 |
| 19259: | T:1 |
| 19260: | T:1 |
| 19261: | T:1 |
| 19262: | T:1 |
| 19263: | T:1 |
| 19264: | T:1 |
| 19265: | T:1 |
| 19266: | T:1 |
| 19267: | T:1 |
| 19268: | T:1 |
| 19269: | T:1 |
| 19270: | T:1 |
| 19271: | T:1 |
| 19272: | T:1 |
| 19273: | T:1 |
| 19274: | T:1 |
| 19275: | T:1 |
| 19276: | T:1 |
| 19277: | T:1 |
| 19278: | T:1 |
| 19279: | T:1 |
| 19280: | T:1 |
| 19281: | T:1 |
| 19282: | T:1 |
| 19283: | T:1 |
| 19284: | T:1 |
| 19285: | T:1 |
| 19286: | T:1 |
| 19287: | T:1 |
| 19288: | T:1 |
| 19289: | T:1 |
| 19290: | T:1 |
| 19291: | T:1 |
| 19292: | T:1 |
| 19293: | T:1 |
| 19294: | T:1 |
| 19295: | T:1 |
| 19296: | T:1 |
| 19297: | T:1 |
| 19298: | T:1 |
| 19299: | T:1 |
| 19300: | T:1 |
| 19301: | T:1 |
| 19302: | T:1 |
| 19303: | T:1 |
| 19304: | T:1 |
| 19305: | T:1 |
| 19306: | T:1 |
| 19307: | T:1 |
| 19308: | T:1 |
| 19309: | T:1 |
| 19310: | T:1 |
| 19311: | T:1 |
| 19312: | T:1 |
| 19313: | T:1 |
| 19314: | T:1 |
| 19315: | T:1 |
| 19316: | T:1 |
| 19317: | T:1 |
| 19318: | T:1 |
| 19319: | T:1 |
| 19320: | T:1 |
| 19321: | T:1 |
| 19322: | T:1 |
| 19323: | T:1 |
| 19324: | T:1 |
| 19325: | T:1 |
| 19326: | T:1 |
| 19327: | T:1 |
| 19328: | T:1 |
| 19329: | T:1 |
| 19330: | T:1 |
| 19331: | T:1 |
| 19332: | T:1 |
| 19333: | T:1 |
| 19334: | T:1 |
| 19335: | T:1 |
| 19336: | T:1 |
| 19337: | T:1 |
| 19338: | T:1 |
| 19339: | T:1 |
| 19340: | T:1 |
| 19341: | T:1 |
| 19342: | T:1 |
| 19343: | T:1 |
| 19344: | T:1 |
| 19345: | T:1 |
| 19346: | T:1 |
| 19347: | T:1 |
| 19348: | T:1 |
| 19349: | T:1 |
| 19350: | T:1 |
| 19351: | T:1 |
| 19352: | T:1 |
| 19353: | T:1 |
| 19354: | T:1 |
| 19355: | T:1 |
| 19356: | T:1 |
| 19357: | T:1 |
| 19358: | T:1 |
| 19359: | T:1 |
| 19360: | T:1 |
| 19361: | T:1 |
| 19362: | T:1 |
| 19363: | T:1 |
| 19364: | T:1 |
| 19365: | T:1 |
| 19366: | T:1 |
| 19367: | T:1 |
| 19368: | T:1 |
| 19369: | T:1 |

TABLE II-continued

| SEQ ID NO. | Spatial Distribution |
|---|---|
| 19370: | T:1 |
| 19371: | T:1 |
| 19372: | T:1 |
| 19373: | T:1 |
| 19374: | T:1 |
| 19375: | T:1 |
| 19376: | T:1 |
| 19377: | T:1 |
| 19378: | T:1 |
| 19379: | T:1 |
| 19380: | T:1 |
| 19381: | T:1 |
| 19382: | T:1 |
| 19383: | T:1 |
| 19384: | T:1 |
| 19385: | T:1 |
| 19386: | T:1 |
| 19387: | T:1 |
| 19388: | T:1 |
| 19389: | T:1 |
| 19390: | T:1 |
| 19391: | T:1 |
| 19392: | T:1 |
| 19393: | T:1 |
| 19394: | T:1 |
| 19395: | T:1 |
| 19396: | T:1 |
| 19397: | T:1 |
| 19398: | T:1 |
| 19399: | T:1 |
| 19400: | T:1 |
| 19401: | T:1 |
| 19402: | T:1 |
| 19403: | T:1 |
| 19404: | T:1 |
| 19405: | T:1 |
| 19406: | T:1 |
| 19407: | T:1 |
| 19408: | T:1 |
| 19409: | T:1 |
| 19410: | T:1 |
| 19411: | T:1 |
| 19412: | T:1 |
| 19413: | T:1 |
| 19414: | T:1 |
| 19415: | T:1 |
| 19416: | T:1 |
| 19417: | T:1 |
| 19418: | T:1 |
| 19419: | T:1 |
| 19420: | T:1 |
| 19421: | T:1 |
| 19422: | T:1 |
| 19423: | T:1 |
| 19424: | T:1 |
| 19425: | T:1 |
| 19426: | T:1 |
| 19427: | T:1 |
| 19428: | T:1 |
| 19429: | T:1 |
| 19430: | T:1 |
| 19431: | T:1 |
| 19432: | T:1 |
| 19433: | T:1 |
| 19434: | T:1 |
| 19435: | T:1 |
| 19436: | T:1 |
| 19437: | T:1 |
| 19438: | T:1 |
| 19439: | T:1 |
| 19440: | T:1 |
| 19441: | T:1 |
| 19442: | T:1 |
| 19443: | T:1 |
| 19444: | T:1 |
| 19445: | T:1 |
| 19446: | T:1 |
| 19447: | T:1 |
| 19448: | T:1 |
| 19449: | T:1 |
| 19450: | T:1 |
| 19451: | T:1 |
| 19452: | T:1 |
| 19453: | T:1 |
| 19454: | T:1 |
| 19455: | T:1 |
| 19456: | T:1 |
| 19457: | T:1 |
| 19458: | T:1 |
| 19459: | T:1 |
| 19460: | T:1 |
| 19461: | T:1 |
| 19462: | T:1 |
| 19463: | T:1 |
| 19464: | T:1 |
| 19465: | T:1 |
| 19466: | T:1 |
| 19467: | T:1 |
| 19468: | T:1 |
| 19469: | T:1 |
| 19470: | T:1 |
| 19471: | T:1 |
| 19472: | T:1 |
| 19473: | T:1 |
| 19474: | T:1 |
| 19475: | T:1 |
| 19476: | T:1 |
| 19477: | T:1 |
| 19478: | T:1 |
| 19479: | T:1 |
| 19480: | T:1 |
| 19481: | T:1 |
| 19482: | T:1 |
| 19483: | T:1 |
| 19484: | T:1 |
| 19485: | T:1 |
| 19486: | T:1 |
| 19487: | T:1 |
| 19488: | T:1 |
| 19489: | T:1 |
| 19490: | T:1 |
| 19491: | T:1 |
| 19492: | T:1 |
| 19493: | T:1 |
| 19494: | T:1 |
| 19495: | T:1 |
| 19496: | T:1 |
| 19497: | T:1 |
| 19498: | T:1 |
| 19499: | T:1 |
| 19500: | T:1 |
| 19501: | T:1 |
| 19502: | T:1 |
| 19503: | T:1 |
| 19504: | T:1 |
| 19505: | T:1 |
| 19506: | T:1 |
| 19507: | T:1 |
| 19508: | T:1 |
| 19509: | T:1 |
| 19510: | T:1 |
| 19511: | T:1 |
| 19512: | T:1 |
| 19513: | T:1 |
| 19514: | T:1 |
| 19515: | T:1 |
| 19516: | T:1 |
| 19517: | T:1 |
| 19518: | T:1 |
| 19519: | T:1 |
| 19520: | T:1 |
| 19521: | T:1 |
| 19522: | T:1 |
| 19523: | T:1 |

TABLE II-continued

| SEQ ID NO. | Spatial Distribution |
|---|---|
| 19524: | T:1 |
| 19525: | T:1 |
| 19526: | T:1 |
| 19527: | T:1 |
| 19528: | T:1 |
| 19529: | T:1 |
| 19530: | T:1 |
| 19531: | T:1 |
| 19532: | T:1 |
| 19533: | T:1 |
| 19534: | T:1 |
| 19535: | T:1 |
| 19536: | T:1 |
| 19537: | T:1 |
| 19538: | T:1 |
| 19539: | T:1 |
| 19540: | T:1 |
| 19541: | T:1 |
| 19542: | T:1 |
| 19543: | T:1 |
| 19544: | T:1 |
| 19545: | T:1 |
| 19546: | T:1 |
| 19547: | T:1 |
| 19548: | T:1 |
| 19549: | T:1 |
| 19550: | T:1 |
| 19551: | T:1 |
| 19552: | T:1 |
| 19553: | T:1 |
| 19554: | T:1 |
| 19555: | T:1 |
| 19556: | T:1 |
| 19557: | T:1 |
| 19558: | T:1 |
| 19559: | T:1 |
| 19560: | T:1 |
| 19561: | T:1 |
| 19562: | T:1 |
| 19563: | T:1 |
| 19564: | T:1 |
| 19565: | T:1 |
| 19566: | T:1 |
| 19567: | T:1 |
| 19568: | T:1 |
| 19569: | T:1 |
| 19570: | T:1 |
| 19571: | T:1 |
| 19572: | T:1 |
| 19573: | T:1 |
| 19574: | T:1 |
| 19575: | T:1 |
| 19576: | T:1 |
| 19577: | T:1 |
| 19578: | T:1 |
| 19579: | T:1 |
| 19580: | T:1 |
| 19581: | T:1 |
| 19582: | T:1 |
| 19583: | T:1 |
| 19584: | T:1 |
| 19585: | T:1 |
| 19586: | T:1 |
| 19587: | T:1 |
| 19588: | T:1 |
| 19589: | T:1 |
| 19590: | T:1 |
| 19591: | T:1 |
| 19592: | T:1 |
| 19593: | T:1 |
| 19594: | T:1 |
| 19595: | T:1 |
| 19596: | T:1 |
| 19597: | T:1 |
| 19598: | T:1 |
| 19599: | T:1 |
| 19600: | T:1 |
| 19601: | T:1 |
| 19602: | T:1 |
| 19603: | T:1 |
| 19604: | T:1 |
| 19605: | T:1 |
| 19606: | T:1 |
| 19607: | T:1 |
| 19608: | T:1 |
| 19609: | T:1 |
| 19610: | T:1 |
| 19611: | T:1 |
| 19612: | T:1 |
| 19613: | T:1 |
| 19614: | T:1 |
| 19615: | T:1 |
| 19616: | T:1 |
| 19617: | T:1 |
| 19618: | T:1 |
| 19619: | T:1 |
| 19620: | T:1 |
| 19621: | T:1 |
| 19622: | T:1 |
| 19623: | T:1 |
| 19624: | T:1 |
| 19625: | T:1 |
| 19626: | T:1 |
| 19627: | T:1 |
| 19628: | T:1 |
| 19629: | T:1 |
| 19630: | T:1 |
| 19631: | T:1 |
| 19632: | T:1 |
| 19633: | T:1 |
| 19634: | T:1 |
| 19635: | T:1 |
| 19636: | T:1 |
| 19637: | T:1 |
| 19638: | T:1 |
| 19639: | T:1 |
| 19640: | T:1 |
| 19641: | T:1 |
| 19642: | T:1 |
| 19643: | T:1 |
| 19644: | T:1 |
| 19645: | T:1 |
| 19646: | T:1 |
| 19647: | T:1 |
| 19648: | T:1 |
| 19649: | T:1 |
| 19650: | T:1 |
| 19651: | T:1 |
| 19652: | T:1 |
| 19653: | T:1 |
| 19654: | T:1 |
| 19655: | T:1 |
| 19656: | T:1 |
| 19657: | T:1 |
| 19658: | T:1 |
| 19659: | T:1 |
| 19660: | T:1 |
| 19661: | T:1 |
| 19662: | T:1 |
| 19663: | T:1 |
| 19664: | T:1 |
| 19665: | T:1 |
| 19666: | T:1 |
| 19667: | T:1 |
| 19668: | T:1 |
| 19669: | T:1 |
| 19670: | T:1 |
| 19671: | T:1 |
| 19672: | T:1 |
| 19673: | T:1 |
| 19674: | T:1 |
| 19675: | T:1 |
| 19676: | T:1 |
| 19677: | T:1 |

TABLE II-continued

| SEQ ID NO. | Spatial Distribution |
|---|---|
| 19678: | T:1 |
| 19679: | T:1 |
| 19680: | T:1 |
| 19681: | T:1 |
| 19682: | T:1 |
| 19683: | T:1 |
| 19684: | T:1 |
| 19685: | T:1 |
| 19686: | T:1 |
| 19687: | T:1 |
| 19688: | T:1 |
| 19689: | T:1 |
| 19690: | T:1 |
| 19691: | T:1 |
| 19692: | T:1 |
| 19693: | T:1 |
| 19694: | T:1 |
| 19695: | T:1 |
| 19696: | T:1 |
| 19697: | T:1 |
| 19698: | T:1 |
| 19699: | T:1 |
| 19700: | T:1 |
| 19701: | T:1 |
| 19702: | T:1 |
| 19703: | T:1 |
| 19704: | T:1 |
| 19705: | T:1 |
| 19706: | T:1 |
| 19707: | T:1 |
| 19708: | T:1 |
| 19709: | T:1 |
| 19710: | T:1 |
| 19711: | T:1 |
| 19712: | T:1 |
| 19713: | T:1 |
| 19714: | T:1 |
| 19715: | T:1 |
| 19716: | T:1 |
| 19717: | T:1 |
| 19718: | T:1 |
| 19719: | T:1 |
| 19720: | T:1 |
| 19721: | T:1 |
| 19722: | T:1 |
| 19723: | T:1 |
| 19724: | T:1 |
| 19725: | T:1 |
| 19726: | T:1 |
| 19727: | T:1 |
| 19728: | T:1 |
| 19729: | T:1 |
| 19730: | T:1 |
| 19731: | T:1 |
| 19732: | T:1 |
| 19733: | T:1 |
| 19734: | T:1 |
| 19735: | T:1 |
| 19736: | T:1 |
| 19737: | T:1 |
| 19738: | T:1 |
| 19739: | T:1 |
| 19740: | T:1 |
| 19741: | T:1 |
| 19742: | T:1 |
| 19743: | T:1 |
| 19744: | T:1 |
| 19745: | T:1 |
| 19746: | T:1 |
| 19747: | T:1 |
| 19748: | T:1 |
| 19749: | T:1 |
| 19750: | T:1 |
| 19751: | T:1 |
| 19752: | T:1 |
| 19753: | T:1 |
| 19754: | T:1 |
| 19755: | T:1 |
| 19756: | T:1 |
| 19757: | T:1 |
| 19758: | T:1 |
| 19759: | T:1 |
| 19760: | T:1 |
| 19761: | T:1 |
| 19762: | T:1 |
| 19763: | T:1 |
| 19764: | T:1 |
| 19765: | T:1 |
| 19766: | T:1 |
| 19767: | T:1 |
| 19768: | T:1 |
| 19769: | T:1 |
| 19770: | T:1 |
| 19771: | T:1 |
| 19772: | T:1 |
| 19773: | T:1 |
| 19774: | T:1 |
| 19775: | T:1 |
| 19776: | T:1 |
| 19777: | T:1 |
| 19778: | T:1 |
| 19779: | T:1 |
| 19780: | T:1 |
| 19781: | T:1 |
| 19782: | T:1 |
| 19783: | T:1 |
| 19784: | T:1 |
| 19785: | T:1 |
| 19786: | T:1 |
| 19787: | T:1 |
| 19788: | T:1 |
| 19789: | T:1 |
| 19790: | T:1 |
| 19791: | T:1 |
| 19792: | T:1 |
| 19793: | T:1 |
| 19794: | T:1 |
| 19795: | T:1 |
| 19796: | T:1 |
| 19797: | T:1 |
| 19798: | T:1 |
| 19799: | T:1 |
| 19800: | T:1 |
| 19801: | T:1 |
| 19802: | T:1 |
| 19803: | T:1 |
| 19804: | T:1 |
| 19805: | T:1 |
| 19806: | T:1 |
| 19807: | T:1 |
| 19808: | T:1 |
| 19809: | T:1 |
| 19810: | T:1 |
| 19811: | T:1 |
| 19812: | T:1 |
| 19813: | T:1 |
| 19814: | T:1 |
| 19815: | T:1 |
| 19816: | T:1 |
| 19817: | T:1 |
| 19818: | T:1 |
| 19819: | T:1 |
| 19820: | T:1 |
| 19821: | T:1 |
| 19822: | T:1 |
| 19823: | T:1 |
| 19824: | T:1 |
| 19825: | T:1 |
| 19826: | T:1 |
| 19827: | T:1 |
| 19828: | T:1 |
| 19829: | T:1 |
| 19830: | T:1 |
| 19831: | T:1 |

TABLE II-continued

| SEQ ID NO. | Spatial Distribution |
|---|---|
| 19832: | T:1 |
| 19833: | T:1 |
| 19834: | T:1 |
| 19835: | T:1 |
| 19536: | T:1 |
| 19837: | T:1 |
| 19838: | T:1 |
| 19839: | T:1 |
| 19840: | T:1 |
| 19841: | T:1 |
| 19842: | T:1 |
| 19843: | T:1 |
| 19844: | T:1 |
| 19845: | T:1 |
| 19846: | T:1 |
| 19847: | T:1 |
| 19848: | T:1 |
| 19849: | T:1 |
| 19850: | T:1 |
| 19851: | T:1 |
| 19852: | T:1 |
| 19853: | T:1 |
| 19854: | T:1 |
| 19855: | T:1 |
| 19856: | T:1 |
| 19857: | T:1 |
| 19858: | T:1 |
| 19859: | T:1 |
| 19860: | T:1 |
| 19861: | T:1 |
| 19862: | T:1 |
| 19863: | T:1 |
| 19864: | T:1 |
| 19865: | T:1 |
| 19866: | T:1 |
| 19867: | T:1 |
| 19868: | T:1 |
| 19869: | T:1 |
| 19870: | T:1 |
| 19871: | T:1 |
| 19872: | T:1 |
| 19873: | T:1 |
| 19874: | T:1 |
| 19875: | T:1 |
| 19876: | T:1 |
| 19877: | T:1 |
| 19878: | T:1 |
| 19879: | T:1 |
| 19880: | T:1 |
| 19881: | T:1 |
| 19882: | T:1 |
| 19883: | T:1 |
| 19884: | T:1 |
| 19885: | T:1 |
| 19886: | T:1 |
| 19887: | T:1 |
| 19888: | T:1 |
| 19889: | T:1 |
| 19890: | T:1 |
| 19891: | T:1 |
| 19892: | T:1 |
| 19893: | T:1 |
| 19894: | T:1 |
| 19895: | T:1 |
| 19896: | T:1 |
| 19897: | T:1 |
| 19898: | T:1 |
| 19899: | T:1 |
| 19900: | T:1 |
| 19901: | T:1 |
| 19902: | T:1 |
| 19903: | T:1 |
| 19904: | T:1 |
| 19905: | T:1 |
| 19906: | T:1 |
| 19907: | T:1 |
| 19908: | T:1 |
| 19909: | T:1 |
| 19910: | T:1 |
| 19911: | T:1 |
| 19912: | T:1 |
| 19913: | T:1 |
| 19914: | T:1 |
| 19915: | T:1 |
| 19916: | T:1 |
| 19917: | T:1 |
| 19918: | T:1 |
| 19919: | T:1 |
| 19920: | T:1 |
| 19921: | T:1 |
| 19922: | T:1 |
| 19923: | T:1 |
| 19924: | T:1 |
| 19925: | T:1 |
| 19926: | T:1 |
| 19927: | T:1 |
| 19928: | T:1 |
| 19929: | T:1 |
| 19930: | T:1 |
| 19931: | T:1 |
| 19932: | T:1 |
| 19933: | T:1 |
| 19934: | T:1 |
| 19935: | T:1 |
| 19936: | T:1 |
| 19937: | T:1 |
| 19938: | T:1 |
| 19939: | T:1 |
| 19940: | T:1 |
| 19941: | T:1 |
| 19942: | T:1 |
| 19943: | T:1 |
| 19944: | T:1 |
| 19945: | T:1 |
| 19946: | T:1 |
| 19947: | T:1 |
| 19948: | T:1 |
| 19949: | T:1 |
| 19950: | T:1 |
| 19951: | T:1 |
| 19952: | T:1 |
| 19953: | T:1 |
| 19954: | T:1 |
| 19955: | T:1 |
| 19956: | T:1 |
| 19957: | T:1 |
| 19958: | T:1 |
| 19959: | T:1 |
| 19960: | T:1 |
| 19961: | T:1 |
| 19962: | T:1 |
| 19963: | T:1 |
| 19964: | T:1 |
| 19965: | T:1 |
| 19966: | T:1 |
| 19967: | T:1 |
| 19968: | T:1 |
| 19969: | T:1 |
| 19970: | T:1 |
| 19971: | T:1 |
| 19972: | T:1 |
| 19973: | T:1 |
| 19974: | T:1 |
| 19975: | T:1 |
| 19976: | T:1 |
| 19977: | T:1 |
| 19978: | T:1 |
| 19979: | T:1 |
| 19980: | T:1 |
| 19981: | T:1 |
| 19982: | T:1 |
| 19983: | T:1 |
| 19984: | T:1 |
| 19985: | T:1 |

TABLE II-continued

| SEQ ID NO. | Spatial Distribution |
|---|---|
| 19986: | T:1 |
| 19987: | T:1 |
| 19988: | T:1 |
| 19989: | T:1 |
| 19990: | T:1 |
| 19991: | T:1 |
| 19992: | T:1 |
| 19993: | T:1 |
| 19994: | T:1 |
| 19995: | T:1 |
| 19996: | T:1 |
| 19997: | T:1 |
| 19998: | T:1 |
| 19999: | T:1 |
| 20000: | T:1 |
| 20001: | T:1 |
| 20002: | T:1 |
| 20003: | T:1 |
| 20004: | T:1 |
| 20005: | T:1 |
| 20006: | T:1 |
| 20007: | T:1 |
| 20008: | T:1 |
| 20009: | T:1 |
| 20010: | T:1 |
| 20011: | T:1 |
| 20012: | T:1 |
| 20013: | T:1 |
| 20014: | T:1 |
| 20015: | T:1 |
| 20016: | T:1 |
| 20017: | T:1 |
| 20018: | T:1 |
| 20019: | T:1 |
| 20020: | T:1 |
| 20021: | T:1 |
| 20022: | T:1 |
| 20023: | T:1 |
| 20024: | T:1 |
| 20025: | T:1 |
| 20026: | T:1 |
| 20027: | T:1 |
| 20028: | T:1 |
| 20029: | T:1 |
| 20030: | T:1 |
| 20031: | T:1 |
| 20032: | T:1 |
| 20033: | T:1 |
| 20034: | T:1 |
| 20035: | T:1 |
| 20036: | T:1 |
| 20037: | T:1 |
| 20038: | T:1 |
| 20039: | T:1 |
| 20040: | T:1 |
| 20041: | T:1 |
| 20042: | T:1 |
| 20043: | T:1 |
| 20044: | T:1 |
| 20045: | T:1 |
| 20046: | T:1 |
| 20047: | T:1 |
| 20048: | T:1 |
| 20049: | T:1 |
| 20050: | T:1 |
| 20051: | T:1 |
| 20052: | T:1 |
| 20053: | T:1 |
| 20054: | T:1 |
| 20055: | T:1 |
| 20056: | R:1 |
| 20057: | R:1 |
| 20058: | R:1 |
| 20059: | R:1 |
| 20060: | R:1 |
| 20061: | R:1 |
| 20062: | R:1 |
| 20063: | R:1 |
| 20064: | R:1 |
| 20065: | R:1 |
| 20066: | R:1 |
| 20067: | R:1 |
| 20068: | R:1 |
| 20069: | R:1 |
| 20070: | R:1 |
| 20071: | R:1 |
| 20072: | R:1 |
| 20073: | R:1 |
| 20074: | R:1 |
| 20075: | R:1 |
| 20076: | R:1 |
| 20077: | R:1 |
| 20078: | R:1 |
| 20079: | R:1 |
| 20080: | R:1 |
| 20081: | R:1 |
| 20082: | R:1 |
| 20083: | R:1 |
| 20084: | R:1 |
| 20085: | R:1 |
| 20086: | R:1 |
| 20087: | R:1 |
| 20088: | R:1 |
| 20089: | R:1 |
| 20090: | R:1 |
| 20091: | R:1 |
| 20092: | R:1 |
| 20093: | R:1 |
| 20094: | R:1 |
| 20095: | R:1 |
| 20096: | R:1 |
| 20097: | R:1 |
| 20098: | R:1 |
| 20099: | R:1 |
| 20100: | R:1 |
| 20101: | R:1 |
| 20102: | R:1 |
| 20103: | R:1 |
| 20104: | R:1 |
| 20105: | R:1 |
| 20106: | R:1 |
| 20107: | R:1 |
| 20108: | R:1 |
| 20109: | R:1 |
| 20110: | R:1 |
| 20111: | R:1 |
| 20112: | R:1 |
| 20113: | R:1 |
| 20114: | R:1 |
| 20115: | R:1 |
| 20116: | R:1 |
| 20117: | R:1 |
| 20118: | R:1 |
| 20119: | R:1 |
| 20120: | R:1 |
| 20121: | R:1 |
| 20122: | R:1 |
| 20123: | R:1 |
| 20124: | R:1 |
| 20125: | R:1 |
| 20126: | R:1 |
| 20127: | R:1 |
| 20128: | R:1 |
| 20129: | R:1 |
| 20130: | R:1 |
| 20131: | R:1 |
| 20132: | R:1 |
| 20133: | R:1 |
| 20134: | R:1 |
| 20135: | R:1 |
| 20136: | R:1 |
| 20137: | R:1 |
| 20138: | R:1 |
| 20139: | R:1 |

TABLE II-continued

| SEQ ID NO. | Spatial Distribution |
|---|---|
| 20140: | R:1 |
| 20141: | R:1 |
| 20142: | R:1 |
| 20143: | R:1 |
| 20144: | R:1 |
| 20145: | R:1 |
| 20146: | R:1 |
| 20147: | R:1 |
| 20148: | R:1 |
| 20149: | R:1 |
| 20150: | R:1 |
| 20151: | R:1 |
| 20152: | R:1 |
| 20153: | R:1 |
| 20154: | R:1 |
| 20155: | R:1 |
| 20156: | R:1 |
| 20157: | R:1 |
| 20158: | R:1 |
| 20159: | R:1 |
| 20160: | R:1 |
| 20161: | R:1 |
| 20162: | R:1 |
| 20163: | R:1 |
| 20164: | R:1 |
| 20165: | R:1 |
| 20166: | R:1 |
| 20167: | R:1 |
| 20168: | R:1 |
| 20169: | R:1 |
| 20170: | R:1 |
| 20171: | R:1 |
| 20172: | R:1 |
| 20173: | R:1 |
| 20174: | R:1 |
| 20175: | R:1 |
| 20176: | R:1 |
| 20177: | R:1 |
| 20178: | R:1 |
| 20179: | R:1 |
| 20180: | R:1 |
| 20181: | R:1 |
| 20182: | R:1 |
| 20183: | R:1 |
| 20184: | R:1 |
| 20185: | R:1 |
| 20186: | R:1 |
| 20187: | R:1 |
| 20188: | R:1 |
| 20189: | R:1 |
| 20190: | R:1 |
| 20191: | R:1 |
| 20192: | R:1 |
| 20193: | R:1 |
| 20194: | R:1 |
| 20195: | R:1 |
| 20196: | R:1 |
| 20197: | R:1 |
| 20198: | R:1 |
| 20199: | R:1 |
| 20200: | R:1 |
| 20201: | R:1 |
| 20202: | R:1 |
| 20203: | R:1 |
| 20204: | R:1 |
| 20205: | R:1 |
| 20206: | R:1 |
| 20207: | R:1 |
| 20208: | R:1 |
| 20209: | R:1 |
| 20210: | R:1 |
| 20211: | R:1 |
| 20212: | R:1 |
| 20213: | R:1 |
| 20214: | R:1 |
| 20215: | R:1 |
| 20216: | R:1 |
| 20217: | R:1 |
| 20218: | R:1 |
| 20219: | R:1 |
| 20220: | R:1 |
| 20221: | R:1 |
| 20222: | R:1 |
| 20223: | R:1 |
| 20224: | R:1 |
| 20225: | R:1 |
| 20226: | R:1 |
| 20227: | R:1 |
| 20228: | R:1 |
| 20229: | R:1 |
| 20230: | R:1 |
| 20231: | R:1 |
| 20232: | R:1 |
| 20233: | R:1 |
| 20234: | R:1 |
| 20235: | R:1 |
| 20236: | R:1 |
| 20237: | R:1 |
| 20238: | R:1 |
| 20239: | R:1 |
| 20240: | R:1 |
| 20241: | R:1 |
| 20242: | R:1 |
| 20243: | R:1 |
| 20244: | R:1 |
| 20245: | R:1 |
| 20246: | R:1 |
| 20247: | R:1 |
| 20248: | R:1 |
| 20249: | R:1 |
| 20250: | R:1 |
| 20251: | R:1 |
| 20252: | R:1 |
| 20253: | R:1 |
| 20254: | R:1 |
| 20255: | R:1 |
| 20256: | F:1 |
| 20257: | F:1 |
| 20258: | F:1 |
| 20259: | F:1 |
| 20260: | F:1 |
| 20261: | F:1 |
| 20262: | F:1 |
| 20263: | F:1 |
| 20264: | F:1 |
| 20265: | F:1 |
| 20266: | F:1 |
| 20267: | F:1 |
| 20268: | F:1 |
| 20269: | F:1 |
| 20270: | F:1 |
| 20271: | F:1 |
| 20272: | F:1 |
| 20273: | F:1 |
| 20274: | F:1 |
| 20275: | F:1 |
| 20276: | F:1 |
| 20277: | F:1 |
| 20278: | F:1 |
| 20279: | F:1 |
| 20280: | F:1 |
| 20281: | F:1 |
| 20282: | F:1 |
| 20283: | F:1 |
| 20284: | F:1 |
| 20285: | F:1 |
| 20286: | F:1 |
| 20287: | F:1 |
| 20288: | F:1 |
| 20289: | F:1 |
| 20290: | F:1 |
| 20291: | F:1 |
| 20292: | F:1 |
| 20293: | F:1 |

TABLE II-continued

| SEQ ID NO. | Spatial Distribution |
|---|---|
| 20294: | F:1 |
| 20295: | F:1 |
| 20296: | F:1 |
| 20297: | F:1 |
| 20298: | F:1 |
| 20299: | F:1 |
| 20300: | F:1 |
| 20301: | F:1 |
| 20302: | F:1 |
| 20303: | F:1 |
| 20304: | F:1 |
| 20305: | F:1 |
| 20306: | F:1 |
| 20307: | F:1 |
| 20308: | F:1 |
| 20309: | F:1 |
| 20310: | F:1 |
| 20311: | F:1 |
| 20312: | F:1 |
| 20313: | F:1 |
| 20314: | F:1 |
| 20315: | F:1 |
| 20316: | F:1 |
| 20317: | F:1 |
| 20318: | F:1 |
| 20319: | F:1 |
| 20320: | F:1 |
| 20321: | F:1 |
| 20322: | F:1 |
| 20323: | F:1 |
| 20324: | F:1 |
| 20325: | F:1 |
| 20326: | F:1 |
| 20327: | F:1 |
| 20328: | F:1 |
| 20329: | F:1 |
| 20330: | F:1 |
| 20331: | F:1 |
| 20332: | F:1 |
| 20333: | F:1 |
| 20334: | F:1 |
| 20335: | F:1 |
| 20336: | F:1 |
| 20337: | F:1 |
| 20338: | F:1 |
| 20339: | F:1 |
| 20340: | F:1 |
| 20341: | F:1 |
| 20342: | F:1 |
| 20343: | F:1 |
| 20344: | F:1 |
| 20345: | F:1 |
| 20346: | F:1 |
| 20347: | F:1 |
| 20348: | F:1 |
| 20349: | F:1 |
| 20350: | F:1 |
| 20351: | F:1 |
| 20352: | F:1 |
| 20353: | F:1 |
| 20354: | F:1 |
| 20355: | F:1 |
| 20356: | F:1 |
| 20357: | F:1 |
| 20358: | F:1 |
| 20359: | F:1 |
| 20360: | F:1 |
| 20361: | F:1 |
| 20362: | F:1 |
| 20363: | F:1 |
| 20364: | F:1 |
| 20365: | F:1 |
| 20366: | F:1 |
| 20367: | F:1 |
| 20368: | F:1 |
| 20369: | F:1 |
| 20370: | F:1 |
| 20371: | F:1 |
| 20372: | F:1 |
| 20373: | F:1 |
| 20374: | F:1 |
| 20375: | F:1 |
| 20376: | F:1 |
| 20377: | F:1 |
| 20378: | F:1 |
| 20379: | F:1 |
| 20380: | F:1 |
| 20381: | F:1 |
| 20382: | F:1 |
| 20383: | F:1 |
| 20384: | F:1 |
| 20385: | F:1 |
| 20386: | F:1 |
| 20387: | F:1 |
| 20388: | F:1 |
| 20389: | F:1 |
| 20390: | F:1 |
| 20391: | F:1 |
| 20392: | F:1 |
| 20393: | F:1 |
| 20394: | F:1 |
| 20395: | F:1 |
| 20396: | F:1 |
| 20397: | F:1 |
| 20398: | F:1 |
| 20399: | F:1 |
| 20400: | F:1 |
| 20401: | F:1 |
| 20402: | F:1 |
| 20403: | F:1 |
| 20404: | F:1 |
| 20405: | F:1 |
| 20406: | F:1 |
| 20407: | F:1 |
| 20408: | F:1 |
| 20409: | F:1 |
| 20410: | F:1 |
| 20411: | F:1 |
| 20412: | F:1 |
| 20413: | F:1 |
| 20414: | F:1 |
| 20415: | F:1 |
| 20416: | F:1 |
| 20417: | F:1 |
| 20418: | F:1 |
| 20419: | F:1 |
| 20420: | F:1 |
| 20421: | F:1 |
| 20422: | F:1 |
| 20423: | F:1 |
| 20424: | F:1 |
| 20425: | F:1 |
| 20426: | F:1 |
| 20427: | F:1 |
| 20428: | F:1 |
| 20429: | F:1 |
| 20430: | F:1 |
| 20431: | F:1 |
| 20432: | F:1 |
| 20433: | F:1 |
| 20434: | F:1 |
| 20435: | F:1 |
| 20436: | F:1 |
| 20437: | F:1 |
| 20438: | F:1 |
| 20439: | F:1 |
| 20440: | F:1 |
| 20441: | F:1 |
| 20442: | F:1 |
| 20443: | F:1 |
| 20444: | F:1 |
| 20445: | F:1 |
| 20446: | F:1 |
| 20447: | F:1 |

TABLE II-continued

| SEQ ID NO. | Spatial Distribution |
|---|---|
| 20448: | F:1 |
| 20449: | F:1 |
| 20450: | F:1 |
| 20451: | F:1 |
| 20452: | F:1 |
| 20453: | F:1 |
| 20454: | F:1 |
| 20455: | F:1 |
| 20456: | F:1 |
| 20457: | F:1 |
| 20458: | F:1 |
| 20459: | F:1 |
| 20460: | F:1 |
| 20461: | F:1 |
| 20462: | F:1 |
| 20463: | F:1 |
| 20464: | F:1 |
| 20465: | F:1 |
| 20466: | F:1 |
| 20467: | F:1 |
| 20468: | F:1 |
| 20469: | F:1 |
| 20470: | F:1 |
| 20471: | F:1 |
| 20472: | F:1 |
| 20473: | F:1 |
| 20474: | F:1 |
| 20475: | F:1 |
| 20476: | F:1 |
| 20477: | F:1 |
| 20478: | F:1 |
| 20479: | F:1 |
| 20480: | F:1 |
| 20481: | F:1 |
| 20482: | F:1 |
| 20483: | F:1 |
| 20484: | F:1 |
| 20485: | F:1 |
| 20486: | F:1 |
| 20487: | F:1 |
| 20488: | F:1 |
| 20489: | F:1 |
| 20490: | F:1 |
| 20491: | F:1 |
| 20492: | F:1 |
| 20493: | F:1 |
| 20494: | F:1 |
| 20495: | F:1 |
| 20496: | F:1 |
| 20497: | F:1 |
| 20498: | F:1 |
| 20499: | F:1 |
| 20500: | F:1 |
| 20501: | F:1 |
| 20502: | F:1 |
| 20503: | F:1 |
| 20504: | F:1 |
| 20505: | F:1 |
| 20506: | F:1 |
| 20507: | F:1 |
| 20508: | F:1 |
| 20509: | F:1 |
| 20510: | F:1 |
| 20511: | F:1 |
| 20512: | F:1 |
| 20513: | F:1 |
| 20514: | F:1 |
| 20515: | F:1 |
| 20516: | F:1 |
| 20517: | F:1 |
| 20518: | F:1 |
| 20519: | F:1 |
| 20520: | F:1 |
| 20521: | F:1 |
| 20522: | F:1 |
| 20523: | F:1 |
| 20524: | F:1 |
| 20525: | F:1 |
| 20526: | F:1 |
| 20527: | F:1 |
| 20528: | F:1 |
| 20529: | F:1 |
| 20530: | F:1 |
| 20531: | F:1 |
| 20532: | F:1 |
| 20533: | F:1 |
| 20534: | F:1 |
| 20535: | F:1 |
| 20536: | F:1 |
| 20537: | F:1 |
| 20538: | F:1 |
| 20539: | F:1 |
| 20540: | F:1 |
| 20541: | F:1 |
| 20542: | F:1 |
| 20543: | F:1 |
| 20544: | F:1 |
| 20545: | F:1 |
| 20546: | F:1 |
| 20547: | F:1 |
| 20548: | F:1 |
| 20549: | F:1 |
| 20550: | F:1 |
| 20551: | F:1 |
| 20552: | F:1 |
| 20553: | F:1 |
| 20554: | F:1 |
| 20555: | F:1 |
| 20556: | F:1 |
| 20557: | F:1 |
| 20558: | F:1 |
| 20559: | F:1 |
| 20560: | F:1 |
| 20561: | F:1 |
| 20562: | F:1 |
| 20563: | F:1 |
| 20564: | F:1 |
| 20565: | F:1 |
| 20566: | F:1 |
| 20567: | F:1 |
| 20568: | F:1 |
| 20569: | F:1 |
| 20570: | F:1 |
| 20571: | F:1 |
| 20572: | F:1 |
| 20573: | F:1 |
| 20574: | F:1 |
| 20575: | F:1 |
| 20576: | F:1 |
| 20577: | F:1 |
| 20578: | F:1 |
| 20579: | F:1 |
| 20580: | F:1 |
| 20581: | F:1 |
| 20582: | F:1 |
| 20583: | F:1 |
| 20584: | F:1 |
| 20585: | F:1 |
| 20586: | F:1 |
| 20587: | F:1 |
| 20588: | F:1 |
| 20589: | F:1 |
| 20590: | F:1 |
| 20591: | F:1 |
| 20592: | F:1 |
| 20593: | F:1 |
| 20594: | F:1 |
| 20595: | F:1 |
| 20596: | F:1 |
| 20597: | F:1 |
| 20598: | F:1 |
| 20599: | F:1 |
| 20600: | F:1 |
| 20601: | F:1 |

TABLE II-continued

| SEQ ID NO. | Spatial Distribution |
|---|---|
| 20602: | F:1 |
| 20603: | F:1 |
| 20604: | F:1 |
| 20605: | F:1 |
| 20606: | F:1 |
| 20607: | F:1 |
| 20608: | F:1 |
| 20609: | F:1 |
| 20610: | F:1 |
| 20611: | F:1 |
| 20612: | F:1 |
| 20613: | F:1 |
| 20614: | F:1 |
| 20615: | F:1 |
| 20616: | F:1 |
| 20617: | F:1 |
| 20618: | F:1 |
| 20619: | F:1 |
| 20620: | F:1 |
| 20621: | F:1 |
| 20622: | F:1 |
| 20623: | F:1 |
| 20624: | F:1 |
| 20625: | F:1 |
| 20626: | F:1 |
| 20627: | F:1 |
| 20628: | F:1 |
| 20629: | F:1 |
| 20630: | F:1 |
| 20631: | F:1 |
| 20632: | F:1 |
| 20633: | F:1 |
| 20634: | F:1 |
| 20635: | F:1 |
| 20636: | F:1 |
| 20637: | F:1 |
| 20638: | F:1 |
| 20639: | F:1 |
| 20640: | F:1 |
| 20641: | F:1 |
| 20642: | F:1 |
| 20643: | F:1 |
| 20644: | F:1 |
| 20645: | F:1 |
| 20646: | F:1 |
| 20647: | F:1 |
| 20648: | F:1 |
| 20649: | F:1 |
| 20650: | F:1 |
| 20651: | F:1 |
| 20652: | F:1 |
| 20653: | F:1 |
| 20654: | F:1 |
| 20655: | F:1 |
| 20656: | F:1 |
| 20657: | F:1 |
| 20658: | F:1 |
| 20659: | F:1 |
| 20660: | F:1 |
| 20661: | F:1 |
| 20662: | F:1 |
| 20663: | F:1 |
| 20664: | F:1 |
| 20665: | F:1 |
| 20666: | F:1 |
| 20667: | F:1 |
| 20668: | F:1 |
| 20669: | F:1 |
| 20670: | F:1 |
| 20671: | F:1 |
| 20672: | F:1 |
| 20673: | F:1 |
| 20674: | F:1 |
| 20675: | F:1 |
| 20676: | F:1 |
| 20677: | F:1 |
| 20678: | F:1 |
| 20679: | F:1 |
| 20680: | F:1 |
| 20681: | F:1 |
| 20682: | F:1 |
| 20683: | F:1 |
| 20684: | F:1 |
| 20685: | F:1 |
| 20686: | F:1 |
| 20687: | F:1 |
| 20688: | F:1 |
| 20689: | F:1 |
| 20690: | F:1 |
| 20691: | F:1 |
| 20692: | F:1 |
| 20693: | F:1 |
| 20694: | F:1 |
| 20695: | F:1 |
| 20696: | F:1 |
| 20697: | F:1 |
| 20698: | F:1 |
| 20699: | F:1 |
| 20700: | F:1 |
| 20701: | F:1 |
| 20702: | F:1 |
| 20703: | F:1 |
| 20704: | F:1 |
| 20705: | F:1 |
| 20706: | F:1 |
| 20707: | F:1 |
| 20708: | F:1 |
| 20709: | F:1 |
| 20710: | F:1 |
| 20711: | F:1 |
| 20712: | F:1 |
| 20713: | F:1 |
| 20714: | F:1 |
| 20715: | F:1 |
| 20716: | F:1 |
| 20717: | F:1 |
| 20718: | F:1 |
| 20719: | F:1 |
| 20720: | F:1 |
| 20721: | F:1 |
| 20722: | F:1 |
| 20723: | F:1 |
| 20724: | F:1 |
| 20725: | F:1 |
| 20726: | F:1 |
| 20727: | F:1 |
| 20728: | F:1 |
| 20729: | F:1 |
| 20730: | F:1 |
| 20731: | F:1 |
| 20732: | F:1 |
| 20733: | O:1 |
| 20734: | O:1 |
| 20735: | O:1 |
| 20736: | O:1 |
| 20737: | O:1 |
| 20738: | O:1 |
| 20739: | O:1 |
| 20740: | O:1 |
| 20741: | O:1 |
| 20742: | O:1 |
| 20743: | O:1 |
| 20744: | O:1 |
| 20745: | O:1 |
| 20746: | O:1 |
| 20747: | O:1 |
| 20748: | O:1 |
| 20749: | O:1 |
| 20750: | O:1 |
| 20751: | O:1 |
| 20752: | O:1 |
| 20753: | O:1 |
| 20754: | O:1 |
| 20755: | O:1 |

TABLE II-continued

| SEQ ID NO. | Spatial Distribution |
|---|---|
| 20756: | O:1 |
| 20757: | O:1 |
| 20758: | O:1 |
| 20759: | O:1 |
| 20760: | O:1 |
| 20761: | O:1 |
| 20762: | O:1 |
| 20763: | O:1 |
| 20764: | O:1 |
| 20765: | O:1 |
| 20766: | O:1 |
| 20767: | O:1 |
| 20768: | O:1 |
| 20769: | O:1 |
| 20770: | O:1 |
| 20771: | O:1 |
| 20772: | O:1 |
| 20773: | O:1 |
| 20774: | O:1 |
| 20775: | O:1 |
| 20776: | O:1 |
| 20777: | O:1 |
| 20778: | O:1 |
| 20779: | O:1 |
| 20780: | O:1 |
| 20781: | O:1 |
| 20782: | O:1 |
| 20783: | O:1 |
| 20784: | O:1 |
| 20785: | O:1 |
| 20786: | O:1 |
| 20787: | O:1 |
| 20788: | O:1 |
| 20789: | O:1 |
| 20790: | O:1 |
| 20791: | O:1 |
| 20792: | O:1 |
| 20793: | O:1 |
| 20794: | O:1 |
| 20795: | O:1 |
| 20796: | O:1 |
| 20797: | O:1 |
| 20798: | O:1 |
| 20799: | O:1 |
| 20800: | O:1 |
| 20801: | O:1 |
| 20802: | O:1 |
| 20803: | O:1 |
| 20804: | O:1 |
| 20805: | O:1 |
| 20806: | O:1 |
| 20807: | O:1 |
| 20808: | O:1 |
| 20809: | O:1 |
| 20810: | O:1 |
| 20811: | O:1 |
| 20812: | O:1 |
| 20813: | O:1 |
| 20814: | O:1 |
| 20815: | O:1 |
| 20816: | O:1 |
| 20817: | O:1 |
| 20818: | O:1 |
| 20819: | O:1 |
| 20820: | O:1 |
| 20821: | O:1 |
| 20822: | O:1 |
| 20823: | O:1 |
| 20824: | O:1 |
| 20825: | O:1 |
| 20826: | O:1 |
| 20827: | O:1 |
| 20828: | O:1 |
| 20829: | O:1 |
| 20830: | O:1 |
| 20831: | O:1 |
| 20832: | O:1 |
| 20833: | O:1 |
| 20834: | O:1 |
| 20835: | O:1 |
| 20836: | O:1 |
| 20837: | O:1 |
| 20838: | O:1 |
| 20839: | O:1 |
| 20840: | O:1 |
| 20841: | O:1 |
| 20842: | O:1 |
| 20843: | O:1 |
| 20844: | O:1 |
| 20845: | O:1 |
| 20846: | O:1 |
| 20847: | O:1 |
| 20848: | O:1 |
| 20849: | O:1 |
| 20850: | O:1 |
| 20851: | O:1 |
| 20852: | O:1 |
| 20853: | O:1 |
| 20854: | O:1 |
| 20855: | O:1 |
| 20856: | O:1 |
| 20857: | O:1 |
| 20858: | O:1 |
| 20859: | O:1 |
| 20860: | O:1 |
| 20861: | O:1 |
| 20862: | O:1 |
| 20863: | O:1 |
| 20864: | O:1 |
| 20865: | O:1 |
| 20866: | O:1 |
| 20867: | O:1 |
| 20868: | O:1 |
| 20869: | O:1 |
| 20870: | O:1 |
| 20871: | O:1 |
| 20872: | O:1 |
| 20873: | O:1 |
| 20874: | O:1 |
| 20875: | O:1 |
| 20876: | O:1 |
| 20877: | O:1 |
| 20878: | O:1 |
| 20879: | O:1 |
| 20880: | O:1 |
| 20881: | O:1 |
| 20882: | O:1 |
| 20883: | O:1 |
| 20884: | O:1 |
| 20885: | O:1 |
| 20886: | O:1 |
| 20887: | O:1 |
| 20888: | O:1 |
| 20889: | O:1 |
| 20890: | O:1 |
| 20891: | O:1 |
| 20892: | O:1 |
| 20893: | O:1 |
| 20894: | O:1 |
| 20895: | O:1 |
| 20896: | O:1 |
| 20897: | O:1 |
| 20898: | O:1 |
| 20899: | O:1 |
| 20900: | O:1 |
| 20901: | O:1 |
| 20902: | O:1 |
| 20903: | O:1 |
| 20904: | O:1 |
| 20905: | O:1 |
| 20906: | O:1 |
| 20907: | O:1 |
| 20908: | O:1 |
| 20909: | O:1 |

TABLE II-continued

| SEQ ID NO. | Spatial Distribution |
|---|---|
| 20910: | O:1 |
| 20911: | O:1 |
| 20912: | O:1 |
| 20913: | O:1 |
| 20914: | O:1 |
| 20915: | O:1 |
| 20916: | O:1 |
| 20917: | O:1 |
| 20918: | O:1 |
| 20919: | O:1 |
| 20920: | O:1 |
| 20921: | O:1 |
| 20922: | O:1 |
| 20923: | O:1 |
| 20924: | O:1 |
| 20925: | O:1 |
| 20926: | O:1 |
| 20927: | O:1 |
| 20928: | O:1 |
| 20929: | O:1 |
| 20930: | O:1 |
| 20931: | O:1 |
| 20932: | O:1 |
| 20933: | O:1 |
| 20934: | O:1 |
| 20935: | O:1 |
| 20936: | O:1 |
| 20937: | O:1 |
| 20938: | O:1 |
| 20939: | O:1 |
| 20940: | O:1 |
| 20941: | O:1 |
| 20942: | O:1 |
| 20943: | O:1 |
| 20944: | O:1 |
| 20945: | O:1 |
| 20946: | O:1 |
| 20947: | O:1 |
| 20948: | O:1 |
| 20949: | O:1 |
| 20950: | O:1 |
| 20951: | O:1 |
| 20952: | O:1 |
| 20953: | O:1 |
| 20954: | O:1 |
| 20955: | O:1 |
| 20956: | O:1 |
| 20957: | O:1 |
| 20958: | O:1 |
| 20959: | O:1 |
| 20960: | O:1 |
| 20961: | O:1 |
| 20962: | O:1 |
| 20963: | O:1 |
| 20964: | O:1 |
| 20965: | O:1 |
| 20966: | O:1 |
| 20967: | O:1 |
| 20968: | O:1 |
| 20969: | O:1 |
| 20970: | O:1 |
| 20971: | O:1 |
| 20972: | O:1 |
| 20973: | O:1 |
| 20974: | O:1 |
| 20975: | O:1 |
| 20976: | O:1 |
| 20977: | O:1 |
| 20978: | O:1 |
| 20979: | O:1 |
| 20980: | O:1 |
| 20981: | O:1 |
| 20982: | O:1 |
| 20983: | O:1 |
| 20984: | O:1 |
| 20985: | O:1 |
| 20986: | O:1 |
| 20987: | O:1 |
| 20988: | O:1 |
| 20989: | O:1 |
| 20990: | O:1 |
| 20991: | O:1 |
| 20992: | O:1 |
| 20993: | O:1 |
| 20994: | O:1 |
| 20995: | O:1 |
| 20996: | O:1 |
| 20997: | O:1 |
| 20998: | O:1 |
| 20999: | O:1 |
| 21000: | O:1 |
| 21001: | O:1 |
| 21002: | O:1 |
| 21003: | O:1 |
| 21004: | O:1 |
| 21005: | O:1 |
| 21006: | O:1 |
| 21007: | O:1 |
| 21008: | O:1 |
| 21009: | O:1 |
| 21010: | O:1 |
| 21011: | O:1 |
| 21012: | O:1 |
| 21013: | O:1 |
| 21014: | O:1 |
| 21015: | O:1 |
| 21016: | O:1 |
| 21017: | O:1 |
| 21018: | O:1 |
| 21019: | O:1 |
| 21020: | O:1 |
| 21021: | O:1 |
| 21022: | O:1 |
| 21023: | O:1 |
| 21024: | O:1 |
| 21025: | O:1 |
| 21026: | O:1 |
| 21027: | O:1 |
| 21028: | O:1 |
| 21029: | O:1 |
| 21030: | O:1 |
| 21031: | O:1 |
| 21032: | O:1 |
| 21033: | O:1 |
| 21034: | O:1 |
| 21035: | O:1 |
| 21036: | O:1 |
| 21037: | O:1 |
| 21038: | O:1 |
| 21039: | O:1 |
| 21040: | O:1 |
| 21041: | O:1 |
| 21042: | O:1 |
| 21043: | O:1 |
| 21044: | O:1 |
| 21045: | O:1 |
| 21046: | O:1 |
| 21047: | O:1 |
| 21048: | O:1 |
| 21049: | O:1 |
| 21050: | O:1 |
| 21051: | O:1 |
| 21052: | O:1 |
| 21053: | O:1 |
| 21054: | O:1 |
| 21055: | O:1 |
| 21056: | O:1 |
| 21057: | O:1 |
| 21058: | O:1 |
| 21059: | O:1 |
| 21060: | O:1 |
| 21061: | O:1 |
| 21062: | O:1 |
| 21063: | O:1 |

TABLE II-continued

| SEQ ID NO. | Spatial Distribution |
|---|---|
| 21064: | O:1 |
| 21065: | O:1 |
| 21066: | O:1 |
| 21067: | O:1 |
| 21068: | O:1 |
| 21069: | O:1 |
| 21070: | O:1 |
| 21071: | O:1 |
| 21072: | O:1 |
| 21073: | O:1 |
| 21074: | O:1 |
| 21075: | O:1 |
| 21076: | O:1 |
| 21077: | O:1 |
| 21078: | O:1 |
| 21079: | O:1 |
| 21080: | O:1 |
| 21081: | O:1 |
| 21082: | O:1 |
| 21083: | O:1 |
| 21084: | O:1 |
| 21085: | O:1 |
| 21086: | O:1 |
| 21087: | O:1 |
| 21088: | O:1 |
| 21089: | O:1 |
| 21090: | O:1 |
| 21091: | O:1 |
| 21092: | O:1 |
| 21093: | O:1 |
| 21094: | O:1 |
| 21095: | O:1 |
| 21096: | O:1 |
| 21097: | O:1 |
| 21098: | O:1 |
| 21099: | O:1 |
| 21100: | O:1 |
| 21101: | O:1 |
| 21102: | O:1 |
| 21103: | O:1 |
| 21104: | O:1 |
| 21105: | O:1 |
| 21106: | O:1 |
| 21107: | O:1 |
| 21108: | O:1 |
| 21109: | O:1 |
| 21110: | O:1 |
| 21111: | O:1 |
| 21112: | O:1 |
| 21113: | O:1 |
| 21114: | O:1 |
| 21115: | O:1 |
| 21116: | O:1 |
| 21117: | O:1 |
| 21118: | O:1 |
| 21119: | O:1 |
| 21120: | O:1 |
| 21121: | O:1 |
| 21122: | O:1 |
| 21123: | O:1 |
| 21124: | O:1 |
| 21125: | O:1 |
| 21126: | O:1 |
| 21127: | O:1 |
| 21128: | O:1 |
| 21129: | O:1 |
| 21130: | O:1 |
| 21131: | O:1 |
| 21132: | O:1 |
| 21133: | O:1 |
| 21134: | O:1 |
| 21135: | O:1 |
| 21136: | O:1 |
| 21137: | O:1 |
| 21138: | O:1 |
| 21139: | O:1 |
| 21140: | O:1 |
| 21141: | O:1 |
| 21142: | O:1 |
| 21143: | O:1 |
| 21144: | O:1 |
| 21145: | O:1 |
| 21146: | O:1 |
| 21147: | O:1 |
| 21148: | O:1 |
| 21149: | O:1 |
| 21150: | O:1 |
| 21151: | O:1 |
| 21152: | O:1 |
| 21153: | O:1 |
| 21154: | O:1 |
| 21155: | O:1 |
| 21156: | O:1 |
| 21157: | O:1 |
| 21158: | O:1 |
| 21159: | O:1 |
| 21160: | O:1 |
| 21161: | O:1 |
| 21162: | O:1 |
| 21163: | O:1 |
| 21164: | O:1 |
| 21165: | O:1 |
| 21166: | O:1 |
| 21167: | O:1 |
| 21168: | O:1 |
| 21169: | O:1 |
| 21170: | O:1 |
| 21171: | O:1 |
| 21172: | O:1 |
| 21173: | O:1 |
| 21174: | O:1 |
| 21175: | O:1 |
| 21176: | O:1 |
| 21177: | O:1 |
| 21178: | O:1 |
| 21179: | O:1 |
| 21180: | O:1 |
| 21181: | O:1 |
| 21182: | O:1 |
| 21183: | O:1 |
| 21184: | O:1 |
| 21185: | O:1 |
| 21186: | O:1 |
| 21187: | O:1 |
| 21188: | O:1 |
| 21189: | O:1 |
| 21190: | O:1 |
| 21191: | O:1 |
| 21192: | O:1 |
| 21193: | O:1 |
| 21194: | O:1 |
| 21195: | O:1 |
| 21196: | O:1 |
| 21197: | O:1 |
| 21198: | O:1 |
| 21199: | O:1 |
| 21200: | O:1 |
| 21201: | O:1 |
| 21202: | O:1 |
| 21203: | O:1 |
| 21204: | O:1 |
| 21205: | O:1 |
| 21206: | O:1 |
| 21207: | O:1 |
| 21208: | O:1 |
| 21209: | O:1 |
| 21210: | O:1 |
| 21211: | O:1 |
| 21212: | O:1 |
| 21213: | O:1 |
| 21214: | O:1 |
| 21215: | O:1 |
| 21216: | O:1 |
| 21217: | O:1 |

TABLE II-continued

| SEQ ID NO. | Spatial Distribution |
|---|---|
| 21218: | O:1 |
| 21219: | O:1 |
| 21220: | O:1 |
| 21221: | O:1 |
| 21222: | O:1 |
| 21223: | O:1 |
| 21224: | O:1 |
| 21225: | O:1 |
| 21226: | O:1 |
| 21227: | O:1 |
| 21228: | O:1 |
| 21229: | O:1 |
| 21230: | O:1 |
| 21231: | O:1 |
| 21232: | O:1 |
| 21233: | O:1 |
| 21234: | O:1 |
| 21235: | O:1 |
| 21236: | O:1 |
| 21237: | O:1 |
| 21238: | O:1 |
| 21239: | O:1 |
| 21240: | O:1 |
| 21241: | O:1 |
| 21242: | O:1 |
| 21243: | O:1 |
| 21244: | O:1 |
| 21245: | O:1 |
| 21246: | O:1 |
| 21247: | O:1 |
| 21248: | O:1 |
| 21249: | O:1 |
| 21250: | O:1 |
| 21251: | O:1 |
| 21252: | O:1 |
| 21253: | O:1 |
| 21254: | O:1 |
| 21255: | O:1 |
| 21256: | O:1 |
| 21257: | O:1 |
| 21258: | O:1 |
| 21259: | O:1 |
| 21260: | O:1 |
| 21261: | O:1 |
| 21262: | O:1 |
| 21263: | O:1 |
| 21264: | O:1 |
| 21265: | O:1 |
| 21266: | O:1 |
| 21267: | O:1 |
| 21268: | O:1 |
| 21269: | O:1 |
| 21270: | O:1 |
| 21271: | O:1 |
| 21272: | O:1 |
| 21273: | O:1 |
| 21274: | O:1 |
| 21275: | O:1 |
| 21276: | O:1 |
| 21277: | O:1 |
| 21278: | O:1 |
| 21279: | O:1 |
| 21280: | O:1 |
| 21281: | O:1 |
| 21282: | O:1 |
| 21283: | O:1 |
| 21284: | O:1 |
| 21285: | O:1 |
| 21286: | O:1 |
| 21287: | O:1 |
| 21288: | O:1 |
| 21289: | O:1 |
| 21290: | O:1 |
| 21291: | O:1 |
| 21292: | O:1 |
| 21293: | O:1 |
| 21294: | O:1 |
| 21295: | O:1 |
| 21296: | O:1 |
| 21297: | O:1 |
| 21298: | O:1 |
| 21299: | O:1 |
| 21300: | O:1 |
| 21301: | O:1 |
| 21302: | O:1 |
| 21303: | O:1 |
| 21304: | O:1 |
| 21305: | O:1 |
| 21306: | O:1 |
| 21307: | O:1 |
| 21308: | O:1 |
| 21309: | O:1 |
| 21310: | O:1 |
| 21311: | O:1 |
| 21312: | O:1 |
| 21313: | O:1 |
| 21314: | O:1 |
| 21315: | O:1 |
| 21316: | O:1 |
| 21317: | O:1 |
| 21318: | O:1 |
| 21319: | O:1 |
| 21320: | O:1 |
| 21321: | O:1 |
| 21322: | O:1 |
| 21323: | O:1 |
| 21324: | O:1 |
| 21325: | O:1 |
| 21326: | O:1 |
| 21327: | O:1 |
| 21328: | O:1 |
| 21329: | O:1 |
| 21330: | O:1 |
| 21331: | O:1 |
| 21332: | O:1 |
| 21333: | O:1 |
| 21334: | O:1 |
| 21335: | O:1 |
| 21336: | O:1 |
| 21337: | O:1 |
| 21338: | O:1 |
| 21339: | O:1 |
| 21340: | O:1 |
| 21341: | O:1 |
| 21342: | O:1 |
| 21343: | O:1 |
| 21344: | O:1 |
| 21345: | O:1 |
| 21346: | O:1 |
| 21347: | O:1 |
| 21348: | O:1 |
| 21349: | O:1 |
| 21350: | O:1 |
| 21351: | O:1 |
| 21352: | O:1 |
| 21353: | O:1 |
| 21354: | O:1 |
| 21355: | O:1 |
| 21356: | O:1 |
| 21357: | O:1 |
| 21358: | O:1 |
| 21359: | O:1 |
| 21360: | O:1 |
| 21361: | O:1 |
| 21362: | O:1 |
| 21363: | O:1 |
| 21364: | O:1 |
| 21365: | V:1 |
| 21366: | V:1 |
| 21367: | V:1 |
| 21368: | V:1 |
| 21369: | V:1 |
| 21370: | V:1 |
| 21371: | V:1 |

TABLE II-continued

| SEQ ID NO. | Spatial Distribution |
|---|---|
| 21372: | V:1 |
| 21373: | V:1 |
| 21374: | V:1 |
| 21375: | V:1 |
| 21376: | V:1 |
| 21377: | V:1 |
| 21378: | V:1 |
| 21379: | V:1 |
| 21380: | V:1 |
| 21381: | V:1 |
| 21382: | V:1 |
| 21383: | V:1 |
| 21384: | V:1 |
| 21385: | V:1 |
| 21386: | V:1 |
| 21387: | V:1 |
| 21388: | V:1 |
| 21389: | V:1 |
| 21390: | V:1 |
| 21391: | V:1 |
| 21392: | V:1 |
| 21393: | V:1 |
| 21394: | V:1 |
| 21395: | V:1 |
| 21396: | V:1 |
| 21397: | V:1 |
| 21398: | V:1 |
| 21399: | V:1 |
| 21400: | V:1 |
| 21401: | V:1 |
| 21402: | V:1 |
| 21403: | V:1 |
| 21404: | V:1 |
| 21405: | V:1 |
| 21406: | V:1 |
| 21407: | B:1 |
| 21408: | B:1 |
| 21409: | B:1 |
| 21410: | B:1 |
| 21411: | B:1 |
| 21412: | B:1 |
| 21413: | B:1 |
| 21414: | B:1 |
| 21415: | B:1 |
| 21416: | B:1 |
| 21417: | B:1 |
| 21418: | B:1 |
| 21419: | B:1 |
| 21420: | B:1 |
| 21421: | B:1 |
| 21422: | B:1 |
| 21423: | B:1 |
| 21424: | B:1 |
| 21425: | B:1 |
| 21426: | B:1 |
| 21427: | B:1 |
| 21428: | B:1 |
| 21429: | B:1 |
| 21430: | B:1 |
| 21431: | B:1 |
| 21432: | B:1 |
| 21433: | B:1 |
| 21434: | B:1 |
| 21435: | B:1 |
| 21436: | B:1 |
| 21437: | B:1 |
| 21438: | B:1 |
| 21439: | B:1 |
| 21440: | B:1 |
| 21441: | B:1 |
| 21442: | B:1 |
| 21443: | B:1 |
| 21444: | B:1 |
| 21445: | B:1 |
| 21446: | B:1 |
| 21447: | B:1 |
| 21448: | B:1 |
| 21449: | B:1 |
| 21450: | B:1 |
| 21451: | B:1 |
| 21452: | B:1 |
| 21453: | B:1 |
| 21454: | B:1 |
| 21455: | B:1 |
| 21456: | B:1 |
| 21457: | B:1 |
| 21458: | B:1 |
| 21459: | B:1 |
| 21460: | B:1 |
| 21461: | B:1 |
| 21462: | B:1 |
| 21463: | B:1 |
| 21464: | B:1 |
| 21465: | B:1 |
| 21466: | B:1 |
| 21467: | B:1 |
| 21468: | B:1 |
| 21469: | B:1 |
| 21470: | B:1 |
| 21471: | B:1 |
| 21472: | B:1 |
| 21473: | B:1 |
| 21474: | B:1 |
| 21475: | B:1 |
| 21476: | B:1 |
| 21477: | B:1 |
| 21478: | B:1 |
| 21479: | B:1 |
| 21480: | B:1 |
| 21481: | B:1 |
| 21482: | B:1 |
| 21483: | B:1 |
| 21484: | B:1 |
| 21485: | B:1 |
| 21486: | B:1 |
| 21487: | B:1 |
| 21488: | B:1 |
| 21489: | B:1 |
| 21490: | B:1 |
| 21491: | B:1 |
| 21492: | B:1 |
| 21493: | B:1 |
| 21494: | B:1 |
| 21495: | B:1 |
| 21496: | B:1 |
| 21497: | B:1 |
| 21498: | B:1 |
| 21499: | B:1 |
| 21500: | B:1 |
| 21501: | B:1 |
| 21502: | B:1 |
| 21503: | B:1 |
| 21504: | B:1 |
| 21505: | B:1 |
| 21506: | B:1 |
| 21507: | B:1 |
| 21508: | B:1 |
| 21509: | B:1 |
| 21510: | B:1 |
| 21511: | B:1 |
| 21512: | B:1 |
| 21513: | B:1 |
| 21514: | B:1 |
| 21515: | B:1 |
| 21516: | B:1 |
| 21517: | B:1 |
| 21518: | B:1 |
| 21519: | B:1 |
| 21520: | B:1 |
| 21521: | B:1 |
| 21522: | B:1 |
| 21523: | B:1 |
| 21524: | B:1 |
| 21525: | B:1 |

TABLE II-continued

| SEQ ID NO. | Spatial Distribution |
|---|---|
| 21526: | B:1 |
| 21527: | B:1 |
| 21528: | B:1 |
| 21529: | B:1 |
| 21530: | B:1 |
| 21531: | B:1 |
| 21532: | B:1 |
| 21533: | B:1 |
| 21534: | B:1 |
| 21535: | B:1 |
| 21536: | B:1 |
| 21537: | B:1 |
| 21538: | B:1 |
| 21539: | B:1 |
| 21540: | B:1 |
| 21541: | B:1 |
| 21542: | B:1 |
| 21543: | B:1 |
| 21544: | B:1 |
| 21545: | B:1 |
| 21546: | B:1 |
| 21547: | B:1 |
| 21548: | B:1 |
| 21549: | B:1 |
| 21550: | B:1 |
| 21551: | B:1 |
| 21552: | B:1 |
| 21553: | B:1 |
| 21554: | B:1 |
| 21555: | B:1 |
| 21556: | B:1 |
| 21557: | B:1 |
| 21558: | B:1 |
| 21559: | B:1 |
| 21560: | B:1 |
| 21561: | B:1 |
| 21562: | B:1 |
| 21563: | B:1 |
| 21564: | B:1 |
| 21565: | B:1 |
| 21566: | B:1 |
| 21567: | B:1 |
| 21568: | B:1 |
| 21569: | B:1 |
| 21570: | B:1 |
| 21571: | B:1 |
| 21572: | B:1 |
| 21573: | B:1 |
| 21574: | B:1 |
| 21575: | B:1 |
| 21576: | B:1 |
| 21577: | B:1 |
| 21578: | B:1 |
| 21579: | B:1 |
| 21580: | B:1 |
| 21581: | B:1 |
| 21582: | B:1 |
| 21583: | B:1 |
| 21584: | B:1 |
| 21585: | B:1 |
| 21586: | B:1 |
| 21587: | B:1 |
| 21588: | B:1 |
| 21589: | B:1 |
| 21590: | B:1 |
| 21591: | B:1 |
| 21592: | B:1 |
| 21593: | B:1 |
| 21594: | B:1 |
| 21595: | B:1 |
| 21596: | B:1 |
| 21597: | B:1 |
| 21598: | B:1 |
| 21599: | B:1 |
| 21600: | B:1 |
| 21601: | B:1 |
| 21602: | B:1 |
| 21603: | B:1 |
| 21604: | B:1 |
| 21605: | B:1 |
| 21606: | B:1 |
| 21607: | B:1 |
| 21608: | B:1 |
| 21609: | B:1 |
| 21610: | B:1 |
| 21611: | B:1 |
| 21612: | B:1 |
| 21613: | B:1 |
| 21614: | B:1 |
| 21615: | B:1 |
| 21616: | B:1 |
| 21617: | B:1 |
| 21618: | B:1 |
| 21619: | B:1 |
| 21620: | B:1 |
| 21621: | B:1 |
| 21622: | B:1 |
| 21623: | B:1 |
| 21624: | B:1 |
| 21625: | B:1 |
| 21626: | B:1 |
| 21627: | B:1 |
| 21628: | B:1 |
| 21629: | B:1 |
| 21630: | B:1 |
| 21631: | B:1 |
| 21632: | B:1 |
| 21633: | B:1 |
| 21634: | B:1 |
| 21635: | B:1 |
| 21636: | B:1 |
| 21637: | B:1 |
| 21638: | B:1 |
| 21639: | B:1 |
| 21640: | B:1 |
| 21641: | B:1 |
| 21642: | B:1 |
| 21643: | B:1 |
| 21644: | B:1 |
| 21645: | B:1 |
| 21646: | B:1 |
| 21647: | B:1 |
| 21648: | B:1 |
| 21649: | B:1 |
| 21650: | B:1 |
| 21651: | B:1 |
| 21652: | B:1 |
| 21653: | B:1 |
| 21654: | B:1 |
| 21655: | B:1 |
| 21656: | B:1 |
| 21657: | B:1 |
| 21658: | B:1 |
| 21659: | B:1 |
| 21660: | B:1 |
| 21661: | B:1 |
| 21662: | B:1 |
| 21663: | B:1 |
| 21664: | B:1 |
| 21665: | B:1 |
| 21666: | B:1 |
| 21667: | B:1 |
| 21668: | B:1 |
| 21669: | B:1 |
| 21670: | B:1 |
| 21671: | B:1 |
| 21672: | B:1 |
| 21673: | B:1 |
| 21674: | B:1 |
| 21675: | B:1 |
| 21676: | B:1 |
| 21677: | B:1 |
| 21678: | B:1 |
| 21679: | B:1 |

TABLE II-continued

| SEQ ID NO. | Spatial Distribution |
|---|---|
| 21680: | B:1 |
| 21681: | B:1 |
| 21682: | B:1 |
| 21683: | B:1 |
| 21684: | B:1 |
| 21685: | B:1 |
| 21686: | B:1 |
| 21687: | B:1 |
| 21688: | B:1 |
| 21689: | B:1 |
| 21690: | B:1 |
| 21691: | B:1 |
| 21692: | B:1 |
| 21693: | B:1 |
| 21694: | B:1 |
| 21695: | B:1 |
| 21696: | B:1 |
| 21697: | B:1 |
| 21698: | B:1 |
| 21699: | B:1 |
| 21700: | B:1 |
| 21701: | B:1 |
| 21702: | B:1 |
| 21703: | B:1 |
| 21704: | B:1 |
| 21705: | B:1 |
| 21706: | B:1 |
| 21707: | B:1 |
| 21708: | B:1 |
| 21709: | B:1 |
| 21710: | B:1 |
| 21711: | B:1 |
| 21712: | B:1 |
| 21713: | B:1 |
| 21714: | B:1 |
| 21715: | B:1 |
| 21716: | B:1 |
| 21717: | B:1 |
| 21718: | B:1 |
| 21719: | B:1 |
| 21720: | B:1 |
| 21721: | B:1 |
| 21722: | B:1 |
| 21723: | B:1 |
| 21724: | B:1 |
| 21725: | B:1 |
| 21726: | B:1 |
| 21727: | B:1 |
| 21728: | B:1 |
| 21729: | B:1 |
| 21730: | B:1 |
| 21731: | B:1 |
| 21732: | B:1 |
| 21733: | B:1 |
| 21734: | B:1 |
| 21735: | B:1 |
| 21736: | B:1 |
| 21737: | B:1 |
| 21738: | B:1 |
| 21739: | B:1 |
| 21740: | B:1 |
| 21741: | B:1 |
| 21742: | B:1 |
| 21743: | B:1 |
| 21744: | B:1 |
| 21745: | B:1 |
| 21746: | B:1 |
| 21747: | B:1 |
| 21748: | B:1 |
| 21749: | B:1 |
| 21750: | B:1 |
| 21751: | B:1 |
| 21752: | B:1 |
| 21753: | B:1 |
| 21754: | B:1 |
| 21755: | B:1 |
| 21756: | B:1 |
| 21757: | B:1 |
| 21758: | B:1 |
| 21759: | B:1 |
| 21760: | B:1 |
| 21761: | B:1 |
| 21762: | B:1 |
| 21763: | B:1 |
| 21764: | B:1 |
| 21765: | B:1 |
| 21766: | B:1 |
| 21767: | B:1 |
| 21768: | B:1 |
| 21769: | B:1 |
| 21770: | B:1 |
| 21771: | B:1 |
| 21772: | B:1 |
| 21773: | B:1 |
| 21774: | B:1 |
| 21775: | B:1 |
| 21776: | B:1 |
| 21777: | B:1 |
| 21778: | B:1 |
| 21779: | B:1 |
| 21780: | B:1 |
| 21781: | B:1 |
| 21782: | B:1 |
| 21783: | B:1 |
| 21784: | B:1 |
| 21785: | B:1 |
| 21786: | B:1 |
| 21787: | B:1 |
| 21788: | B:1 |
| 21789: | B:1 |
| 21790: | B:1 |
| 21791: | B:1 |
| 21792: | B:1 |
| 21793: | B:1 |
| 21794: | B:1 |
| 21795: | B:1 |
| 21796: | B:1 |
| 21797: | B:1 |
| 21798: | B:1 |
| 21799: | B:1 |
| 21800: | B:1 |
| 21801: | B:1 |
| 21802: | B:1 |
| 21803: | B:1 |
| 21804: | B:1 |
| 21805: | B:1 |
| 21806: | B:1 |
| 21807: | B:1 |
| 21808: | B:1 |
| 21809: | B:1 |
| 21810: | B:1 |
| 21811: | B:1 |
| 21812: | B:1 |
| 21813: | B:1 |
| 21814: | B:1 |
| 21815: | B:1 |
| 21816: | B:1 |
| 21817: | B:1 |
| 21818: | B:1 |
| 21819: | B:1 |
| 21820: | B:1 |
| 21821: | B:1 |
| 21822: | B:1 |
| 21823: | B:1 |
| 21824: | B:1 |
| 21825: | B:1 |
| 21826: | B:1 |
| 21827: | B:1 |
| 21828: | B:1 |
| 21829: | B:1 |
| 21830: | B:1 |
| 21831: | B:1 |
| 21832: | B:1 |
| 21833: | B:1 |

TABLE II-continued

| SEQ ID NO. | Spatial Distribution |
|---|---|
| 21834: | B:1 |
| 21835: | B:1 |
| 21836: | B:1 |
| 21837: | B:1 |
| 21838: | B:1 |
| 21839: | B:1 |
| 21840: | B:1 |
| 21841: | B:1 |
| 21842: | B:1 |
| 21843: | B:1 |
| 21844: | B:1 |
| 21845: | B:1 |
| 21846: | B:1 |
| 21847: | B:1 |
| 21848: | B:1 |
| 21849: | B:1 |
| 21850: | B:1 |
| 21851: | B:1 |
| 21852: | B:1 |
| 21853: | B:1 |
| 21854: | B:1 |
| 21855: | B:1 |
| 21856: | B:1 |
| 21857: | B:1 |
| 21858: | B:1 |
| 21859: | B:1 |
| 21860: | B:1 |
| 21861: | B:1 |
| 21862: | B:1 |
| 21863: | B:1 |
| 21864: | B:1 |
| 21865: | B:1 |
| 21866: | B:1 |
| 21867: | B:1 |
| 21868: | B:1 |
| 21869: | B:1 |
| 21870: | B:1 |
| 21871: | B:1 |
| 21872: | B:1 |
| 21873: | B:1 |
| 21874: | B:1 |
| 21875: | B:1 |
| 21876: | B:1 |
| 21877: | B:1 |
| 21878: | B:1 |
| 21879: | B:1 |
| 21880: | B:1 |
| 21881: | B:1 |
| 21882: | B:1 |
| 21883: | B:1 |
| 21884: | B:1 |
| 21885: | B:1 |
| 21886: | B:1 |
| 21887: | B:1 |
| 21888: | B:1 |
| 21889: | B:1 |
| 21890: | B:1 |
| 21891: | B:1 |
| 21892: | B:1 |
| 21893: | B:1 |
| 21894: | B:1 |
| 21895: | B:1 |
| 21896: | B:1 |
| 21897: | B:1 |
| 21898: | B:1 |
| 21899: | B:1 |
| 21900: | B:1 |
| 21901: | B:1 |
| 21902: | B:1 |
| 21903: | B:1 |
| 21904: | B:1 |
| 21905: | B:1 |
| 21906: | B:1 |
| 21907: | B:1 |
| 21908: | B:1 |
| 21909: | B:1 |
| 21910: | B:1 |
| 21911: | B:1 |
| 21912: | B:1 |
| 21913: | B:1 |
| 21914: | B:1 |
| 21915: | B:1 |
| 21916: | B:1 |
| 21917: | B:1 |
| 21918: | B:1 |
| 21919: | B:1 |
| 21920: | B:1 |
| 21921: | B:1 |
| 21922: | B:1 |
| 21923: | B:1 |
| 21924: | B:1 |
| 21925: | B:1 |
| 21926: | B:1 |
| 21927: | B:1 |
| 21928: | B:1 |
| 21929: | B:1 |
| 21930: | B:1 |
| 21931: | B:1 |
| 21932: | B:1 |
| 21933: | B:1 |
| 21934: | B:1 |
| 21935: | B:1 |
| 21936: | B:1 |
| 21937: | B:1 |
| 21938: | B:1 |
| 21939: | B:1 |
| 21940: | B:1 |
| 21941: | B:1 |
| 21942: | B:1 |
| 21943: | B:1 |
| 21944: | B:1 |
| 21945: | B:1 |
| 21946: | B:1 |
| 21947: | B:1 |
| 21948: | B:1 |
| 21949: | B:1 |
| 21950: | B:1 |
| 21951: | B:1 |
| 21952: | B:1 |
| 21953: | B:1 |
| 21954: | B:1 |
| 21955: | B:1 |
| 21956: | B:1 |
| 21957: | B:1 |
| 21958: | B:1 |
| 21959: | B:1 |
| 21960: | B:1 |
| 21961: | B:1 |
| 21962: | B:1 |
| 21963: | B:1 |
| 21964: | B:1 |
| 21965: | B:1 |
| 21966: | B:1 |
| 21967: | B:1 |
| 21968: | B:1 |
| 21969: | B:1 |
| 21970: | B:1 |
| 21971: | B:1 |
| 21972: | B:1 |
| 21973: | B:1 |
| 21974: | B:1 |
| 21975: | B:1 |
| 21976: | B:1 |
| 21977: | B:1 |
| 21978: | B:1 |
| 21979: | B:1 |
| 21980: | B:1 |
| 21981: | B:1 |
| 21982: | B:1 |
| 21983: | B:1 |
| 21984: | B:1 |
| 21985: | B:1 |
| 21986: | B:1 |
| 21987: | B:1 |

TABLE II-continued

| SEQ ID NO. | Spatial Distribution |
|---|---|
| 21988: | B:1 |
| 21989: | B:1 |
| 21990: | B:1 |
| 21991: | B:1 |
| 21992: | B:1 |
| 21993: | B:1 |
| 21994: | B:1 |
| 21995: | B:1 |
| 21996: | B:1 |
| 21997: | B:1 |
| 21998: | B:1 |
| 21999: | B:1 |
| 22000: | B:1 |
| 22001: | B:1 |
| 22002: | B:1 |
| 22003: | B:1 |
| 22004: | B:1 |
| 22005: | B:1 |
| 22006: | B:1 |
| 22007: | B:1 |
| 22008: | B:1 |
| 22009: | B:1 |
| 22010: | B:1 |
| 22011: | B:1 |
| 22012: | B:1 |
| 22013: | B:1 |
| 22014: | B:1 |
| 22015: | B:1 |
| 22016: | B:1 |
| 22017: | B:1 |
| 22018: | B:1 |
| 22019: | B:1 |
| 22020: | B:1 |
| 22021: | B:1 |
| 22022: | B:1 |
| 22023: | B:1 |
| 22024: | B:1 |
| 22025: | B:1 |
| 22026: | B:1 |
| 22027: | B:1 |
| 22028: | B:1 |
| 22029: | B:1 |
| 22030: | B:1 |
| 22031: | B:1 |
| 22032: | B:1 |
| 22033: | B:1 |
| 22034: | B:1 |
| 22035: | B:1 |
| 22036: | B:1 |
| 22037: | B:1 |
| 22038: | B:1 |
| 22039: | B:1 |
| 22040: | B:1 |
| 22041: | B:1 |
| 22042: | B:1 |
| 22043: | B:1 |
| 22044: | B:1 |
| 22045: | B:1 |
| 22046: | B:1 |
| 22047: | B:1 |
| 22048: | B:1 |
| 22049: | B:1 |
| 22050: | B:1 |
| 22051: | B:1 |
| 22052: | B:1 |
| 22053: | B:1 |
| 22054: | B:1 |
| 22055: | B:1 |
| 22056: | B:1 |
| 22057: | B:1 |
| 22058: | B:1 |
| 22059: | B:1 |
| 22060: | B:1 |
| 22061: | B:1 |
| 22062: | B:1 |
| 22063: | B:1 |
| 22064: | B:1 |
| 22065: | B:1 |
| 22066: | B:1 |
| 22067: | B:1 |
| 22068: | B:1 |
| 22069: | B:1 |
| 22070: | B:1 |
| 22071: | B:1 |
| 22072: | B:1 |
| 22073: | B:1 |
| 22074: | B:1 |
| 22075: | B:1 |
| 22076: | B:1 |
| 22077: | B:1 |
| 22078: | B:1 |
| 22079: | B:1 |
| 22080: | B:1 |
| 22081: | B:1 |
| 22082: | B:1 |
| 22083: | B:1 |
| 22084: | B:1 |
| 22085: | B:1 |
| 22086: | B:1 |
| 22087: | B:1 |
| 22088: | B:1 |
| 22089: | B:1 |
| 22090: | B:1 |
| 22091: | B:1 |
| 22092: | B:1 |
| 22093: | B:1 |
| 22094: | B:1 |
| 22095: | B:1 |
| 22096: | B:1 |
| 22097: | B:1 |
| 22098: | B:1 |
| 22099: | B:1 |
| 22100: | B:1 |
| 22101: | B:1 |
| 22102: | B:1 |
| 22103: | B:1 |
| 22104: | B:1 |
| 22105: | B:1 |
| 22106: | B:1 |
| 22107: | B:1 |
| 22108: | B:1 |
| 22109: | B:1 |
| 22110: | B:1 |
| 22111: | B:1 |
| 22112: | B:1 |
| 22113: | B:1 |
| 22114: | B:1 |
| 22115: | B:1 |
| 22116: | B:1 |
| 22117: | B:1 |
| 22118: | B:1 |
| 22119: | B:1 |
| 22120: | B:1 |
| 22121: | B:1 |
| 22122: | B:1 |
| 22123: | B:1 |
| 22124: | B:1 |
| 22125: | B:1 |
| 22126: | B:1 |
| 22127: | B:1 |
| 22128: | B:1 |
| 22129: | B:1 |
| 22130: | B:1 |
| 22131: | B:1 |
| 22132: | B:1 |
| 22133: | B:1 |
| 22134: | B:1 |
| 22135: | B:1 |
| 22136: | B:1 |
| 22137: | B:1 |
| 22138: | B:1 |
| 22139: | B:1 |
| 22140: | B:1 |
| 22141: | B:1 |

TABLE II-continued

| SEQ ID NO. | Spatial Distribution |
|---|---|
| 22142: | B:1 |
| 22143: | B:1 |
| 22144: | B:1 |
| 22145: | B:1 |
| 22146: | B:1 |
| 22147: | B:1 |
| 22148: | B:1 |
| 22149: | B:1 |
| 22150: | B:1 |
| 22151: | B:1 |
| 22152: | B:1 |
| 22153: | B:1 |
| 22154: | B:1 |
| 22155: | B:1 |
| 22156: | B:1 |
| 22157: | B:1 |
| 22158: | B:1 |
| 22159: | B:1 |
| 22160: | B:1 |
| 22161: | B:1 |
| 22162: | B:1 |
| 22163: | B:1 |
| 22164: | B:1 |
| 22165: | B:1 |
| 22166: | B:1 |
| 22167: | B:1 |
| 22168: | B:1 |
| 22169: | B:1 |
| 22170: | B:1 |
| 22171: | B:1 |
| 22172: | B:1 |
| 22173: | B:1 |
| 22174: | B:1 |
| 22175: | B:1 |
| 22176: | B:1 |
| 22177: | B:1 |
| 22178: | B:1 |
| 22179: | B:1 |
| 22180: | B:1 |
| 22181: | B:1 |
| 22182: | B:1 |
| 22183: | B:1 |
| 22184: | B:1 |
| 22185: | B:1 |
| 22186: | B:1 |
| 22187: | B:1 |
| 22188: | B:1 |
| 22189: | B:1 |
| 22190: | B:1 |
| 22191: | B:1 |
| 22192: | B:1 |
| 22193: | B:1 |
| 22194: | B:1 |
| 22195: | B:1 |
| 22196: | B:1 |
| 22197: | B:1 |
| 22198: | B:1 |
| 22199: | B:1 |
| 22200: | B:1 |
| 22201: | B:1 |
| 22202: | B:1 |
| 22203: | B:1 |
| 22204: | B:1 |
| 22205: | B:1 |
| 22206: | B:1 |
| 22207: | B:1 |
| 22208: | B:1 |
| 22209: | B:1 |
| 22210: | B:1 |
| 22211: | B:1 |
| 22212: | B:1 |
| 22213: | B:1 |
| 22214: | B:1 |
| 22215: | B:1 |
| 22216: | B:1 |
| 22217: | B:1 |
| 22218: | B:1 |
| 22219: | B:1 |
| 22220: | B:1 |
| 22221: | B:1 |
| 22222: | B:1 |
| 22223: | B:1 |
| 22224: | B:1 |
| 22225: | B:1 |
| 22226: | B:1 |
| 22227: | B:1 |
| 22228: | B:1 |
| 22229: | B:1 |
| 22230: | B:1 |
| 22231: | B:1 |
| 22232: | B:1 |
| 22233: | B:1 |
| 22234: | B:1 |
| 22235: | B:1 |
| 22236: | B:1 |
| 22237: | B:1 |
| 22238: | B:1 |
| 22239: | B:1 |
| 22240: | B:1 |
| 22241: | B:1 |
| 22242: | B:1 |
| 22243: | B:1 |
| 22244: | B:1 |
| 22245: | B:1 |
| 22246: | B:1 |
| 22247: | B:1 |
| 22248: | B:1 |
| 22249: | B:1 |
| 22250: | B:1 |
| 22251: | B:1 |
| 22252: | B:1 |
| 22253: | B:1 |
| 22254: | B:1 |
| 22255: | B:1 |
| 22256: | B:1 |
| 22257: | B:1 |
| 22258: | B:1 |
| 22259: | B:1 |
| 22260: | B:1 |
| 22261: | B:1 |
| 22262: | B:1 |
| 22263: | B:1 |
| 22264: | B:1 |
| 22265: | B:1 |
| 22266: | B:1 |
| 22267: | B:1 |
| 22268: | B:1 |
| 22269: | B:1 |
| 22270: | B:1 |
| 22271: | B:1 |
| 22272: | B:1 |
| 22273: | B:1 |
| 22274: | B:1 |
| 22275: | B:1 |
| 22276: | B:1 |
| 22277: | B:1 |
| 22278: | B:1 |
| 22279: | B:1 |
| 22280: | B:1 |
| 22281: | B:1 |
| 22282: | B:1 |
| 22283: | B:1 |
| 22284: | B:1 |
| 22285: | B:1 |
| 22286: | B:1 |
| 22287: | B:1 |
| 22288: | B:1 |
| 22289: | B:1 |
| 22290: | B:1 |
| 22291: | B:1 |
| 22292: | B:1 |
| 22293: | B:1 |
| 22294: | B:1 |
| 22295: | B:1 |

TABLE II-continued

| SEQ ID NO. | Spatial Distribution |
|---|---|
| 22296: | B:1 |
| 22297: | B:1 |
| 22298: | B:1 |
| 22299: | B:1 |
| 22300: | B:1 |
| 22301: | B:1 |
| 22302: | B:1 |
| 22303: | B:1 |
| 22304: | B:1 |
| 22305: | B:1 |
| 22306: | B:1 |
| 22307: | B:1 |
| 22308: | B:1 |
| 22309: | B:1 |
| 22310: | B:1 |
| 22311: | B:1 |
| 22312: | B:1 |
| 22313: | B:1 |
| 22314: | B:1 |
| 22315: | B:1 |
| 22316: | B:1 |
| 22317: | B:1 |
| 22318: | B:1 |
| 22319: | B:1 |
| 22320: | B:1 |
| 22321: | B:1 |
| 22322: | B:1 |
| 22323: | B:1 |
| 22324: | B:1 |
| 22325: | B:1 |
| 22326: | B:1 |
| 22327: | B:1 |
| 22328: | B:1 |
| 22329: | B:1 |
| 22330: | B:1 |
| 22331: | B:1 |
| 22332: | B:1 |
| 22333: | B:1 |
| 22334: | B:1 |
| 22335: | B:1 |
| 22336: | B:1 |
| 22337: | B:1 |
| 22338: | B:1 |
| 22339: | B:1 |
| 22340: | B:1 |
| 22341: | B:1 |
| 22342: | B:1 |
| 22343: | B:1 |
| 22344: | B:1 |
| 22345: | B:1 |
| 22346: | B:1 |
| 22347: | B:1 |
| 22348: | B:1 |
| 22349: | B:1 |
| 22350: | B:1 |
| 22351: | B:1 |
| 22352: | B:1 |
| 22353: | B:1 |
| 22354: | B:1 |
| 22355: | B:1 |
| 22356: | B:1 |
| 22357: | B:1 |
| 22358: | B:1 |
| 22359: | B:1 |
| 22360: | B:1 |
| 22361: | B:1 |
| 22362: | B:1 |
| 22363: | B:1 |
| 22364: | B:1 |
| 22365: | B:1 |
| 22366: | B:1 |
| 22367: | B:1 |
| 22368: | B:1 |
| 22369: | B:1 |
| 22370: | B:1 |
| 22371: | B:1 |
| 22372: | B:1 |
| 22373: | B:1 |
| 22374: | B:1 |
| 22375: | B:1 |
| 22376: | B:1 |
| 22377: | B:1 |
| 22378: | B:1 |
| 22379: | B:1 |
| 22380: | B:1 |
| 22381: | B:1 |
| 22382: | B:1 |
| 22383: | B:1 |
| 22384: | B:1 |
| 22385: | B:1 |
| 22386: | B:1 |
| 22387: | B:1 |
| 22388: | B:1 |
| 22389: | B:1 |
| 22390: | B:1 |
| 22391: | B:1 |
| 22392: | B:1 |
| 22393: | B:1 |
| 22394: | B:1 |
| 22395: | B:1 |
| 22396: | B:1 |
| 22397: | B:1 |
| 22398: | B:1 |
| 22399: | B:1 |
| 22400: | B:1 |
| 22401: | B:1 |
| 22402: | B:1 |
| 22403: | B:1 |
| 22404: | B:1 |
| 22405: | B:1 |
| 22406: | B:1 |
| 22407: | B:1 |
| 22408: | B:1 |
| 22409: | B:1 |
| 22410: | B:1 |
| 22411: | B:1 |
| 22412: | B:1 |
| 22413: | B:1 |
| 22414: | B:1 |
| 22415: | B:1 |
| 22416: | B:1 |
| 22417: | B:1 |
| 22418: | B:1 |
| 22419: | B:1 |
| 22420: | B:1 |
| 22421: | B:1 |
| 22422: | B:1 |
| 22423: | B:1 |
| 22424: | B:1 |
| 22425: | B:1 |
| 22426: | B:1 |
| 22427: | B:1 |
| 22428: | B:1 |
| 22429: | B:1 |
| 22430: | B:1 |
| 22431: | B:1 |
| 22432: | B:1 |
| 22433: | B:1 |
| 22434: | B:1 |
| 22435: | B:1 |
| 22436: | B:1 |
| 22437: | B:1 |
| 22438: | B:1 |
| 22439: | B:1 |
| 22440: | B:1 |
| 22441: | B:1 |
| 22442: | B:1 |
| 22443: | B:1 |
| 22444: | B:1 |
| 22445: | B:1 |
| 22446: | B:1 |
| 22447: | B:1 |
| 22448: | B:1 |
| 22449: | B:1 |

TABLE II-continued

| SEQ ID NO. | Spatial Distribution |
|---|---|
| 22450: | B:1 |
| 22451: | B:1 |
| 22452: | B:1 |
| 22453: | B:1 |
| 22454: | B:1 |
| 22455: | B:1 |
| 22456: | B:1 |
| 22457: | B:1 |
| 22458: | B:1 |
| 22459: | B:1 |
| 22460: | B:1 |
| 22461: | B:1 |
| 22462: | B:1 |
| 22463: | B:1 |
| 22464: | B:1 |
| 22465: | B:1 |
| 22466: | B:1 |
| 22467: | B:1 |
| 22468: | B:1 |
| 22469: | B:1 |
| 22470: | B:1 |
| 22471: | B:1 |
| 22472: | B:1 |
| 22473: | B:1 |
| 22474: | B:1 |
| 22475: | B:1 |
| 22476: | B:1 |
| 22477: | B:1 |
| 22478: | B:1 |
| 22479: | B:1 |
| 22480: | B:1 |
| 22481: | B:1 |
| 22482: | B:1 |
| 22483: | B:1 |
| 22484: | B:1 |
| 22485: | B:1 |
| 22486: | B:1 |
| 22487: | B:1 |
| 22488: | B:1 |
| 22489: | B:1 |
| 22490: | B:1 |
| 22491: | B:1 |
| 22492: | B:1 |
| 22493: | B:1 |
| 22494: | B:1 |
| 22495: | B:1 |
| 22496: | B:1 |
| 22497: | B:1 |
| 22498: | B:1 |
| 22499: | B:1 |
| 22500: | B:1 |
| 22501: | B:1 |
| 22502: | B:1 |
| 22503: | B:1 |
| 22504: | B:1 |
| 22505: | B:1 |
| 22506: | B:1 |
| 22507: | B:1 |
| 22508: | B:1 |
| 22509: | B:1 |
| 22510: | B:1 |
| 22511: | B:1 |
| 22512: | B:1 |
| 22513: | B:1 |
| 22514: | B:1 |
| 22515: | B:1 |
| 22516: | B:1 |
| 22517: | B:1 |
| 22518: | B:1 |
| 22519: | B:1 |
| 22520: | B:1 |
| 22521: | B:1 |
| 22522: | B:1 |
| 22523: | B:1 |
| 22524: | B:1 |
| 22525: | B:1 |
| 22526: | B:1 |
| 22527: | B:1 |
| 22528: | B:1 |
| 22529: | B:1 |
| 22530: | B:1 |
| 22531: | B:1 |
| 22532: | B:1 |
| 22533: | B:1 |
| 22534: | B:1 |
| 22535: | B:1 |
| 22536: | B:1 |
| 22537: | B:1 |
| 22538: | B:1 |
| 22539: | B:1 |
| 22540: | B:1 |
| 22541: | B:1 |
| 22542: | B:1 |
| 22543: | B:1 |
| 22544: | B:1 |
| 22545: | B:1 |
| 22546: | B:1 |
| 22547: | B:1 |
| 22548: | B:1 |
| 22549: | B:1 |
| 22550: | B:1 |
| 22551: | B:1 |
| 22552: | B:1 |
| 22553: | B:1 |
| 22554: | B:1 |
| 22555: | B:1 |
| 22556: | B:1 |
| 22557: | B:1 |
| 22558: | B:1 |
| 22559: | B:1 |
| 22560: | B:1 |
| 22561: | B:1 |
| 22562: | B:1 |
| 22563: | B:1 |
| 22564: | B:1 |
| 22565: | B:1 |
| 22566: | B:1 |
| 22567: | B:1 |
| 22568: | B:1 |
| 22569: | B:1 |
| 22570: | B:1 |
| 22571: | B:1 |
| 22572: | B:1 |
| 22573: | B:1 |
| 22574: | B:1 |
| 22575: | B:1 |
| 22576: | B:1 |
| 22577: | B:1 |
| 22578: | B:1 |
| 22579: | B:1 |
| 22580: | B:1 |
| 22581: | B:1 |
| 22582: | B:1 |
| 22583: | B:1 |
| 22584: | B:1 |
| 22585: | B:1 |
| 22586: | B:1 |
| 22587: | B:1 |
| 22588: | B:1 |
| 22589: | B:1 |
| 22590: | B:1 |
| 22591: | B:1 |
| 22592: | B:1 |
| 22593: | B:1 |
| 22594: | B:1 |
| 22595: | B:1 |
| 22596: | B:1 |
| 22597: | B:1 |
| 22598: | B:1 |
| 22599: | B:1 |
| 22600: | B:1 |
| 22601: | B:1 |
| 22602: | B:1 |
| 22603: | B:1 |

TABLE II-continued

| SEQ ID NO. | Spatial Distribution |
|---|---|
| 22604: | B:1 |
| 22605: | B:1 |
| 22606: | B:1 |
| 22607: | B:1 |
| 22608: | B:1 |
| 22609: | B:1 |
| 22610: | B:1 |
| 22611: | B:1 |
| 22612: | B:1 |
| 22613: | B:1 |
| 22614: | B:1 |
| 22615: | B:1 |
| 22616: | B:1 |
| 22617: | B:1 |
| 22618: | B:1 |
| 22619: | B:1 |
| 22620: | B:1 |
| 22621: | B:1 |
| 22622: | B:1 |
| 22623: | B:1 |
| 22624: | B:1 |
| 22625: | B:1 |
| 22626: | B:1 |
| 22627: | B:1 |
| 22628: | B:1 |
| 22629: | B:1 |
| 22630: | B:1 |
| 22631: | B:1 |
| 22632: | B:1 |
| 22633: | B:1 |
| 22634: | B:1 |
| 22635: | B:1 |
| 22636: | B:1 |
| 22637: | B:1 |
| 22638: | B:1 |
| 22639: | B:1 |
| 22640: | B:1 |
| 22641: | B:1 |
| 22642: | B:1 |
| 22643: | B:1 |
| 22644: | B:1 |
| 22645: | B:1 |
| 22646: | B:1 |
| 22647: | B:1 |
| 22648: | B:1 |
| 22649: | B:1 |
| 22650: | B:1 |
| 22651: | B:1 |
| 22652: | B:1 |
| 22653: | B:1 |
| 22654: | B:1 |
| 22655: | B:1 |
| 22656: | B:1 |
| 22657: | B:1 |
| 22658: | B:1 |
| 22659: | B:1 |
| 22660: | B:1 |
| 22661: | B:1 |
| 22662: | B:1 |
| 22663: | B:1 |
| 22664: | B:1 |
| 22665: | B:1 |
| 22666: | B:1 |
| 22667: | B:1 |
| 22668: | B:1 |
| 22669: | B:1 |
| 22670: | B:1 |
| 22671: | B:1 |
| 22672: | B:1 |
| 22673: | B:1 |
| 22674: | B:1 |
| 22675: | B:1 |
| 22676: | B:1 |
| 22677: | B:1 |
| 22678: | B:1 |
| 22679: | B:1 |
| 22680: | B:1 |
| 22681: | B:1 |
| 22682: | B:1 |
| 22683: | B:1 |
| 22684: | B:1 |
| 22685: | B:1 |
| 22686: | B:1 |
| 22687: | B:1 |
| 22688: | B:1 |
| 22689: | B:1 |
| 22690: | B:1 |
| 22691: | B:1 |
| 22692: | B:1 |
| 22693: | B:1 |
| 22694: | B:1 |
| 22695: | B:1 |
| 22696: | B:1 |
| 22697: | B:1 |
| 22698: | B:1 |
| 22699: | B:1 |
| 22700: | B:1 |
| 22701: | B:1 |
| 22702: | B:1 |
| 22703: | B:1 |
| 22704: | B:1 |
| 22705: | B:1 |
| 22706: | B:1 |
| 22707: | B:1 |
| 22708: | B:1 |
| 22709: | B:1 |
| 22710: | B:1 |
| 22711: | B:1 |
| 22712: | B:1 |
| 22713: | B:1 |
| 22714: | B:1 |
| 22715: | B:1 |
| 22716: | B:1 |
| 22717: | B:1 |
| 22718: | B:1 |
| 22719: | B:1 |
| 22720: | B:1 |
| 22721: | B:1 |
| 22722: | B:1 |
| 22723: | B:1 |
| 22724: | B:1 |
| 22725: | B:1 |
| 22726: | B:1 |
| 22727: | B:1 |
| 22728: | B:1 |
| 22729: | B:1 |
| 22730: | B:1 |
| 22731: | B:1 |
| 22732: | B:1 |
| 22733: | B:1 |
| 22734: | B:1 |
| 22735: | B:1 |
| 22736: | B:1 |
| 22737: | B:1 |
| 22738: | B:1 |
| 22739: | B:1 |
| 22740: | B:1 |
| 22741: | B:1 |
| 22742: | B:1 |
| 22743: | B:1 |
| 22744: | B:1 |
| 22745: | B:1 |
| 22746: | B:1 |
| 22747: | B:1 |
| 22748: | B:1 |
| 22749: | B:1 |
| 22750: | B:1 |
| 22751: | B:1 |
| 22752: | B:1 |
| 22753: | B:1 |
| 22754: | B:1 |
| 22755: | B:1 |
| 22756: | B:1 |
| 22757: | B:1 |

TABLE II-continued

| SEQ ID NO. | Spatial Distribution |
|---|---|
| 22758: | B:1 |
| 22759: | B:1 |
| 22760: | B:1 |
| 22761: | B:1 |
| 22762: | B:1 |
| 22763: | B:1 |
| 22764: | B:1 |
| 22765: | B:1 |
| 22766: | B:1 |
| 22767: | B:1 |
| 22768: | B:1 |
| 22769: | B:1 |
| 22770: | B:1 |
| 22771: | B:1 |
| 22772: | B:1 |
| 22773: | B:1 |
| 22774: | B:1 |
| 22775: | B:1 |
| 22776: | B:1 |
| 22777: | B:1 |
| 22778: | B:1 |
| 22779: | B:1 |
| 22780: | B:1 |
| 22781: | B:1 |
| 22782: | B:1 |
| 22783: | B:1 |
| 22784: | B:1 |
| 22785: | B:1 |
| 22786: | B:1 |
| 22787: | B:1 |
| 22788: | B:1 |
| 22789: | B:1 |
| 22790: | B:1 |
| 22791: | B:1 |
| 22792: | B:1 |
| 22793: | B:1 |
| 22794: | B:1 |
| 22795: | B:1 |
| 22796: | B:1 |
| 22797: | B:1 |
| 22798: | B:1 |
| 22799: | B:1 |
| 22800: | B:1 |
| 22801: | B:1 |
| 22802: | B:1 |
| 22803: | B:1 |
| 22804: | B:1 |
| 22805: | B:1 |
| 22806: | B:1 |
| 22807: | B:1 |
| 22808: | B:1 |
| 22809: | B:1 |
| 22810: | B:1 |
| 22811: | B:1 |
| 22812: | B:1 |
| 22813: | B:1 |
| 22814: | B:1 |
| 22815: | B:1 |
| 22816: | B:1 |
| 22817: | B:1 |
| 22818: | B:1 |
| 22819: | B:1 |
| 22820: | B:1 |
| 22821: | B:1 |
| 22822: | B:1 |
| 22823: | B:1 |
| 22824: | B:1 |
| 22825: | B:1 |
| 22826: | B:1 |
| 22827: | B:1 |
| 22828: | B:1 |
| 22829: | B:1 |
| 22830: | B:1 |
| 22831: | B:1 |
| 22832: | B:1 |
| 22833: | B:1 |
| 22834: | B:1 |
| 22835: | B:1 |
| 22836: | B:1 |
| 22837: | B:1 |
| 22838: | B:1 |
| 22839: | B:1 |
| 22840: | B:1 |
| 22841: | B:1 |
| 22842: | B:1 |
| 22843: | B:1 |
| 22844: | B:1 |
| 22845: | B:1 |
| 22846: | B:1 |
| 22847: | B:1 |
| 22848: | B:1 |
| 22849: | B:1 |
| 22850: | B:1 |
| 22851: | B:1 |
| 22852: | B:1 |
| 22853: | B:1 |
| 22854: | B:1 |
| 22855: | B:1 |
| 22856: | B:1 |
| 22857: | B:1 |
| 22858: | B:1 |
| 22859: | B:1 |
| 22860: | B:1 |
| 22861: | B:1 |
| 22862: | B:1 |
| 22863: | B:1 |
| 22864: | B:1 |
| 22865: | B:1 |
| 22866: | B:1 |
| 22867: | B:1 |
| 22868: | B:1 |
| 22869: | B:1 |
| 22870: | B:1 |
| 22871: | B:1 |
| 22872: | B:1 |
| 22873: | B:1 |
| 22874: | B:1 |
| 22875: | B:1 |
| 22876: | B:1 |
| 22877: | B:1 |
| 22878: | B:1 |
| 22879: | B:1 |
| 22880: | B:1 |
| 22881: | B:1 |
| 22882: | B:1 |
| 22883: | B:1 |
| 22884: | B:1 |
| 22885: | B:1 |
| 22886: | B:1 |
| 22887: | B:1 |
| 22888: | B:1 |
| 22889: | B:1 |
| 22890: | B:1 |
| 22891: | B:1 |
| 22892: | B:1 |
| 22893: | B:1 |
| 22894: | B:1 |
| 22895: | B:1 |
| 22896: | B:1 |
| 22897: | B:1 |
| 22898: | B:1 |
| 22899: | B:1 |
| 22900: | B:1 |
| 22901: | B:1 |
| 22902: | B:1 |
| 22903: | B:1 |
| 22904: | B:1 |
| 22905: | B:1 |
| 22906: | B:1 |
| 22907: | B:1 |
| 22908: | B:1 |
| 22909: | B:1 |
| 22910: | B:1 |
| 22911: | B:1 |

TABLE II-continued

| SEQ ID NO. | Spatial Distribution |
|---|---|
| 22912: | B:1 |
| 22913: | B:1 |
| 22914: | B:1 |
| 22915: | B:1 |
| 22916: | B:1 |
| 22917: | B:1 |
| 22918: | B:1 |
| 22919: | B:1 |
| 22920: | B:1 |
| 22921: | B:1 |
| 22922: | B:1 |
| 22923: | B:1 |
| 22924: | B:1 |
| 22925: | B:1 |
| 22926: | B:1 |
| 22927: | B:1 |
| 22928: | B:1 |
| 22929: | B:1 |
| 22930: | B:1 |
| 22931: | B:1 |
| 22932: | B:1 |
| 22933: | B:1 |
| 22934: | B:1 |
| 22935: | B:1 |
| 22936: | B:1 |
| 22937: | B:1 |
| 22938: | B:1 |
| 22939: | B:1 |
| 22940: | B:1 |
| 22941: | B:1 |
| 22942: | B:1 |
| 22943: | B:1 |
| 22944: | B:1 |
| 22945: | B:1 |
| 22946: | B:1 |
| 22947: | B:1 |
| 22948: | B:1 |
| 22949: | B:1 |
| 22950: | B:1 |
| 22951: | B:1 |
| 22952: | B:1 |
| 22953: | B:1 |
| 22954: | B:1 |
| 22955: | B:1 |
| 22956: | B:1 |
| 22957: | B:1 |
| 22958: | B:1 |
| 22959: | B:1 |
| 22960: | B:1 |
| 22961: | B:1 |
| 22962: | B:1 |
| 22963: | B:1 |
| 22964: | B:1 |
| 22965: | B:1 |
| 22966: | B:1 |
| 22967: | B:1 |
| 22968: | B:1 |
| 22969: | B:1 |
| 22970: | B:1 |
| 22971: | B:1 |
| 22972: | B:1 |
| 22973: | B:1 |
| 22974: | B:1 |
| 22975: | B:1 |
| 22976: | B:1 |
| 22977: | B:1 |
| 22978: | B:1 |
| 22979: | B:1 |
| 22980: | B:1 |
| 22981: | B:1 |
| 22982: | B:1 |
| 22983: | B:1 |
| 22984: | B:1 |
| 22985: | B:1 |
| 22986: | B:1 |
| 22987: | B:1 |
| 22988: | B:1 |
| 22989: | B:1 |
| 22990: | B:1 |
| 22991: | B:1 |
| 22992: | B:1 |
| 22993: | B:1 |
| 22994: | B:1 |
| 22995: | B:1 |
| 22996: | B:1 |
| 22997: | B:1 |
| 22998: | B:1 |
| 22999: | B:1 |
| 23000: | B:1 |
| 23001: | B:1 |
| 23002: | B:1 |
| 23003: | B:1 |
| 23004: | B:1 |
| 23005: | B:1 |
| 23006: | B:1 |
| 23007: | B:1 |
| 23008: | B:1 |
| 23009: | B:1 |
| 23010: | B:1 |
| 23011: | B:1 |
| 23012: | B:1 |
| 23013: | B:1 |
| 23014: | B:1 |
| 23015: | B:1 |
| 23016: | B:1 |
| 23017: | B:1 |
| 23018: | B:1 |
| 23019: | B:1 |
| 23020: | B:1 |
| 23021: | B:1 |
| 23022: | B:1 |
| 23023: | B:1 |
| 23024: | B:1 |
| 23025: | B:1 |
| 23026: | B:1 |
| 23027: | B:1 |
| 23028: | B:1 |
| 23029: | B:1 |
| 23030: | B:1 |
| 23031: | B:1 |
| 23032: | B:1 |
| 23033: | B:1 |
| 23034: | B:1 |
| 23035: | B:1 |
| 23036: | B:1 |
| 23037: | B:1 |
| 23038: | B:1 |
| 23039: | B:1 |
| 23040: | B:1 |
| 23041: | B:1 |
| 23042: | B:1 |
| 23043: | B:1 |
| 23044: | B:1 |
| 23045: | B:1 |
| 23046: | B:1 |
| 23047: | B:1 |
| 23048: | B:1 |
| 23049: | B:1 |
| 23050: | B:1 |
| 23051: | B:1 |
| 23052: | B:1 |
| 23053: | B:1 |
| 23054: | B:1 |
| 23055: | B:1 |
| 23056: | B:1 |
| 23057: | B:1 |
| 23058: | B:1 |
| 23059: | B:1 |
| 23060: | B:1 |
| 23061: | B:1 |
| 23062: | B:1 |
| 23063: | B:1 |
| 23064: | B:1 |
| 23065: | B:1 |

TABLE II-continued

| SEQ ID NO. | Spatial Distribution |
|---|---|
| 23066: | B:1 |
| 23067: | B:1 |
| 23068: | B:1 |
| 23069: | B:1 |
| 23070: | B:1 |
| 23071: | B:1 |
| 23072: | B:1 |
| 23073: | B:1 |
| 23074: | B:1 |
| 23075: | B:1 |
| 23076: | B:1 |
| 23077: | B:1 |
| 23078: | B:1 |
| 23079: | B:1 |
| 23080: | B:1 |
| 23081: | B:1 |
| 23082: | B:1 |
| 23083: | B:1 |
| 23084: | B:1 |
| 23085: | B:1 |
| 23086: | B:1 |
| 23087: | B:1 |
| 23088: | B:1 |
| 23089: | B:1 |
| 23090: | B:1 |
| 23091: | B:1 |
| 23092: | B:1 |
| 23093: | B:1 |
| 23094: | B:1 |
| 23095: | B:1 |
| 23096: | B:1 |
| 23097: | B:1 |
| 23098: | B:1 |
| 23099: | B:1 |
| 23100: | B:1 |
| 23101: | B:1 |
| 23102: | B:1 |
| 23103: | B:1 |
| 23104: | B:1 |
| 23105: | B:1 |
| 23106: | B:1 |
| 23107: | B:1 |
| 23108: | B:1 |
| 23109: | B:1 |
| 23110: | B:1 |
| 23111: | B:1 |
| 23112: | B:1 |
| 23113: | B:1 |
| 23114: | B:1 |
| 23115: | B:1 |
| 23116: | B:1 |
| 23117: | B:1 |
| 23118: | B:1 |
| 23119: | B:1 |
| 23120: | B:1 |
| 23121: | B:1 |
| 23122: | B:1 |
| 23123: | B:1 |
| 23124: | B:1 |
| 23125: | B:1 |
| 23126: | B:1 |
| 23127: | B:1 |
| 23128: | B:1 |
| 23129: | B:1 |
| 23130: | B:1 |
| 23131: | B:1 |
| 23132: | B:1 |
| 23133: | B:1 |
| 23134: | B:1 |
| 23135: | B:1 |
| 23136: | B:1 |
| 23137: | B:1 |
| 23138: | B:1 |
| 23139: | B:1 |
| 23140: | B:1 |
| 23141: | B:1 |
| 23142: | B:1 |
| 23143: | B:1 |
| 23144: | B:1 |
| 23145: | B:1 |
| 23146: | B:1 |
| 23147: | B:1 |
| 23148: | B:1 |
| 23149: | B:1 |
| 23150: | B:1 |
| 23151: | B:1 |
| 23152: | B:1 |
| 23153: | B:1 |
| 23154: | B:1 |
| 23155: | B:1 |
| 23156: | B:1 |
| 23157: | B:1 |
| 23158: | B:1 |
| 23159: | B:1 |
| 23160: | B:1 |
| 23161: | B:1 |
| 23162: | B:1 |
| 23163: | B:1 |
| 23164: | B:1 |
| 23165: | B:1 |
| 23166: | B:1 |
| 23167: | B:1 |
| 23168: | B:1 |
| 23169: | B:1 |
| 23170: | B:1 |
| 23171: | B:1 |
| 23172: | B:1 |
| 23173: | B:1 |
| 23174: | B:1 |
| 23175: | B:1 |
| 23176: | B:1 |
| 23177: | B:1 |
| 23178: | B:1 |
| 23179: | B:1 |
| 23180: | B:1 |
| 23181: | B:1 |
| 23182: | B:1 |
| 23183: | B:1 |
| 23184: | B:1 |
| 23185: | B:1 |
| 23186: | B:1 |
| 23187: | B:1 |
| 23188: | B:1 |
| 23189: | B:1 |
| 23190: | B:1 |
| 23191: | B:1 |
| 23192: | B:1 |
| 23193: | B:1 |
| 23194: | B:1 |
| 23195: | B:1 |
| 23196: | B:1 |
| 23197: | B:1 |
| 23198: | B:1 |
| 23199: | B:1 |
| 23200: | B:1 |
| 23201: | B:1 |
| 23202: | B:1 |
| 23203: | B:1 |
| 23204: | B:1 |
| 23205: | B:1 |
| 23206: | B:1 |
| 23207: | B:1 |
| 23208: | B:1 |
| 23209: | B:1 |
| 23210: | B:1 |
| 23211: | B:1 |
| 23212: | B:1 |
| 23213: | B:1 |
| 23214: | B:1 |
| 23215: | B:1 |
| 23216: | B:1 |
| 23217: | B:1 |
| 23218: | B:1 |
| 23219: | B:1 |

TABLE II-continued

| SEQ ID NO. | Spatial Distribution |
|---|---|
| 23220: | B:1 |
| 23221: | B:1 |
| 23222: | B:1 |
| 23223: | B:1 |
| 23224: | B:1 |
| 23225: | B:1 |
| 23226: | B:1 |
| 23227: | B:1 |
| 23228: | B:1 |
| 23229: | B:1 |
| 23230: | B:1 |
| 23231: | B:1 |
| 23232: | B:1 |
| 23233: | B:1 |
| 23234: | B:1 |
| 23235: | B:1 |
| 23236: | B:1 |
| 23237: | B:1 |
| 23238: | B:1 |
| 23239: | B:1 |
| 23240: | B:1 |
| 23241: | B:1 |
| 23242: | B:1 |
| 23243: | B:1 |
| 23244: | B:1 |
| 23245: | B:1 |
| 23246: | B:1 |
| 23247: | B:1 |
| 23248: | B:1 |
| 23249: | B:1 |
| 23250: | B:1 |
| 23251: | B:1 |
| 23252: | B:1 |
| 23253: | B:1 |
| 23254: | B:1 |
| 23255: | B:1 |
| 23256: | B:1 |
| 23257: | B:1 |
| 23258: | B:1 |
| 23259: | B:1 |
| 23260: | B:1 |
| 23261: | B:1 |
| 23262: | B:1 |
| 23263: | B:1 |
| 23264: | B:1 |
| 23265: | B:1 |
| 23266: | B:1 |
| 23267: | B:1 |
| 23268: | B:1 |
| 23269: | B:1 |
| 23270: | B:1 |
| 23271: | B:1 |
| 23272: | B:1 |
| 23273: | B:1 |
| 23274: | B:1 |
| 23275: | B:1 |
| 23276: | B:1 |
| 23277: | B:1 |
| 23278: | B:1 |
| 23279: | B:1 |
| 23280: | B:1 |
| 23281: | B:1 |
| 23282: | B:1 |
| 23283: | B:1 |
| 23284: | B:1 |
| 23285: | B:1 |
| 23286: | B:1 |
| 23287: | B:1 |
| 23288: | B:1 |
| 23289: | B:1 |
| 23290: | B:1 |
| 23291: | B:1 |
| 23292: | B:1 |
| 23293: | B:1 |
| 23294: | B:1 |
| 23295: | B:1 |
| 23296: | B:1 |
| 23297: | B:1 |
| 23298: | B:1 |
| 23299: | B:1 |
| 23300: | B:1 |
| 23301: | B:1 |
| 23302: | B:1 |
| 23303: | B:1 |
| 23304: | B:1 |
| 23305: | B:1 |
| 23306: | B:1 |
| 23307: | B:1 |
| 23308: | B:1 |
| 23309: | B:1 |
| 23310: | B:1 |
| 23311: | B:1 |
| 23312: | B:1 |
| 23313: | B:1 |
| 23314: | B:1 |
| 23315: | B:1 |
| 23316: | B:1 |
| 23317: | B:1 |
| 23318: | B:1 |
| 23319: | B:1 |
| 23320: | B:1 |
| 23321: | B:1 |
| 23322: | B:1 |
| 23323: | B:1 |
| 23324: | B:1 |
| 23325: | B:1 |
| 23326: | B:1 |
| 23327: | B:1 |
| 23328: | B:1 |
| 23329: | B:1 |
| 23330: | B:1 |
| 23331: | B:1 |
| 23332: | B:1 |
| 23333: | B:1 |
| 23334: | B:1 |
| 23335: | B:1 |
| 23336: | B:1 |
| 23337: | B:1 |
| 23338: | B:1 |
| 23339: | B:1 |
| 23340: | B:1 |
| 23341: | B:1 |
| 23342: | B:1 |
| 23343: | B:1 |
| 23344: | B:1 |
| 23345: | B:1 |
| 23346: | B:1 |
| 23347: | B:1 |
| 23348: | B:1 |
| 23349: | B:1 |
| 23350: | B:1 |
| 23351: | B:1 |
| 23352: | B:1 |
| 23353: | B:1 |
| 23354: | B:1 |
| 23355: | B:1 |
| 23356: | B:1 |
| 23357: | B:1 |
| 23358: | B:1 |
| 23359: | B:1 |
| 23360: | B:1 |
| 23361: | B:1 |
| 23362: | B:1 |
| 23363: | B:1 |
| 23364: | B:1 |
| 23365: | B:1 |
| 23366: | B:1 |
| 23367: | B:1 |
| 23368: | B:1 |
| 23369: | B:1 |
| 23370: | B:1 |
| 23371: | B:1 |
| 23372: | B:1 |
| 23373: | B:1 |

TABLE II-continued

| SEQ ID NO. | Spatial Distribution |
|---|---|
| 23374: | B:1 |
| 23375: | B:1 |
| 23376: | B:1 |
| 23377: | B:1 |
| 23378: | B:1 |
| 23379: | B:1 |
| 23380: | B:1 |
| 23381: | B:1 |
| 23382: | B:1 |
| 23383: | B:1 |
| 23384: | B:1 |
| 23385: | B:1 |
| 23386: | B:1 |
| 23387: | B:1 |
| 23388: | B:1 |
| 23389: | B:1 |
| 23390: | B:1 |
| 23391: | B:1 |
| 23392: | B:1 |
| 23393: | B:1 |
| 23394: | B:1 |
| 23395: | B:1 |
| 23396: | B:1 |
| 23397: | B:1 |
| 23398: | B:1 |
| 23399: | B:1 |
| 23400: | B:1 |
| 23401: | B:1 |
| 23402: | B:1 |
| 23403: | B:1 |
| 23404: | B:1 |
| 23405: | B:1 |
| 23406: | B:1 |
| 23407: | B:1 |
| 23408: | B:1 |
| 23409: | B:1 |
| 23410: | B:1 |
| 23411: | B:1 |
| 23412: | B:1 |
| 23413: | B:1 |
| 23414: | B:1 |
| 23415: | B:1 |
| 23416: | B:1 |
| 23417: | B:1 |
| 23418: | B:1 |
| 23419: | B:1 |
| 23420: | B:1 |
| 23421: | B:1 |
| 23422: | B:1 |
| 23423: | B:1 |
| 23424: | B:1 |
| 23425: | B:1 |
| 23426: | B:1 |
| 23427: | B:1 |
| 23428: | B:1 |
| 23429: | B:1 |
| 23430: | B:1 |
| 23431: | B:1 |
| 23432: | B:1 |
| 23433: | B:1 |
| 23434: | B:1 |
| 23435: | B:1 |
| 23436: | B:1 |
| 23437: | B:1 |
| 23438: | B:1 |
| 23439: | B:1 |
| 23440: | B:1 |
| 23441: | B:1 |
| 23442: | B:1 |
| 23443: | B:1 |
| 23444: | B:1 |
| 23445: | B:1 |
| 23446: | B:1 |
| 23447: | B:1 |
| 23448: | B:1 |
| 23449: | B:1 |
| 23450: | B:1 |
| 23451: | B:1 |
| 23452: | B:1 |
| 23453: | B:1 |
| 23454: | B:1 |
| 23455: | B:1 |
| 23456: | B:1 |
| 23457: | B:1 |
| 23458: | B:1 |
| 23459: | B:1 |
| 23460: | B:1 |
| 23461: | B:1 |
| 23462: | B:1 |
| 23463: | B:1 |
| 23464: | B:1 |
| 23465: | B:1 |
| 23466: | B:1 |
| 23467: | B:1 |
| 23468: | B:1 |
| 23469: | B:1 |
| 23470: | B:1 |
| 23471: | B:1 |
| 23472: | B:1 |
| 23473: | B:1 |
| 23474: | B:1 |
| 23475: | B:1 |
| 23476: | B:1 |
| 23477: | B:1 |
| 23478: | B:1 |
| 23479: | B:1 |
| 23480: | B:1 |
| 23481: | B:1 |
| 23482: | B:1 |
| 23483: | B:1 |
| 23484: | B:1 |
| 23485: | B:1 |
| 23486: | B:1 |
| 23487: | B:1 |
| 23488: | B:1 |
| 23489: | B:1 |
| 23490: | B:1 |
| 23491: | B:1 |
| 23492: | B:1 |
| 23493: | B:1 |
| 23494: | B:1 |
| 23495: | B:1 |
| 23496: | B:1 |
| 23497: | B:1 |
| 23498: | B:1 |
| 23499: | B:1 |
| 23500: | B:1 |
| 23501: | B:1 |
| 23502: | B:1 |
| 23503: | B:1 |
| 23504: | B:1 |
| 23505: | B:1 |
| 23506: | B:1 |
| 23507: | B:1 |
| 23508: | B:1 |
| 23509: | B:1 |
| 23510: | B:1 |
| 23511: | B:1 |
| 23512: | B:1 |
| 23513: | B:1 |
| 23514: | B:1 |
| 23515: | B:1 |
| 23516: | B:1 |
| 23517: | B:1 |
| 23518: | B:1 |
| 23519: | B:1 |
| 23520: | B:1 |
| 23521: | B:1 |
| 23522: | B:1 |
| 23523: | B:1 |
| 23524: | B:1 |
| 23525: | B:1 |
| 23526: | B:1 |
| 23527: | B:1 |

TABLE II-continued

| SEQ ID NO. | Spatial Distribution |
|---|---|
| 23528: | B:1 |
| 23529: | B:1 |
| 23530: | B:1 |
| 23531: | B:1 |
| 23532: | B:1 |
| 23533: | B:1 |
| 23534: | B:1 |
| 23535: | B:1 |
| 23536: | B:1 |
| 23537: | B:1 |
| 23538: | B:1 |
| 23539: | B:1 |
| 23540: | B:1 |
| 23541: | B:1 |
| 23542: | B:1 |
| 23543: | B:1 |
| 23544: | B:1 |
| 23545: | B:1 |
| 23546: | B:1 |
| 23547: | B:1 |
| 23548: | B:1 |
| 23549: | B:1 |
| 23550: | B:1 |
| 23551: | B:1 |
| 23552: | B:1 |
| 23553: | B:1 |
| 23554: | B:1 |
| 23555: | B:1 |
| 23556: | B:1 |
| 23557: | B:1 |
| 23558: | B:1 |
| 23559: | B:1 |
| 23560: | B:1 |
| 23561: | B:1 |
| 23562: | B:1 |
| 23563: | B:1 |
| 23564: | B:1 |
| 23565: | B:1 |
| 23566: | B:1 |
| 23567: | B:1 |
| 23568: | B:1 |
| 23569: | B:1 |
| 23570: | B:1 |
| 23571: | B:1 |
| 23572: | B:1 |
| 23573: | B:1 |
| 23574: | B:1 |
| 23575: | B:1 |
| 23576: | B:1 |
| 23577: | B:1 |
| 23578: | B:1 |
| 23579: | B:1 |
| 23580: | B:1 |
| 23581: | B:1 |
| 23582: | B:1 |
| 23583: | B:1 |
| 23584: | B:1 |
| 23585: | B:1 |
| 23586: | B:1 |
| 23587: | B:1 |
| 23588: | B:1 |
| 23589: | B:1 |
| 23590: | B:1 |
| 23591: | B:1 |
| 23592: | B:1 |
| 23593: | B:1 |
| 23594: | B:1 |
| 23595: | B:1 |
| 23596: | B:1 |
| 23597: | B:1 |
| 23598: | B:1 |
| 23599: | B:1 |
| 23600: | B:1 |
| 23601: | B:1 |
| 23602: | B:1 |
| 23603: | B:1 |
| 23604: | B:1 |
| 23605: | B:1 |
| 23606: | B:1 |
| 23607: | B:1 |
| 23608: | B:1 |
| 23609: | B:1 |
| 23610: | B:1 |
| 23611: | B:1 |
| 23612: | B:1 |
| 23613: | B:1 |
| 23614: | B:1 |
| 23615: | B:1 |
| 23616: | B:1 |
| 23617: | B:1 |
| 23618: | B:1 |
| 23619: | B:1 |
| 23620: | B:1 |
| 23621: | B:1 |
| 23622: | B:1 |
| 23623: | B:1 |
| 23624: | B:1 |
| 23625: | B:1 |
| 23626: | B:1 |
| 23627: | B:1 |
| 23628: | B:1 |
| 23629: | B:1 |
| 23630: | B:1 |
| 23631: | B:1 |
| 23632: | B:1 |
| 23633: | B:1 |
| 23634: | B:1 |
| 23635: | B:1 |
| 23636: | B:1 |
| 23637: | B:1 |
| 23638: | B:1 |
| 23639: | B:1 |
| 23640: | B:1 |
| 23641: | B:1 |
| 23642: | B:1 |
| 23643: | B:1 |
| 23644: | B:1 |
| 23645: | B:1 |
| 23646: | B:1 |
| 23647: | B:1 |
| 23648: | B:1 |
| 23649: | B:1 |
| 23650: | B:1 |
| 23651: | B:1 |
| 23652: | B:1 |
| 23653: | B:1 |
| 23654: | B:1 |
| 23655: | B:1 |
| 23656: | B:1 |
| 23657: | B:1 |
| 23658: | B:1 |
| 23659: | B:1 |
| 23660: | B:1 |
| 23661: | B:1 |
| 23662: | B:1 |
| 23663: | B:1 |
| 23664: | B:1 |
| 23665: | B:1 |
| 23666: | B:1 |
| 23667: | B:1 |
| 23668: | B:1 |
| 23669: | B:1 |
| 23670: | B:1 |
| 23671: | B:1 |
| 23672: | B:1 |
| 23673: | B:1 |
| 23674: | B:1 |
| 23675: | B:1 |
| 23676: | B:1 |
| 23677: | B:1 |
| 23678: | B:1 |
| 23679: | B:1 |
| 23680: | B:1 |
| 23681: | B:1 |

TABLE II-continued

| SEQ ID NO. | Spatial Distribution |
|---|---|
| 23682: | B:1 |
| 23683: | B:1 |
| 23684: | B:1 |
| 23685: | B:1 |
| 23686: | B:1 |
| 23687: | B:1 |
| 23688: | B:1 |
| 23689: | B:1 |
| 23690: | B:1 |
| 23691: | B:1 |
| 23692: | B:1 |
| 23693: | B:1 |
| 23694: | B:1 |
| 23695: | B:1 |
| 23696: | B:1 |
| 23697: | B:1 |
| 23698: | B:1 |
| 23699: | B:1 |
| 23700: | B:1 |
| 23701: | B:1 |
| 23702: | B:1 |
| 23703: | B:1 |
| 23704: | B:1 |
| 23705: | B:1 |
| 23706: | B:1 |
| 23707: | B:1 |
| 23708: | B:1 |
| 23709: | B:1 |
| 23710: | B:1 |
| 23711: | B:1 |
| 23712: | B:1 |
| 23713: | B:1 |
| 23714: | B:1 |
| 23715: | B:1 |
| 23716: | B:1 |
| 23717: | B:1 |
| 23718: | B:1 |
| 23719: | B:1 |
| 23720: | B:1 |
| 23721: | B:1 |
| 23722: | B:1 |
| 23723: | B:1 |
| 23724: | B:1 |
| 23725: | B:1 |
| 23726: | B:1 |
| 23727: | B:1 |
| 23728: | B:1 |
| 23729: | B:1 |
| 23730: | B:1 |
| 23731: | B:1 |
| 23732: | B:1 |
| 23733: | B:1 |
| 23734: | B:1 |
| 23735: | B:1 |
| 23736: | B:1 |
| 23737: | B:1 |
| 23738: | B:1 |
| 23739: | B:1 |
| 23740: | B:1 |
| 23741: | B:1 |
| 23742: | B:1 |
| 23743: | B:1 |
| 23744: | B:1 |
| 23745: | B:1 |
| 23746: | B:1 |
| 23747: | B:1 |
| 23748: | B:1 |
| 23749: | B:1 |
| 23750: | B:1 |
| 23751: | B:1 |
| 23752: | B:1 |
| 23753: | B:1 |
| 23754: | B:1 |
| 23755: | B:1 |
| 23756: | B:1 |
| 23757: | B:1 |
| 23758: | B:1 |
| 23759: | B:1 |
| 23760: | B:1 |
| 23761: | B:1 |
| 23762: | B:1 |
| 23763: | B:1 |
| 23764: | B:1 |
| 23765: | B:1 |
| 23766: | B:1 |
| 23767: | B:1 |
| 23768: | B:1 |
| 23769: | B:1 |
| 23770: | B:1 |

TABLE II

| SEQ ID NO. | Spatial Distribution |
|---|---|
| 23771: | B:1 |
| 23772: | B:1 |
| 23773: | B:1 |
| 23774: | B:1 |
| 23775: | B:1 |
| 23776: | B:1 |
| 23777: | B:1 |
| 23778: | B:1 |
| 23779: | B:1 |
| 23780: | B:1 |
| 23781: | AC:1 |
| 23782: | AC:1 |
| 23783: | AC:1 |
| 23784: | AC:1 |
| 23785: | AC:1 |
| 23786: | AC:1 |
| 23787: | AC:1 |
| 23788: | AC:1 |
| 23789: | AC:1 |
| 23790: | AC:1 |
| 23791: | AC:1 |
| 23792: | AC:1 |
| 23793: | AC:1 |
| 23794: | AC:1 |
| 23795: | AC:1 |
| 23796: | AC:1 |
| 23797: | AC:1 |
| 23798: | AC:1 |
| 23799: | AC:1 |
| 23800: | AC:1 |
| 23801: | AC:1 |
| 23802: | AC:1 |
| 23803: | AC:1 |
| 23804: | AC:1 |
| 23805: | AC:1 |
| 23806: | AC:1 |
| 23807: | AC:1 |
| 23808: | AC:1 |
| 23809: | AC:1 |
| 23810: | AC:1 |
| 23811: | AC:1 |
| 23812: | AC:1 |
| 23813: | AC:1 |
| 23814: | AC:1 |
| 23815: | AC:1 |
| 23816: | AC:1 |
| 23817: | AC:1 |
| 23818: | AC:1 |
| 23819: | AC:1 |
| 23820: | AC:1 |
| 23821: | AC:1 |
| 23822: | AC:1 |
| 23823: | AC:1 |
| 23824: | AC:1 |
| 23825: | AC:1 |
| 23826: | AC:1 |
| 23827: | AC:1 |

TABLE II-continued

| SEQ ID NO. | Spatial Distribution |
|---|---|
| 23828: | AC:1 |
| 23829: | AC:1 |
| 23830: | AC:1 |
| 23831: | AC:1 |
| 23832: | AC:1 |
| 23833: | AC:1 |
| 23834: | AC:1 |
| 23835: | AC:1 |
| 23836: | AC:1 |
| 23837: | AC:1 |
| 23838: | AC:1 |
| 23839: | AC:1 |
| 23840: | AC:1 |
| 23841: | AC:1 |
| 23842: | AC:1 |
| 23843: | AC:1 |
| 23844: | AC:1 |
| 23845: | AC:1 |
| 23846: | AC:1 |
| 23847: | AC:1 |
| 23848: | AC:1 |
| 23849: | AC:1 |
| 23850: | AC:1 |
| 23851: | AC:1 |
| 23852: | AC:1 |
| 23853: | AC:1 |
| 23854: | AC:1 |
| 23855: | AC:1 |
| 23856: | AC:1 |
| 23857: | AC:1 |
| 23858: | AC:1 |
| 23859: | AC:1 |
| 23860: | AC:1 |
| 23861: | AC:1 |
| 23862: | AC:1 |
| 23863: | AC:1 |
| 23864: | AC:1 |
| 23865: | AC:1 |
| 23866: | AC:1 |
| 23867: | AC:1 |
| 23868: | AC:1 |
| 23869: | AC:1 |
| 23870: | AC:1 |
| 23871: | AC:1 |
| 23872: | AC:1 |
| 23873: | AC:1 |
| 23874: | AC:1 |
| 23875: | AC:1 |
| 23876: | AC:1 |
| 23877: | AC:1 |
| 23878: | AC:1 |
| 23879: | AC:1 |
| 23880: | AC:1 |
| 23881: | AC:1 |
| 23882: | AC:1 |
| 23883: | AC:1 |
| 23884: | AC:1 |
| 23885: | AC:1 |
| 23886: | AC:1 |
| 23887: | AC:1 |
| 23888: | AC:1 |
| 23889: | AC:1 |
| 23890: | AC:1 |
| 23891: | AC:1 |
| 23892: | AC:1 |
| 23893: | AC:1 |
| 23894: | AC:1 |
| 23895: | AC:1 |
| 23896: | AC:1 |
| 23897: | AC:1 |
| 23898: | AC:1 |
| 23899: | AC:1 |
| 23900: | AC:1 |
| 23901: | AC:1 |
| 23902: | AC:1 |
| 23903: | AC:1 |
| 23904: | AC:1 |
| 23905: | AC:1 |
| 23906: | AC:1 |
| 23907: | AC:1 |
| 23908: | AC:1 |
| 23909: | AC:1 |
| 23910: | AC:1 |
| 23911: | AC:1 |
| 23912: | AC:1 |
| 23913: | AC:1 |
| 23914: | AC:1 |
| 23915: | AC:1 |
| 23916: | AC:1 |
| 23917: | AC:1 |
| 23918: | AC:1 |
| 23919: | AC:1 |
| 23920: | AC:1 |
| 23921: | AC:1 |
| 23922: | AC:1 |
| 23923: | AC:1 |
| 23924: | AC:1 |
| 23925: | AC:1 |
| 23926: | AC:1 |
| 23927: | AC:1 |
| 23928: | AC:1 |
| 23929: | AC:1 |
| 23930: | AC:1 |
| 23931: | AC:1 |
| 23932: | AC:1 |
| 23933: | AC:1 |
| 23934: | AC:1 |
| 23935: | AC:1 |
| 23936: | AC:1 |
| 23937: | AC:1 |
| 23938: | AC:1 |
| 23939: | AC:1 |
| 23940: | AC:1 |
| 23941: | AC:1 |
| 23942: | AC:1 |
| 23943: | AC:1 |
| 23944: | AC:1 |
| 23945: | AC:1 |
| 23946: | AC:1 |
| 23947: | AC:1 |
| 23948: | AC:1 |
| 23949: | AC:1 |
| 23950: | AC:1 |
| 23951: | AC:1 |
| 23952: | AC:1 |
| 23953: | AC:1 |
| 23954: | AC:1 |
| 23955: | AC:1 |
| 23956: | AC:1 |
| 23957: | AC:1 |
| 23958: | AC:1 |
| 23959: | AC:1 |
| 23960: | AC:1 |
| 23961: | AC:1 |
| 23962: | AC:1 |
| 23963: | AC:1 |
| 23964: | AC:1 |
| 23965: | AC:1 |
| 23966: | AC:1 |
| 23967: | AC:1 |
| 23968: | AC:1 |
| 23969: | AC:1 |
| 23970: | AC:1 |
| 23971: | AC:1 |
| 23972: | AC:1 |
| 23973: | AC:1 |
| 23974: | AC:1 |
| 23975: | AC:1 |
| 23976: | AC:1 |
| 23977: | AC:1 |
| 23978: | AC:1 |
| 23979: | AC:1 |
| 23980: | AC:1 |
| 23981: | AC:1 |

TABLE II-continued

| SEQ ID NO. | Spatial Distribution |
|---|---|
| 23982: | AC:1 |
| 23983: | AC:1 |
| 23984: | AC:1 |
| 23985: | AC:1 |
| 23986: | AC:1 |
| 23987: | AC:1 |
| 23988: | AC:1 |
| 23989: | AC:1 |
| 23990: | AC:1 |
| 23991: | AC:1 |
| 23992: | AC:1 |
| 23993: | AC:1 |
| 23994: | AC:1 |
| 23995: | AC:1 |
| 23996: | AC:1 |
| 23997: | AC:1 |
| 23998: | AC:1 |
| 23999: | AC:1 |
| 24000: | AC:1 |
| 24001: | AC:1 |
| 24002: | AC:1 |
| 24003: | AC:1 |
| 24004: | AC:1 |
| 24005: | AC:1 |
| 24006: | AC:1 |
| 24007: | AC:1 |
| 24008: | AC:1 |
| 24009: | AC:1 |
| 24010: | AC:1 |
| 24011: | AC:1 |
| 24012: | AC:1 |
| 24013: | AC:1 |
| 24014: | AC:1 |
| 24015: | AC:1 |
| 24016: | AC:1 |
| 24017: | AC:1 |
| 24018: | AC:1 |
| 24019: | AC:1 |
| 24020: | AC:1 |
| 24021: | AC:1 |
| 24022: | AC:1 |
| 24023: | AC:1 |
| 24024: | AC:1 |
| 24025: | AC:1 |
| 24026: | AC:1 |
| 24027: | AC:1 |
| 24028: | AC:1 |
| 24029: | AC:1 |
| 24030: | AC:1 |
| 24031: | AC:1 |
| 24032: | AC:1 |
| 24033: | AC:1 |
| 24034: | AC:1 |
| 24035: | AC:1 |
| 24036: | AC:1 |
| 24037: | AC:1 |
| 24038: | AC:1 |
| 24039: | AC:1 |
| 24040: | AC:1 |
| 24041: | AC:1 |
| 24042: | AC:1 |
| 24043: | AC:1 |
| 24044: | AC:1 |
| 24045: | AC:1 |
| 24046: | AC:1 |
| 24047: | AC:1 |
| 24048: | AC:1 |
| 24049: | AC:1 |
| 24050: | AC:1 |
| 24051: | AC:1 |
| 24052: | AC:1 |
| 24053: | AC:1 |
| 24054: | AC:1 |
| 24055: | AC:1 |
| 24056: | AC:1 |
| 24057: | AC:1 |
| 24058: | AC:1 |
| 24059: | AC:1 |
| 24060: | AC:1 |
| 24061: | AC:1 |
| 24062: | AC:1 |
| 24063: | AC:1 |
| 24064: | AC:1 |
| 24065: | AC:1 |
| 24066: | AC:1 |
| 24067: | AC:1 |
| 24068: | AC:1 |
| 24069: | AC:1 |
| 24070: | AC:1 |
| 24071: | AC:1 |
| 24072: | AC:1 |
| 24073: | AC:1 |
| 24074: | AC:1 |
| 24075: | AC:1 |
| 24076: | AC:1 |
| 24077: | AC:1 |
| 24078: | AC:1 |
| 24079: | AC:1 |
| 24080: | AC:1 |
| 24081: | AC:1 |
| 24082: | AC:1 |
| 24083: | AC:1 |
| 24084: | AC:1 |
| 24085: | AC:1 |
| 24086: | AC:1 |
| 24087: | AC:1 |
| 24088: | AC:1 |
| 24089: | AC:1 |
| 24090: | AC:1 |
| 24091: | AC:1 |
| 24092: | AC:1 |
| 24093: | AC:1 |
| 24094: | AC:1 |
| 24095: | AC:1 |
| 24096: | AC:1 |
| 24097: | AC:1 |
| 24098: | AC:1 |
| 24099: | AC:1 |
| 24100: | AC:1 |
| 24101: | AC:1 |
| 24102: | AC:1 |
| 24103: | AC:1 |
| 24104: | AC:1 |
| 24105: | AC:1 |
| 24106: | AC:1 |
| 24107: | AC:1 |
| 24108: | AC:1 |
| 24109: | AC:1 |
| 24110: | AC:1 |
| 24111: | AC:1 |
| 24112: | AC:1 |
| 24113: | AC:1 |
| 24114: | AC:1 |
| 24115: | AC:1 |
| 24116: | AC:1 |
| 24117: | AC:1 |
| 24118: | AC:1 |
| 24119: | AC:1 |
| 24120: | AC:1 |
| 24121: | AC:1 |
| 24122: | AC:1 |
| 24123: | AC:1 |
| 24124: | AC:1 |
| 24125: | AC:1 |
| 24126: | AC:1 |
| 24127: | AC:1 |
| 24128: | AC:1 |
| 24129: | AC:1 |
| 24130: | AC:1 |
| 24131: | AC:1 |
| 24132: | AC:1 |
| 24133: | AC:1 |
| 24134: | AC:1 |
| 24135: | AC:1 |

TABLE II-continued

| SEQ ID NO. | Spatial Distribution |
|---|---|
| 24136: | AC:1 |
| 24137: | AC:1 |
| 24138: | AC:1 |
| 24139: | AC:1 |
| 24140: | AC:1 |
| 24141: | AC:1 |
| 24142: | AC:1 |
| 24143: | AC:1 |
| 24144: | AC:1 |
| 24145: | AC:1 |
| 24146: | AC:1 |
| 24147: | AC:1 |
| 24148: | AC:1 |
| 24149: | AC:1 |
| 24150: | AC:1 |
| 24151: | AC:1 |
| 24152: | AC:1 |
| 24153: | AC:1 |
| 24154: | AC:1 |
| 24155: | AC:1 |
| 24156: | AC:1 |
| 24157: | AC:1 |
| 24158: | AC:1 |
| 24159: | AC:1 |
| 24160: | AC:1 |
| 24161: | AC:1 |
| 24162: | AC:1 |
| 24163: | AC:1 |
| 24164: | AC:1 |
| 24165: | AC:1 |
| 24166: | AC:1 |
| 24167: | AC:1 |
| 24168: | AC:1 |
| 24169: | AC:1 |
| 24170: | AC:1 |
| 24171: | AC:1 |
| 24172: | AC:1 |
| 24173: | AC:1 |
| 24174: | AC:1 |
| 24175: | AC:1 |
| 24176: | AC:1 |
| 24177: | AC:1 |
| 24178: | AC:1 |
| 24179: | AC:1 |
| 24180: | AC:1 |
| 24181: | AC:1 |
| 24182: | AC:1 |
| 24183: | AC:1 |
| 24184: | AC:1 |
| 24185: | AC:1 |
| 24186: | AC:1 |
| 24187: | AC:1 |
| 24188: | AC:1 |
| 24189: | AC:1 |
| 24190: | AC:1 |
| 24191: | AC:1 |
| 24192: | AC:1 |
| 24193: | AC:1 |
| 24194: | AC:1 |
| 24195: | AC:1 |
| 24196: | AC:1 |
| 24197: | AC:1 |
| 24198: | AC:1 |
| 24199: | AC:1 |
| 24200: | AC:1 |
| 24201: | AC:1 |
| 24202: | AC:1 |
| 24203: | AC:1 |
| 24204: | AC:1 |
| 24205: | AC:1 |
| 24206: | AC:1 |
| 24207: | AC:1 |
| 24208: | AC:1 |
| 24209: | AC:1 |
| 24210: | AC:1 |
| 24211: | AC:1 |
| 24212: | AC:1 |
| 24213: | AC:1 |
| 24214: | AC:1 |
| 24215: | AC:1 |
| 24216: | AC:1 |
| 24217: | AC:1 |
| 24218: | AC:1 |
| 24219: | AC:1 |
| 24220: | AC:1 |
| 24221: | AC:1 |
| 24222: | AC:1 |
| 24223: | AC:1 |
| 24224: | AC:1 |
| 24225: | AC:1 |
| 24226: | AC:1 |
| 24227: | AC:1 |
| 24228: | AC:1 |
| 24229: | AC:1 |
| 24230: | AC:1 |
| 24231: | AC:1 |
| 24232: | AC:1 |
| 24233: | AC:1 |
| 24234: | AC:1 |
| 24235: | AC:1 |
| 24236: | AC:1 |
| 24237: | AC:1 |
| 24238: | AC:1 |
| 24239: | AC:1 |
| 24240: | AC:1 |
| 24241: | AC:1 |
| 24242: | AC:1 |
| 24243: | AC:1 |
| 24244: | AC:1 |
| 24245: | AC:1 |
| 24246: | AC:1 |
| 24247: | AC:1 |
| 24248: | AC:1 |
| 24249: | AC:1 |
| 24250: | AC:1 |
| 24251: | AC:1 |
| 24252: | AC:1 |
| 24253: | AC:1 |
| 24254: | AC:1 |
| 24255: | AC:1 |
| 24256: | AC:1 |
| 24257: | AC:1 |
| 24258: | AC:1 |
| 24259: | AC:1 |
| 24260: | AC:1 |
| 24261: | AC:1 |
| 24262: | AC:1 |
| 24263: | AC:1 |
| 24264: | AC:1 |
| 24265: | AC:1 |
| 24266: | AC:1 |
| 24267: | AC:1 |
| 24268: | AC:1 |
| 24269: | AC:1 |
| 24270: | AC:1 |
| 24271: | AC:1 |
| 24272: | AC:1 |
| 24273: | AC:1 |
| 24274: | AC:1 |
| 24275: | AC:1 |
| 24276: | AC:1 |
| 24277: | AC:1 |
| 24278: | AC:1 |
| 24279: | AC:1 |
| 24280: | AC:1 |
| 24281: | AC:1 |
| 24282: | AC:1 |
| 24283: | AC:1 |
| 24284: | AC:1 |
| 24285: | AC:1 |
| 24286: | AC:1 |
| 24287: | AC:1 |
| 24288: | AC:1 |
| 24289: | AC:1 |

TABLE II-continued

| SEQ ID NO. | Spatial Distribution |
|---|---|
| 24290: | AC:1 |
| 24291: | AC:1 |
| 24292: | AC:1 |
| 24293: | AC:1 |
| 24294: | AC:1 |
| 24295: | AC:1 |
| 24296: | AC:1 |
| 24297: | AC:1 |
| 24298: | AC:1 |
| 24299: | AC:1 |
| 24300: | AC:1 |
| 24301: | AC:1 |
| 24302: | AC:1 |
| 24303: | AC:1 |
| 24304: | AC:1 |
| 24305: | AC:1 |
| 24306: | AC:1 |
| 24307: | AC:1 |
| 24308: | AC:1 |
| 24309: | AC:1 |
| 24310: | AC:1 |
| 24311: | AC:1 |
| 24312: | AC:1 |
| 24313: | AC:1 |
| 24314: | AC:1 |
| 24315: | AC:1 |
| 24316: | AC:1 |
| 24317: | AC:1 |
| 24318: | AC:1 |
| 24319: | AC:1 |
| 24320: | AC:1 |
| 24321: | AC:1 |
| 24322: | AC:1 |
| 24323: | AC:1 |
| 24324: | AC:1 |
| 24325: | AC:1 |
| 24326: | AC:1 |
| 24327: | AC:1 |
| 24328: | AC:1 |
| 24329: | AC:1 |
| 24330: | AC:1 |
| 24331: | AC:1 |
| 24332: | AC:1 |
| 24333: | AC:1 |
| 24334: | AC:1 |
| 24335: | AC:1 |
| 24336: | AC:1 |
| 24337: | AC:1 |
| 24338: | AC:1 |
| 24339: | AC:1 |
| 24340: | AC:1 |
| 24341: | AC:1 |
| 24342: | AC:1 |
| 24343: | AC:1 |
| 24344: | AC:1 |
| 24345: | AC:1 |
| 24346: | AC:1 |
| 24347: | AC:1 |
| 24348: | AC:1 |
| 24349: | AC:1 |
| 24350: | AC:1 |
| 24351: | AC:1 |
| 24352: | AC:1 |
| 24353: | AC:1 |
| 24354: | AC:1 |
| 24355: | AC:1 |
| 24356: | AC:1 |
| 24357: | AC:1 |
| 24358: | AC:1 |
| 24359: | AC:1 |
| 24360: | AC:1 |
| 24361: | AC:1 |
| 24362: | AC:1 |
| 24363: | AC:1 |
| 24364: | AC:1 |
| 24365: | AC:1 |
| 24366: | AC:1 |
| 24367: | AC:1 |
| 24368: | AC:1 |
| 24369: | AC:1 |
| 24370: | AC:1 |
| 24371: | AC:1 |
| 24372: | AC:1 |
| 24373: | AC:1 |
| 24374: | AC:1 |
| 24375: | AC:1 |
| 24376: | AC:1 |
| 24377: | AC:1 |
| 24378: | AC:1 |
| 24379: | AC:1 |
| 24380: | AC:1 |
| 24381: | AC:1 |
| 24382: | AC:1 |
| 24383: | AC:1 |
| 24384: | AC:1 |
| 24385: | AC:1 |
| 24386: | AC:1 |
| 24387: | AC:1 |
| 24388: | O:1 |
| 24389: | O:1 |
| 24390: | O:1 |
| 24391: | O:1 |
| 24392: | O:1 |
| 24393: | O:1 |
| 24394: | O:1 |
| 24395: | O:1 |
| 24396: | O:1 |
| 24397: | O:1 |
| 24398: | O:1 |
| 24399: | O:1 |
| 24400: | O:1 |
| 24401: | O:1 |
| 24402: | O:1 |
| 24403: | O:1 |
| 24404: | O:1 |
| 24405: | O:1 |
| 24406: | O:1 |
| 24407: | O:1 |
| 24408: | O:1 |
| 24409: | O:1 |
| 24410: | O:1 |
| 24411: | O:1 |
| 24412: | O:1 |
| 24413: | O:1 |
| 24414: | O:1 |
| 24415: | O:1 |
| 24416: | O:1 |
| 24417: | O:1 |
| 24418: | O:1 |
| 24419: | O:1 |
| 24420: | O:1 |
| 24421: | O:1 |
| 24422: | O:1 |
| 24423: | O:1 |
| 24424: | O:1 |
| 24425: | O:1 |
| 24426: | O:1 |
| 24427: | O:1 |
| 24428: | O:1 |
| 24429: | O:1 |
| 24430: | O:1 |
| 24431: | O:1 |
| 24432: | O:1 |
| 24433: | O:1 |
| 24434: | O:1 |
| 24435: | O:1 |
| 24436: | O:1 |
| 24437: | O:1 |
| 24438: | O:1 |
| 24439: | O:1 |
| 24440: | O:1 |
| 24441: | O:1 |
| 24442: | O:1 |
| 24443: | O:1 |

TABLE II-continued

| SEQ ID NO. | Spatial Distribution |
|---|---|
| 24444: | O:1 |
| 24445: | O:1 |
| 24446: | O:1 |
| 24447: | O:1 |
| 24448: | O:1 |
| 24449: | O:1 |
| 24450: | O:1 |
| 24451: | O:1 |
| 24452: | O:1 |
| 24453: | O:1 |
| 24454: | O:1 |
| 24455: | O:1 |
| 24456: | O:1 |
| 24457: | O:1 |
| 24458: | O:1 |
| 24459: | O:1 |
| 24460: | O:1 |
| 24461: | O:1 |
| 24462: | O:1 |
| 24463: | O:1 |
| 24464: | O:1 |
| 24465: | O:1 |
| 24466: | O:1 |
| 24467: | O:1 |
| 24468: | O:1 |
| 24469: | O:1 |
| 24470: | O:1 |
| 24471: | O:1 |
| 24472: | O:1 |
| 24473: | O:1 |
| 24474: | O:1 |
| 24475: | O:1 |
| 24476: | O:1 |
| 24477: | O:1 |
| 24478: | O:1 |
| 24479: | O:1 |
| 24480: | O:1 |
| 24481: | O:1 |
| 24482: | O:1 |
| 24483: | O:1 |
| 24484: | O:1 |
| 24485: | O:1 |
| 24486: | O:1 |
| 24487: | O:1 |
| 24488: | O:1 |
| 24489: | O:1 |
| 24490: | O:1 |
| 24491: | O:1 |
| 24492: | O:1 |
| 24493: | O:1 |
| 24494: | O:1 |
| 24495: | O:1 |
| 24496: | O:1 |
| 24497: | O:1 |
| 24498: | O:1 |
| 24499: | O:1 |
| 24500: | O:1 |
| 24501: | O:1 |
| 24502: | O:1 |
| 24503: | O:1 |
| 24504: | O:1 |
| 24505: | O:1 |
| 24506: | O:1 |
| 24507: | O:1 |
| 24508: | O:1 |
| 24509: | O:1 |
| 24510: | O:1 |
| 24511: | O:1 |
| 24512: | O:1 |
| 24513: | O:1 |
| 24514: | O:1 |
| 24515: | O:1 |
| 24516: | O:1 |
| 24517: | O:1 |
| 24518: | O:1 |
| 24519: | O:1 |
| 24520: | O:1 |
| 24521: | O:1 |
| 24522: | O:1 |
| 24523: | O:1 |
| 24524: | O:1 |
| 24525: | O:1 |
| 24526: | O:1 |
| 24527: | O:1 |
| 24528: | O:1 |
| 24529: | O:1 |
| 24530: | O:1 |
| 24531: | O:1 |
| 24532: | O:1 |
| 24533: | O:1 |
| 24534: | O:1 |
| 24535: | O:1 |
| 24536: | O:1 |
| 24537: | O:1 |
| 24538: | O:1 |
| 24539: | O:1 |
| 24540: | O:1 |
| 24541: | O:1 |
| 24542: | O:1 |
| 24543: | O:1 |
| 24544: | O:1 |
| 24545: | O:1 |
| 24546: | O:1 |
| 24547: | O:1 |
| 24548: | O:1 |
| 24549: | O:1 |
| 24550: | O:1 |
| 24551: | O:1 |
| 24552: | O:1 |
| 24553: | O:1 |
| 24554: | U:1 |
| 24555: | U:1 |
| 24556: | U:1 |
| 24557: | U:1 |
| 24558: | U:1 |
| 24559: | U:1 |
| 24560: | U:1 |
| 24561: | U:1 |
| 24562: | U:1 |
| 24563: | U:1 |
| 24564: | U:1 |
| 24565: | U:1 |
| 24566: | U:1 |
| 24567: | U:1 |
| 24568: | U:1 |
| 24569: | U:1 |
| 24570: | U:1 |
| 24571: | U:1 |
| 24572: | U:1 |
| 24573: | U:1 |
| 24574: | U:1 |
| 24575: | U:1 |
| 24576: | U:1 |
| 24577: | U:1 |
| 24578: | U:1 |
| 24579: | U:1 |
| 24580: | U:1 |
| 24581: | U:1 |
| 24582: | U:1 |
| 24583: | U:1 |
| 24584: | U:1 |
| 24585: | U:1 |
| 24586: | U:1 |
| 24587: | U:1 |
| 24588: | U:1 |
| 24589: | U:1 |
| 24590: | U:1 |
| 24591: | U:1 |
| 24592: | U:1 |
| 24593: | U:1 |
| 24594: | U:1 |
| 24595: | U:1 |
| 24596: | U:1 |
| 24597: | U:1 |

TABLE II-continued

| SEQ ID NO. | Spatial Distribution |
|---|---|
| 24598: | U:1 |
| 24599: | U:1 |
| 24600: | U:1 |
| 24601: | U:1 |
| 24602: | U:1 |
| 24603: | U:1 |
| 24604: | Y:1 |
| 24605: | Y:1 |
| 24606: | Y:1 |
| 24607: | Y:1 |
| 24608: | Y:1 |
| 24609: | Y:1 |
| 24610: | Y:1 |
| 24611: | Y:1 |
| 24612: | Y:1 |
| 24613: | Y:1 |
| 24614: | Y:1 |
| 24615: | Y:1 |
| 24616: | Y:1 |
| 24617: | Y:1 |
| 24618: | Y:1 |
| 24619: | Y:1 |
| 24620: | Y:1 |
| 24621: | Y:1 |
| 24622: | Y:1 |
| 24623: | Y:1 |
| 24624: | Y:1 |
| 24625: | Y:1 |
| 24626: | Y:1 |
| 24627: | Y:1 |
| 24628: | Y:1 |
| 24629: | Y:1 |
| 24630: | Y:1 |
| 24631: | Y:1 |
| 24632: | Y:1 |
| 24633: | Y:1 |
| 24634: | Y:1 |
| 24635: | Y:1 |
| 24636: | Y:1 |
| 24637: | Y:1 |
| 24638: | Y:1 |
| 24639: | Y:1 |
| 24640: | Y:1 |
| 24641: | Y:1 |
| 24642: | Y:1 |
| 24643: | Y:1 |
| 24644: | Y:1 |
| 24645: | Y:1 |
| 24646: | Y:1 |
| 24647: | Y:1 |
| 24648: | Y:1 |
| 24649: | Y:1 |
| 24650: | Y:1 |
| 24651: | Y:1 |
| 24652: | Y:1 |
| 24653: | Y:1 |
| 24654: | Y:1 |
| 24655: | Y:1 |
| 24656: | Y:1 |
| 24657: | Y:1 |
| 24658: | Y:1 |
| 24659: | Y:1 |
| 24660: | Y:1 |
| 24661: | Y:1 |
| 24662: | Y:1 |
| 24663: | Y:1 |
| 24664: | Y:1 |
| 24665: | Y:1 |
| 24666: | Y:1 |
| 24667: | Y:1 |
| 24668: | Y:1 |
| 24669: | Y:1 |
| 24670: | Y:1 |
| 24671: | Y:1 |
| 24672: | Y:1 |
| 24673: | Y:1 |
| 24674: | Y:1 |
| 24675: | Y:1 |
| 24676: | Y:1 |
| 24677: | Y:1 |
| 24678: | Y:1 |
| 24679: | Y:1 |
| 24680: | Y:1 |
| 24681: | Y:1 |
| 24682: | Y:1 |
| 24683: | Y:1 |
| 24684: | Y:1 |
| 24685: | Y:1 |
| 24686: | Y:1 |
| 24687: | Y:1 |
| 24688: | Y:1 |
| 24689: | Y:1 |
| 24690: | Y:1 |
| 24691: | Y:1 |
| 24692: | Y:1 |
| 24693: | Y:1 |
| 24694: | Y:1 |
| 24695: | Y:1 |
| 24696: | Y:1 |
| 24697: | Y:1 |
| 24698: | Y:1 |
| 24699: | Y:1 |
| 24700: | Y:1 |
| 24701: | Y:1 |
| 24702: | Y:1 |
| 24703: | Y:1 |
| 24704: | Y:1 |
| 24705: | Y:1 |
| 24706: | Y:1 |
| 24707: | Y:1 |
| 24708: | Y:1 |
| 24709: | Y:1 |
| 24710: | Y:1 |
| 24711: | Y:1 |
| 24712: | Y:1 |
| 24713: | Y:1 |
| 24714: | Y:1 |
| 24715: | Y:1 |
| 24716: | Y:1 |
| 24717: | Y:1 |
| 24718: | Y:1 |
| 24719: | Y:1 |
| 24720: | Y:1 |
| 24721: | Y:1 |
| 24722: | Y:1 |
| 24723: | Y:1 |
| 24724: | Y:1 |
| 24725: | Y:1 |
| 24726: | Y:1 |
| 24727: | Y:1 |
| 24728: | Y:1 |
| 24729: | Y:1 |
| 24730: | Y:1 |
| 24731: | Y:1 |
| 24732: | Y:1 |
| 24733: | Y:1 |
| 24734: | Y:1 |
| 24735: | Y:1 |
| 24736: | Y:1 |
| 24737: | Y:1 |
| 24738: | Y:1 |
| 24739: | Y:1 |
| 24740: | Y:1 |
| 24741: | Y:1 |
| 24742: | Y:1 |
| 24743: | Y:1 |
| 24744: | Y:1 |
| 24745: | Y:1 |
| 24746: | Y:1 |
| 24747: | Y:1 |
| 24748: | Y:1 |
| 24749: | Y:1 |
| 24750: | Y:1 |
| 24751: | Y:1 |

TABLE II-continued

| SEQ ID NO. | Spatial Distribution |
|---|---|
| 24752: | Y:1 |
| 24753: | Y:1 |
| 24754: | Y:1 |
| 24755: | Y:1 |
| 24756: | Y:1 |
| 24757: | Y:1 |
| 24758: | Y:1 |
| 24759: | Y:1 |
| 24760: | Y:1 |
| 24761: | Y:1 |
| 24762: | Y:1 |
| 24763: | Y:1 |
| 24764: | Y:1 |
| 24765: | Y:1 |
| 24766: | Y:1 |
| 24767: | Y:1 |
| 24768: | Y:1 |
| 24769: | Y:1 |
| 24770: | Y:1 |
| 24771: | Y:1 |
| 24772: | Y:1 |
| 24773: | Y:1 |
| 24774: | Y:1 |
| 24775: | Y:1 |
| 24776: | Y:1 |
| 24777: | Y:1 |
| 24778: | Y:1 |
| 24779: | Y:1 |
| 24780: | Y:1 |
| 24781: | Y:1 |
| 24782: | Y:1 |
| 24783: | Y:1 |
| 24784: | Y:1 |
| 24785: | Y:1 |
| 24786: | Y:1 |
| 24787: | Y:1 |
| 24788: | Y:1 |
| 24789: | Y:1 |
| 24790: | Y:1 |
| 24791: | Y:1 |
| 24792: | Y:1 |
| 24793: | Y:1 |
| 24794: | Y:1 |
| 24795: | Y:1 |
| 24796: | Y:1 |
| 24797: | Y:1 |
| 24798: | Y:1 |
| 24799: | Y:1 |
| 24800: | Y:1 |
| 24801: | Y:1 |
| 24802: | Y:1 |
| 24803: | Y:1 |
| 24804: | Y:1 |
| 24805: | Y:1 |
| 24806: | Y:1 |
| 24807: | Y:1 |
| 24808: | Y:1 |
| 24809: | Y:1 |
| 24810: | Y:1 |
| 24811: | Y:1 |
| 24812: | Y:1 |
| 24813: | Y:1 |
| 24814: | Y:1 |
| 24815: | Y:1 |
| 24816: | Y:1 |
| 24817: | Y:1 |
| 24818: | Y:1 |
| 24819: | Y:1 |
| 24820: | Y:1 |
| 24821: | Y:1 |
| 24822: | Y:1 |
| 24823: | Y:1 |
| 24824: | Y:1 |
| 24825: | Y:1 |
| 24826: | Y:1 |
| 24827: | Y:1 |
| 24828: | Y:1 |
| 24829: | Y:1 |
| 24830: | Y:1 |
| 24831: | Y:1 |
| 24832: | Y:1 |
| 24833: | Y:1 |
| 24834: | Y:1 |
| 24835: | Y:1 |
| 24836: | Y:1 |
| 24837: | Y:1 |
| 24838: | Y:1 |
| 24839: | Y:1 |
| 24840: | Y:1 |
| 24841: | Y:1 |
| 24842: | Y:1 |
| 24843: | Y:1 |
| 24844: | Y:1 |
| 24845: | Y:1 |
| 24846: | Y:1 |
| 24847: | Y:1 |
| 24848: | Y:1 |
| 24849: | Y:1 |
| 24850: | Y:1 |
| 24851: | Y:1 |
| 24852: | Y:1 |
| 24853: | Y:1 |
| 24854: | Y:1 |
| 24855: | Y:1 |
| 24856: | Y:1 |
| 24857: | Y:1 |
| 24858: | Y:1 |
| 24859: | Y:1 |
| 24860: | Y:1 |
| 24861: | Y:1 |
| 24862: | Y:1 |
| 24863: | Y:1 |
| 24864: | Y:1 |
| 24865: | Y:1 |
| 24866: | Y:1 |
| 24867: | Y:1 |
| 24868: | Y:1 |
| 24869: | Y:1 |
| 24870: | Y:1 |
| 24871: | Y:1 |
| 24872: | Y:1 |
| 24873: | Y:1 |
| 24874: | Y:1 |
| 24875: | Y:1 |
| 24876: | Y:1 |
| 24877: | Y:1 |
| 24878: | Y:1 |
| 24879: | Y:1 |
| 24880: | Y:1 |
| 24881: | Y:1 |
| 24882: | Y:1 |
| 24883: | Y:1 |
| 24884: | Y:1 |
| 24885: | Y:1 |
| 24886: | Y:1 |
| 24887: | Y:1 |
| 24888: | Y:1 |
| 24889: | Y:1 |
| 24890: | Y:1 |
| 24891: | Y:1 |
| 24892: | Y:1 |
| 24893: | Y:1 |
| 24894: | Y:1 |
| 24895: | Y:1 |
| 24896: | Y:1 |
| 24897: | Y:1 |
| 24898: | Y:1 |
| 24899: | Y:1 |
| 24900: | Y:1 |
| 24901: | Y:1 |
| 24902: | Y:1 |
| 24903: | Y:1 |
| 24904: | Y:1 |
| 24905: | Y:1 |

TABLE II-continued

| SEQ ID NO. | Spatial Distribution |
|---|---|
| 24906: | Y:1 |
| 24907: | Y:1 |
| 24908: | Y:1 |
| 24909: | Y:1 |
| 24910: | Y:1 |
| 24911: | Y:1 |
| 24912: | Y:1 |
| 24913: | Y:1 |
| 24914: | Y:1 |
| 24915: | Y:1 |
| 24916: | Y:1 |
| 24917: | Y:1 |
| 24918: | Y:1 |
| 24919: | Y:1 |
| 24920: | Y:1 |
| 24921: | Y:1 |
| 24922: | Y:1 |
| 24923: | Y:1 |
| 24924: | Y:1 |
| 24925: | Y:1 |
| 24926: | Y:1 |
| 24927: | Y:1 |
| 24928: | Y:1 |
| 24929: | Y:1 |
| 24930: | Y:1 |
| 24931: | Y:1 |
| 24932: | Y:1 |
| 24933: | Y:1 |
| 24934: | Y:1 |
| 24935: | Y:1 |
| 24936: | Y:1 |
| 24937: | Y:1 |
| 24938: | Y:1 |
| 24939: | Y:1 |
| 24940: | Y:1 |
| 24941: | Y:1 |
| 24942: | Y:1 |
| 24943: | Y:1 |
| 24944: | Y:1 |
| 24945: | Y:1 |
| 24946: | Y:1 |
| 24947: | Y:1 |
| 24948: | Y:1 |
| 24949: | Y:1 |
| 24950: | Y:1 |
| 24951: | Y:1 |
| 24952: | Y:1 |
| 24953: | Y:1 |
| 24954: | Y:1 |
| 24955: | Y:1 |
| 24956: | Y:1 |
| 24957: | Y:1 |
| 24958: | Y:1 |
| 24959: | Y:1 |
| 24960: | Y:1 |
| 24961: | Y:1 |
| 24962: | Y:1 |
| 24963: | Y:1 |
| 24964: | Y:1 |
| 24965: | Y:1 |
| 24966: | Y:1 |
| 24967: | Y:1 |
| 24968: | Y:1 |
| 24969: | Y:1 |
| 24970: | Y:1 |
| 24971: | Y:1 |
| 24972: | Y:1 |
| 24973: | Y:1 |
| 24974: | Y:1 |
| 24975: | Y:1 |
| 24976: | Y:1 |
| 24977: | Y:1 |
| 24978: | Y:1 |
| 24979: | Y:1 |
| 24980: | Y:1 |
| 24981: | Y:1 |
| 24982: | Y:1 |
| 24983: | Y:1 |
| 24984: | Y:1 |
| 24985: | Y:1 |
| 24986: | Y:1 |
| 24987: | Y:1 |
| 24988: | Y:1 |
| 24989: | Y:1 |
| 24990: | Y:1 |
| 24991: | Y:1 |
| 24992: | Y:1 |
| 24993: | Y:1 |
| 24994: | Y:1 |
| 24995: | Y:1 |
| 24996: | Y:1 |
| 24997: | Y:1 |
| 24998: | Y:1 |
| 24999: | Y:1 |
| 25000: | Y:1 |
| 25001: | Y:1 |
| 25002: | Y:1 |
| 25003: | Y:1 |
| 25004: | Y:1 |
| 25005: | Y:1 |
| 25006: | Y:1 |
| 25007: | Y:1 |
| 25008: | Y:1 |
| 25009: | Y:1 |
| 25010: | Y:1 |
| 25011: | Y:1 |
| 25012: | Y:1 |
| 25013: | Y:1 |
| 25014: | Y:1 |
| 25015: | Y:1 |
| 25016: | Y:1 |
| 25017: | Y:1 |
| 25018: | Y:1 |
| 25019: | Y:1 |
| 25020: | Y:1 |
| 25021: | Y:1 |
| 25022: | Y:1 |
| 25023: | Y:1 |
| 25024: | Y:1 |
| 25025: | Y:1 |
| 25026: | Y:1 |
| 25027: | Y:1 |
| 25028: | Y:1 |
| 25029: | Y:1 |
| 25030: | Y:1 |
| 25031: | Y:1 |
| 25032: | Y:1 |
| 25033: | Y:1 |
| 25034: | Y:1 |
| 25035: | Y:1 |
| 25036: | Y:1 |
| 25037: | Y:1 |
| 25038: | Y:1 |
| 25039: | Y:1 |
| 25040: | Y:1 |
| 25041: | Y:1 |
| 25042: | Y:1 |
| 25043: | Y:1 |
| 25044: | Y:1 |
| 25045: | Y:1 |
| 25046: | Y:1 |
| 25047: | Y:1 |
| 25048: | Y:1 |
| 25049: | Y:1 |
| 25050: | Y:1 |
| 25051: | Y:1 |
| 25052: | Y:1 |
| 25053: | Y:1 |
| 25054: | Y:1 |
| 25055: | Y:1 |
| 25056: | Y:1 |
| 25057: | Y:1 |
| 25058: | Y:1 |
| 25059: | Y:1 |

TABLE II-continued

| SEQ ID NO. | Spatial Distribution |
|---|---|
| 25060: | Y:1 |
| 25061: | Y:1 |
| 25062: | Y:1 |
| 25063: | Y:1 |
| 25064: | Y:1 |
| 25065: | Y:1 |
| 25066: | Y:1 |
| 25067: | Y:1 |
| 25068: | Y:1 |
| 25069: | Y:1 |
| 25070: | Y:1 |
| 25071: | Y:1 |
| 25072: | Y:1 |
| 25073: | Y:1 |
| 25074: | Y:1 |
| 25075: | Y:1 |
| 25076: | Y:1 |
| 25077: | Y:1 |
| 25078: | Y:1 |
| 25079: | Y:1 |
| 25080: | Y:1 |
| 25081: | Y:1 |
| 25082: | Y:1 |
| 25083: | Y:1 |
| 25084: | Y:1 |
| 25085: | Y:1 |
| 25086: | Y:1 |
| 25087: | Y:1 |
| 25088: | Y:1 |
| 25089: | Y:1 |
| 25090: | Y:1 |
| 25091: | Y:1 |
| 25092: | Y:1 |
| 25093: | Y:1 |
| 25094: | Y:1 |
| 25095: | Y:1 |
| 25096: | Y:1 |
| 25097: | Y:1 |
| 25098: | Y:1 |
| 25099: | Y:1 |
| 25100: | Y:1 |
| 25101: | Y:1 |
| 25102: | Y:1 |
| 25103: | Y:1 |
| 25104: | Y:1 |
| 25105: | Y:1 |
| 25106: | Y:1 |
| 25107: | Y:1 |
| 25108: | Y:1 |
| 25109: | Y:1 |
| 25110: | Y:1 |
| 25111: | Y:1 |
| 25112: | Y:1 |
| 25113: | Y:1 |
| 25114: | Y:1 |
| 25115: | Y:1 |
| 25116: | Y:1 |
| 25117: | Y:1 |
| 25118: | Y:1 |
| 25119: | Y:1 |
| 25120: | Y:1 |
| 25121: | Y:1 |
| 25122: | Y:1 |
| 25123: | Y:1 |
| 25124: | Y:1 |
| 25125: | Y:1 |
| 25126: | Y:1 |
| 25127: | Y:1 |
| 25128: | Y:1 |
| 25129: | Y:1 |
| 25130: | Y:1 |
| 25131: | Y:1 |
| 25132: | Y:1 |
| 25133: | Y:1 |
| 25134: | Y:1 |
| 25135: | Y:1 |
| 25136: | Y:1 |
| 25137: | Y:1 |
| 25138: | Y:1 |
| 25139: | Y:1 |
| 25140: | Y:1 |
| 25141: | Y:1 |
| 25142: | Y:1 |
| 25143: | Y:1 |
| 25144: | Y:1 |
| 25145: | Y:1 |
| 25146: | Y:1 |
| 25147: | Y:1 |
| 25148: | Y:1 |
| 25149: | Y:1 |
| 25150: | Y:1 |
| 25151: | Y:1 |
| 25152: | Y:1 |
| 25153: | Y:1 |
| 25154: | Y:1 |
| 25155: | Y:1 |
| 25156: | Y:1 |
| 25157: | Y:1 |
| 25158: | Y:1 |
| 25159: | Y:1 |
| 25160: | Y:1 |
| 25161: | Y:1 |
| 25162: | Y:1 |
| 25163: | Y:1 |
| 25164: | Y:1 |
| 25165: | Y:1 |
| 25166: | Y:1 |
| 25167: | Y:1 |
| 25168: | Y:1 |
| 25169: | Y:1 |
| 25170: | Y:1 |
| 25171: | Y:1 |
| 25172: | Y:1 |
| 25173: | Y:1 |
| 25174: | Y:1 |
| 25175: | Y:1 |
| 25176: | Y:1 |
| 25177: | Y:1 |
| 25178: | Y:1 |
| 25179: | Y:1 |
| 25180: | Y:1 |
| 25181: | Y:1 |
| 25182: | Y:1 |
| 25183: | Y:1 |
| 25184: | Y:1 |
| 25185: | Y:1 |
| 25186: | Y:1 |
| 25187: | Y:1 |
| 25188: | Y:1 |
| 25189: | Y:1 |
| 25190: | Y:1 |
| 25191: | Y:1 |
| 25192: | Y:1 |
| 25193: | Y:1 |
| 25194: | Y:1 |
| 25195: | Y:1 |
| 25196: | Y:1 |
| 25197: | Y:1 |
| 25198: | Y:1 |
| 25199: | Y:1 |
| 25200: | Y:1 |
| 25201: | Y:1 |
| 25202: | Y:1 |
| 25203: | Y:1 |
| 25204: | Y:1 |
| 25205: | Y:1 |
| 25206: | Y:1 |
| 25207: | Y:1 |
| 25208: | Y:1 |
| 25209: | Y:1 |
| 25210: | Y:1 |
| 25211: | Y:1 |
| 25212: | Y:1 |
| 25213: | Y:1 |

TABLE II-continued

| SEQ ID NO. | Spatial Distribution |
|---|---|
| 25214: | Y:1 |
| 25215: | Y:1 |
| 25216: | Y:1 |
| 25217: | Y:1 |
| 25218: | Y:1 |
| 25219: | Y:1 |
| 25220: | Y:1 |
| 25221: | Y:1 |
| 25222: | Y:1 |
| 25223: | Y:1 |
| 25224: | Y:1 |
| 25225: | Y:1 |
| 25226: | Y:1 |
| 25227: | Y:1 |
| 25228: | Y:1 |
| 25229: | Y:1 |
| 25230: | Y:1 |
| 25231: | Y:1 |
| 25232: | Y:1 |
| 25233: | Y:1 |
| 25234: | Y:1 |
| 25235: | Y:1 |
| 25236: | Y:1 |
| 25237: | Y:1 |
| 25238: | Y:1 |
| 25239: | Y:1 |
| 25240: | Y:1 |
| 25241: | Y:1 |
| 25242: | Y:1 |
| 25243: | Y:1 |
| 25244: | Y:1 |
| 25245: | Y:1 |
| 25246: | Y:1 |
| 25247: | Y:1 |
| 25248: | Y:1 |
| 25249: | Y:1 |
| 25250: | Y:1 |
| 25251: | Y:1 |
| 25252: | Y:1 |
| 25253: | Y:1 |
| 25254: | Y:1 |
| 25255: | Y:1 |
| 25256: | Y:1 |
| 25257: | Y:1 |
| 25258: | Y:1 |
| 25259: | Y:1 |
| 25260: | Y:1 |
| 25261: | Y:1 |
| 25262: | Y:1 |
| 25263: | Y:1 |
| 25264: | Y:1 |
| 25265: | Y:1 |
| 25266: | Y:1 |
| 25267: | Y:1 |
| 25268: | Y:1 |
| 25269: | Y:1 |
| 25270: | Y:1 |
| 25271: | Y:1 |
| 25272: | Y:1 |
| 25273: | Y:1 |
| 25274: | Y:1 |
| 25275: | Y:1 |
| 25276: | Y:1 |
| 25277: | Y:1 |
| 25278: | Y:1 |
| 25279: | Y:1 |
| 25280: | Y:1 |
| 25281: | Y:1 |
| 25282: | Y:1 |
| 25283: | Y:1 |
| 25284: | Y:1 |
| 25285: | Y:1 |
| 25286: | Y:1 |
| 25287: | Y:1 |
| 25288: | Y:1 |
| 25289: | Y:1 |
| 25290: | Y:1 |
| 25291: | Y:1 |
| 25292: | Y:1 |
| 25293: | Y:1 |
| 25294: | Y:1 |
| 25295: | Y:1 |
| 25296: | Y:1 |
| 25297: | Y:1 |
| 25298: | Y:1 |
| 25299: | Y:1 |
| 25300: | Y:1 |
| 25301: | Y:1 |
| 25302: | Y:1 |
| 25303: | Y:1 |
| 25304: | Y:1 |
| 25305: | Y:1 |
| 25306: | Y:1 |
| 25307: | Y:1 |
| 25308: | Y:1 |
| 25309: | Y:1 |
| 25310: | Y:1 |
| 25311: | Y:1 |
| 25312: | Y:1 |
| 25313: | Y:1 |
| 25314: | Y:1 |
| 25315: | Y:1 |
| 25316: | Y:1 |
| 25317: | Y:1 |
| 25318: | Y:1 |
| 25319: | Y:1 |
| 25320: | Y:1 |
| 25321: | Y:1 |
| 25322: | Y:1 |
| 25323: | Y:1 |
| 25324: | Y:1 |
| 25325: | Y:1 |
| 25326: | Y:1 |
| 25327: | Y:1 |
| 25328: | Y:1 |
| 25329: | Y:1 |
| 25330: | Y:1 |
| 25331: | Y:1 |
| 25332: | Y:1 |
| 25333: | Y:1 |
| 25334: | Y:1 |
| 25335: | Y:1 |
| 25336: | Y:1 |
| 25337: | Y:1 |
| 25338: | Y:1 |
| 25339: | Y:1 |
| 25340: | Y:1 |
| 25341: | Y:1 |
| 25342: | Y:1 |
| 25343: | Y:1 |
| 25344: | Y:1 |
| 25345: | Y:1 |
| 25346: | Y:1 |
| 25347: | Y:1 |
| 25348: | Y:1 |
| 25349: | Y:1 |
| 25350: | Y:1 |
| 25351: | Y:1 |
| 25352: | Y:1 |
| 25353: | Y:1 |
| 25354: | Y:1 |
| 25355: | Y:1 |
| 25356: | Y:1 |
| 25357: | Y:1 |
| 25358: | Y:1 |
| 25359: | Y:1 |
| 25360: | Y:1 |
| 25361: | Y:1 |
| 25362: | Y:1 |
| 25363: | Y:1 |
| 25364: | Y:1 |
| 25365: | Y:1 |
| 25366: | Y:1 |
| 25367: | Y:1 |

TABLE II-continued

| SEQ ID NO. | Spatial Distribution |
|---|---|
| 25368: | Y:1 |
| 25369: | Y:1 |
| 25370: | Y:1 |
| 25371: | Y:1 |
| 25372: | Y:1 |
| 25373: | Y:1 |
| 25374: | Y:1 |
| 25375: | Y:1 |
| 25376: | Y:1 |
| 25377: | Y:1 |
| 25378: | Y:1 |
| 25379: | Y:1 |
| 25380: | Y:1 |
| 25381: | Y:1 |
| 25382: | Y:1 |
| 25383: | Y:1 |
| 25384: | Y:1 |
| 25385: | Y:1 |
| 25386: | Y:1 |
| 25387: | Y:1 |
| 25388: | Y:1 |
| 25389: | Y:1 |
| 25390: | Y:1 |
| 25391: | Y:1 |
| 25392: | Y:1 |
| 25393: | Y:1 |
| 25394: | Y:1 |
| 25395: | Y:1 |
| 25396: | Y:1 |
| 25397: | Y:1 |
| 25398: | Y:1 |
| 25399: | Y:1 |
| 25400: | Y:1 |
| 25401: | Y:1 |
| 25402: | Y:1 |
| 25403: | Y:1 |
| 25404: | Y:1 |
| 25405: | Y:1 |
| 25406: | Y:1 |
| 25407: | Y:1 |
| 25408: | Y:1 |
| 25409: | Y:1 |
| 25410: | Y:1 |
| 25411: | Y:1 |
| 25412: | Y:1 |
| 25413: | Y:1 |
| 25414: | Y:1 |
| 25415: | Y:1 |
| 25416: | Y:1 |
| 25417: | Y:1 |
| 25418: | Y:1 |
| 25419: | Y:1 |
| 25420: | Y:1 |
| 25421: | Y:1 |
| 25422: | Y:1 |
| 25423: | Y:1 |
| 25424: | Y:1 |
| 25425: | Y:1 |
| 25426: | Y:1 |
| 25427: | Y:1 |
| 25428: | Y:1 |
| 25429: | Y:1 |
| 25430: | Y:1 |
| 25431: | Y:1 |
| 25432: | Y:1 |
| 25433: | Y:1 |
| 25434: | Y:1 |
| 25435: | Y:1 |
| 25436: | Y:1 |
| 25437: | Y:1 |
| 25438: | Y:1 |
| 25439: | Y:1 |
| 25440: | Y:1 |
| 25441: | Y:1 |
| 25442: | Y:1 |
| 25443: | Y:1 |
| 25444: | Y:1 |
| 25445: | Y:1 |
| 25446: | Y:1 |
| 25447: | Y:1 |
| 25448: | Y:1 |
| 25449: | Y:1 |
| 25450: | Y:1 |
| 25451: | Y:1 |
| 25452: | Y:1 |
| 25453: | Y:1 |
| 25454: | Y:1 |
| 25455: | Y:1 |
| 25456: | Y:1 |
| 25457: | Y:1 |
| 25458: | Y:1 |
| 25459: | Y:1 |
| 25460: | Y:1 |
| 25461: | Y:1 |
| 25462: | Y:1 |
| 25463: | Y:1 |
| 25464: | Y:1 |
| 25465: | Y:1 |
| 25466: | Y:1 |
| 25467: | Y:1 |
| 25468: | Y:1 |
| 25469: | Y:1 |
| 25470: | Y:1 |
| 25471: | Y:1 |
| 25472: | Y:1 |
| 25473: | Y:1 |
| 25474: | Y:1 |
| 25475: | Y:1 |
| 25476: | Y:1 |
| 25477: | Y:1 |
| 25478: | Y:1 |
| 25479: | Y:1 |
| 25480: | Y:1 |
| 25481: | Y:1 |
| 25482: | Y:1 |
| 25483: | Y:1 |
| 25484: | Y:1 |
| 25485: | Y:1 |
| 25486: | Y:1 |
| 25487: | Y:1 |
| 25488: | Y:1 |
| 25489: | Y:1 |
| 25490: | Y:1 |
| 25491: | Y:1 |
| 25492: | Y:1 |
| 25493: | Y:1 |
| 25494: | Y:1 |
| 25495: | Y:1 |
| 25496: | Y:1 |
| 25497: | Y:1 |
| 25498: | Y:1 |
| 25499: | Y:1 |
| 25500: | P:1 |
| 25501: | P:1 |
| 25502: | P:1 |
| 25503: | P:1 |
| 25504: | P:1 |
| 25505: | P:1 |
| 25506: | P:1 |
| 25507: | P:1 |
| 25508: | P:1 |
| 25509: | P:1 |
| 25510: | P:1 |
| 25511: | P:1 |
| 25512: | P:1 |
| 25513: | P:1 |
| 25514: | P:1 |
| 25515: | P:1 |
| 25516: | P:1 |
| 25517: | P:1 |
| 25518: | P:1 |
| 25519: | P:1 |
| 25520: | P:1 |
| 25521: | P:1 |

TABLE II-continued

| SEQ ID NO. | Spatial Distribution |
|---|---|
| 25522: | P:1 |
| 25523: | P:1 |
| 25524: | P:1 |
| 25525: | P:1 |
| 25526: | P:1 |
| 25527: | P:1 |
| 25528: | P:1 |
| 25529: | P:1 |
| 25530: | P:1 |
| 25531: | P:1 |
| 25532: | P:1 |
| 25533: | P:1 |
| 25534: | P:1 |
| 25535: | P:1 |
| 25536: | P:1 |
| 25537: | P:1 |
| 25538: | P:1 |
| 25539: | P:1 |
| 25540: | P:1 |
| 25541: | P:1 |
| 25542: | P:1 |
| 25543: | P:1 |
| 25544: | P:1 |
| 25545: | P:1 |
| 25546: | P:1 |
| 25547: | P:1 |
| 25548: | P:1 |
| 25549: | P:1 |
| 25550: | P:1 |
| 25551: | P:1 |
| 25552: | P:1 |
| 25553: | P:1 |
| 25554: | P:1 |
| 25555: | P:1 |
| 25556: | P:1 |
| 25557: | P:1 |
| 25558: | P:1 |
| 25559: | P:1 |
| 25560: | P:1 |
| 25561: | P:1 |
| 25562: | P:1 |
| 25563: | P:1 |
| 25564: | P:1 |
| 25565: | P:1 |
| 25566: | P:1 |
| 25567: | P:1 |
| 25568: | P:1 |
| 25569: | P:1 |
| 25570: | P:1 |
| 25571: | P:1 |
| 25572: | P:1 |
| 25573: | P:1 |
| 25574: | P:1 |
| 25575: | P:1 |
| 25576: | P:1 |
| 25577: | P:1 |
| 25578: | P:1 |
| 25579: | P:1 |
| 25580: | P:1 |
| 25581: | P:1 |
| 25582: | P:1 |
| 25583: | P:1 |
| 25584: | P:1 |
| 25585: | P:1 |
| 25586: | P:1 |
| 25587: | P:1 |
| 25588: | P:1 |
| 25589: | P:1 |
| 25590: | P:1 |
| 25591: | P:1 |
| 25592: | P:1 |
| 25593: | P:1 |
| 25594: | P:1 |
| 25595: | P:1 |
| 25596: | P:1 |
| 25597: | P:1 |
| 25598: | P:1 |
| 25599: | P:1 |
| 25600: | P:1 |
| 25601: | P:1 |
| 25602: | P:1 |
| 25603: | P:1 |
| 25604: | P:1 |
| 25605: | P:1 |
| 25606: | P:1 |
| 25607: | P:1 |
| 25608: | P:1 |
| 25609: | P:1 |
| 25610: | P:1 |
| 25611: | P:1 |
| 25612: | P:1 |
| 25613: | P:1 |
| 25614: | P:1 |
| 25615: | P:1 |
| 25616: | P:1 |
| 25617: | P:1 |
| 25618: | P:1 |
| 25619: | P:1 |
| 25620: | P:1 |
| 25621: | P:1 |
| 25622: | P:1 |
| 25623: | P:1 |
| 25624: | P:1 |
| 25625: | P:1 |
| 25626: | P:1 |
| 25627: | P:1 |
| 25628: | P:1 |
| 25629: | P:1 |
| 25630: | P:1 |
| 25631: | P:1 |
| 25632: | P:1 |
| 25633: | P:1 |
| 25634: | P:1 |
| 25635: | P:1 |
| 25636: | P:1 |
| 25637: | P:1 |
| 25638: | P:1 |
| 25639: | P:1 |
| 25640: | P:1 |
| 25641: | P:1 |
| 25642: | P:1 |
| 25643: | P:1 |
| 25644: | P:1 |
| 25645: | P:1 |
| 25646: | P:1 |
| 25647: | P:1 |
| 25648: | P:1 |
| 25649: | P:1 |
| 25650: | P:1 |
| 25651: | P:1 |
| 25652: | P:1 |
| 25653: | P:1 |
| 25654: | P:1 |
| 25655: | P:1 |
| 25656: | P:1 |
| 25657: | P:1 |
| 25658: | P:1 |
| 25659: | P:1 |
| 25660: | P:1 |
| 25661: | P:1 |
| 25662: | P:1 |
| 25663: | P:1 |
| 25664: | P:1 |
| 25665: | P:1 |
| 25666: | P:1 |
| 25667: | P:1 |
| 25668: | P:1 |
| 25669: | P:1 |
| 25670: | P:1 |
| 25671: | P:1 |
| 25672: | P:1 |
| 25673: | P:1 |
| 25674: | P:1 |
| 25675: | P:1 |

TABLE II-continued

| SEQ ID NO. | Spatial Distribution |
|---|---|
| 25676: | P:1 |
| 25677: | P:1 |
| 25678: | P:1 |
| 25679: | P:1 |
| 25680: | P:1 |
| 25681: | P:1 |
| 25682: | P:1 |
| 25683: | P:1 |
| 25684: | P:1 |
| 25685: | P:1 |
| 25686: | P:1 |
| 25687: | P:1 |
| 25688: | P:1 |
| 25689: | P:1 |
| 25690: | P:1 |
| 25691: | P:1 |
| 25692: | P:1 |
| 25693: | P:1 |
| 25694: | P:1 |
| 25695: | P:1 |
| 25696: | P:1 |
| 25697: | P:1 |
| 25698: | P:1 |
| 25699: | P:1 |
| 25700: | P:1 |
| 25701: | P:1 |
| 25702: | P:1 |
| 25703: | P:1 |
| 25704: | P:1 |
| 25705: | P:1 |
| 25706: | P:1 |
| 25707: | P:1 |
| 25708: | P:1 |
| 25709: | P:1 |
| 25710: | P:1 |
| 25711: | P:1 |
| 25712: | P:1 |
| 25713: | P:1 |
| 25714: | P:1 |
| 25715: | P:1 |
| 25716: | P:1 |
| 25717: | P:1 |
| 25718: | P:1 |
| 25719: | P:1 |
| 25720: | P:1 |
| 25721: | P:1 |
| 25722: | P:1 |
| 25723: | P:1 |
| 25724: | P:1 |
| 25725: | P:1 |
| 25726: | P:1 |
| 25727: | P:1 |
| 25728: | P:1 |
| 25729: | P:1 |
| 25730: | P:1 |
| 25731: | P:1 |
| 25732: | P:1 |
| 25733: | P:1 |
| 25734: | P:1 |
| 25735: | P:1 |
| 25736: | P:1 |
| 25737: | P:1 |
| 25738: | P:1 |
| 25739: | P:1 |
| 25740: | P:1 |
| 25741: | P:1 |
| 25742: | P:1 |
| 25743: | P:1 |
| 25744: | P:1 |
| 25745: | P:1 |
| 25746: | P:1 |
| 25747: | P:1 |
| 25748: | P:1 |
| 25749: | P:1 |
| 25750: | P:1 |
| 25751: | P:1 |
| 25752: | P:1 |
| 25753: | P:1 |
| 25754: | P:1 |
| 25755: | P:1 |
| 25756: | P:1 |
| 25757: | P:1 |
| 25758: | P:1 |
| 25759: | P:1 |
| 25760: | P:1 |
| 25761: | P:1 |
| 25762: | P:1 |
| 25763: | P:1 |
| 25764: | P:1 |
| 25765: | P:1 |
| 25766: | P:1 |
| 25767: | P:1 |
| 25768: | P:1 |
| 25769: | P:1 |
| 25770: | P:1 |
| 25771: | P:1 |
| 25772: | P:1 |
| 25773: | P:1 |
| 25774: | P:1 |
| 25775: | P:1 |
| 25776: | P:1 |
| 25777: | P:1 |
| 25778: | P:1 |
| 25779: | P:1 |
| 25780: | P:1 |
| 25781: | P:1 |
| 25782: | P:1 |
| 25783: | P:1 |
| 25784: | P:1 |
| 25785: | P:1 |
| 25786: | P:1 |
| 25787: | P:1 |
| 25788: | P:1 |
| 25789: | P:1 |
| 25790: | P:1 |
| 25791: | P:1 |
| 25792: | P:1 |
| 25793: | P:1 |
| 25794: | P:1 |
| 25795: | P:1 |
| 25796: | P:1 |
| 25797: | P:1 |
| 25798: | P:1 |
| 25799: | P:1 |
| 25800: | P:1 |
| 25801: | P:1 |
| 25802: | P:1 |
| 25803: | P:1 |
| 25804: | P:1 |
| 25805: | P:1 |
| 25806: | P:1 |
| 25807: | P:1 |
| 25808: | P:1 |
| 25809: | P:1 |
| 25810: | P:1 |
| 25811: | P:1 |
| 25812: | P:1 |
| 25813: | P:1 |
| 25814: | P:1 |
| 25815: | P:1 |
| 25816: | P:1 |
| 25817: | P:1 |
| 25818: | P:1 |
| 25819: | P:1 |
| 25820: | P:1 |
| 25821: | P:1 |
| 25822: | P:1 |
| 25823: | P:1 |
| 25824: | P:1 |
| 25825: | P:1 |
| 25826: | P:1 |
| 25827: | P:1 |
| 25828: | P:1 |
| 25829: | P:1 |

TABLE II-continued

| SEQ ID NO. | Spatial Distribution |
|---|---|
| 25830: | P:1 |
| 25831: | P:1 |
| 25832: | P:1 |
| 25833: | P:1 |
| 25834: | P:1 |
| 25835: | P:1 |
| 25836: | P:1 |
| 25837: | P:1 |
| 25838: | P:1 |
| 25839: | P:1 |
| 25840: | P:1 |
| 25841: | P:1 |
| 25842: | P:1 |
| 25843: | P:1 |
| 25844: | P:1 |
| 25845: | P:1 |
| 25846: | P:1 |
| 25847: | P:1 |
| 25848: | P:1 |
| 25849: | P:1 |
| 25850: | P:1 |
| 25851: | P:1 |
| 25852: | P:1 |
| 25853: | P:1 |
| 25854: | P:1 |
| 25855: | P:1 |
| 25856: | P:1 |
| 25857: | P:1 |
| 25858: | P:1 |
| 25859: | P:1 |
| 25860: | P:1 |
| 25861: | P:1 |
| 25862: | P:1 |
| 25863: | P:1 |
| 25864: | P:1 |
| 25865: | P:1 |
| 25866: | P:1 |
| 25867: | P:1 |
| 25868: | P:1 |
| 25869: | P:1 |
| 25870: | P:1 |
| 25871: | P:1 |
| 25872: | P:1 |
| 25873: | P:1 |
| 25874: | P:1 |
| 25875: | P:1 |
| 25876: | P:1 |
| 25877: | P:1 |
| 25878: | P:1 |
| 25879: | P:1 |
| 25880: | P:1 |
| 25881: | P:1 |
| 25882: | P:1 |
| 25883: | P:1 |
| 25884: | P:1 |
| 25885: | P:1 |
| 25886: | P:1 |
| 25887: | P:1 |
| 25888: | P:1 |
| 25889: | P:1 |
| 25890: | P:1 |
| 25891: | P:1 |
| 25892: | P:1 |
| 25893: | P:1 |
| 25894: | P:1 |
| 25895: | P:1 |
| 25896: | P:1 |
| 25897: | P:1 |
| 25898: | P:1 |
| 25899: | P:1 |
| 25900: | P:1 |
| 25901: | P:1 |
| 25902: | P:1 |
| 25903: | P:1 |
| 25904: | P:1 |
| 25905: | P:1 |
| 25906: | P:1 |
| 25907: | P:1 |
| 25908: | P:1 |
| 25909: | P:1 |
| 25910: | P:1 |
| 25911: | P:1 |
| 25912: | P:1 |
| 25913: | P:1 |
| 25914: | P:1 |
| 25915: | P:1 |
| 25916: | P:1 |
| 25917: | P:1 |
| 25918: | P:1 |
| 25919: | P:1 |
| 25920: | P:1 |
| 25921: | P:1 |
| 25922: | P:1 |
| 25923: | P:1 |
| 25924: | P:1 |
| 25925: | P:1 |
| 25926: | P:1 |
| 25927: | P:1 |
| 25928: | P:1 |
| 25929: | P:1 |
| 25930: | P:1 |
| 25931: | P:1 |
| 25932: | P:1 |
| 25933: | P:1 |
| 25934: | P:1 |
| 25935: | P:1 |
| 25936: | P:1 |
| 25937: | P:1 |
| 25938: | P:1 |
| 25939: | P:1 |
| 25940: | P:1 |
| 25941: | P:1 |
| 25942: | P:1 |
| 25943: | P:1 |
| 25944: | P:1 |
| 25945: | P:1 |
| 25946: | P:1 |
| 25947: | P:1 |
| 25948: | P:1 |
| 25949: | P:1 |
| 25950: | P:1 |
| 25951: | P:1 |
| 25952: | P:1 |
| 25953: | P:1 |
| 25954: | P:1 |
| 25955: | P:1 |
| 25956: | P:1 |
| 25957: | P:1 |
| 25958: | P:1 |
| 25959: | P:1 |
| 25960: | P:1 |
| 25961: | P:1 |
| 25962: | P:1 |
| 25963: | P:1 |
| 25964: | P:1 |
| 25965: | P:1 |
| 25966: | P:1 |
| 25967: | P:1 |
| 25968: | P:1 |
| 25969: | P:1 |
| 25970: | P:1 |
| 25971: | P:1 |
| 25972: | P:1 |
| 25973: | P:1 |
| 25974: | P:1 |
| 25975: | P:1 |
| 25976: | P:1 |
| 25977: | P:1 |
| 25978: | P:1 |
| 25979: | P:1 |
| 25980: | P:1 |
| 25981: | P:1 |
| 25982: | P:1 |
| 25983: | P:1 |

TABLE II-continued

| SEQ ID NO. | Spatial Distribution |
|---|---|
| 25984: | P:1 |
| 25985: | P:1 |
| 25986: | P:1 |
| 25987: | P:1 |
| 25988: | P:1 |
| 25989: | P:1 |
| 25990: | P:1 |
| 25991: | P:1 |
| 25992: | P:1 |
| 25993: | P:1 |
| 25994: | P:1 |
| 25995: | P:1 |
| 25996: | P:1 |
| 25997: | P:1 |
| 25998: | P:1 |
| 25999: | P:1 |
| 26000: | P:1 |
| 26001: | P:1 |
| 26002: | P:1 |
| 26003: | P:1 |
| 26004: | P:1 |
| 26005: | P:1 |
| 26006: | P:1 |
| 26007: | P:1 |
| 26008: | P:1 |
| 26009: | P:1 |
| 26010: | P:1 |
| 26011: | P:1 |
| 26012: | P:1 |
| 26013: | P:1 |
| 26014: | P:1 |
| 26015: | P:1 |
| 26016: | P:1 |
| 26017: | P:1 |
| 26018: | P:1 |
| 26019: | P:1 |
| 26020: | P:1 |
| 26021: | P:1 |
| 26022: | P:1 |
| 26023: | P:1 |
| 26024: | P:1 |
| 26025: | P:1 |
| 26026: | P:1 |
| 26027: | P:1 |
| 26028: | P:1 |
| 26029: | P:1 |
| 26030: | P:1 |
| 26031: | P:1 |
| 26032: | P:1 |
| 26033: | P:1 |
| 26034: | P:1 |
| 26035: | P:1 |
| 26036: | P:1 |
| 26037: | P:1 |
| 26038: | P:1 |
| 26039: | P:1 |
| 26040: | P:1 |
| 26041: | P:1 |
| 26042: | P:1 |
| 26043: | P:1 |
| 26044: | P:1 |
| 26045: | P:1 |
| 26046: | P:1 |
| 26047: | P:1 |
| 26048: | P:1 |
| 26049: | P:1 |
| 26050: | P:1 |
| 26051: | P:1 |
| 26052: | P:1 |
| 26053: | P:1 |
| 26054: | P:1 |
| 26055: | P:1 |
| 26056: | P:1 |
| 26057: | P:1 |
| 26058: | P:1 |
| 26059: | P:1 |
| 26060: | P:1 |
| 26061: | P:1 |
| 26062: | P:1 |
| 26063: | P:1 |
| 26064: | P:1 |
| 26065: | P:1 |
| 26066: | P:1 |
| 26067: | P:1 |
| 26068: | P:1 |
| 26069: | P:1 |
| 26070: | P:1 |
| 26071: | P:1 |
| 26072: | P:1 |
| 26073: | P:1 |
| 26074: | P:1 |
| 26075: | P:1 |
| 26076: | P:1 |
| 26077: | P:1 |
| 26078: | P:1 |
| 26079: | P:1 |
| 26080: | P:1 |
| 26081: | P:1 |
| 26082: | P:1 |
| 26083: | P:1 |
| 26084: | P:1 |
| 26085: | P:1 |
| 26086: | P:1 |
| 26087: | P:1 |
| 26088: | P:1 |
| 26089: | P:1 |
| 26090: | P:1 |
| 26091: | P:1 |
| 26092: | P:1 |
| 26093: | P:1 |
| 26094: | P:1 |
| 26095: | P:1 |
| 26096: | P:1 |
| 26097: | P:1 |
| 26098: | P:1 |
| 26099: | P:1 |
| 26100: | P:1 |
| 26101: | P:1 |
| 26102: | P:1 |
| 26103: | P:1 |
| 26104: | P:1 |
| 26105: | P:1 |
| 26106: | P:1 |
| 26107: | P:1 |
| 26108: | P:1 |
| 26109: | P:1 |
| 26110: | P:1 |
| 26111: | P:1 |
| 26112: | P:1 |
| 26113: | P:1 |
| 26114: | P:1 |
| 26115: | P:1 |
| 26116: | P:1 |
| 26117: | P:1 |
| 26118: | P:1 |
| 26119: | P:1 |
| 26120: | P:1 |
| 26121: | P:1 |
| 26122: | P:1 |
| 26123: | P:1 |
| 26124: | P:1 |
| 26125: | P:1 |
| 26126: | P:1 |
| 26127: | P:1 |
| 26128: | P:1 |
| 26129: | P:1 |
| 26130: | P:1 |
| 26131: | P:1 |
| 26132: | P:1 |
| 26133: | P:1 |
| 26134: | P:1 |
| 26135: | P:1 |
| 26136: | P:1 |
| 26137: | P:1 |

TABLE II-continued

| SEQ ID NO. | Spatial Distribution |
|---|---|
| 26138: | P:1 |
| 26139: | P:1 |
| 26140: | P:1 |
| 26141: | P:1 |
| 26142: | P:1 |
| 26143: | P:1 |
| 26144: | P:1 |
| 26145: | P:1 |
| 26146: | P:1 |
| 26147: | P:1 |
| 26148: | P:1 |
| 26149: | P:1 |
| 26150: | P:1 |
| 26151: | P:1 |
| 26152: | P:1 |
| 26153: | P:1 |
| 26154: | P:1 |
| 26155: | P:1 |
| 26156: | P:1 |
| 26157: | P:1 |
| 26158: | P:1 |
| 26159: | P:1 |
| 26160: | P:1 |
| 26161: | P:1 |
| 26162: | P:1 |
| 26163: | P:1 |
| 26164: | P:1 |
| 26165: | P:1 |
| 26166: | P:1 |
| 26167: | P:1 |
| 26168: | P:1 |
| 26169: | P:1 |
| 26170: | P:1 |
| 26171: | P:1 |
| 26172: | P:1 |
| 26173: | P:1 |
| 26174: | P:1 |
| 26175: | P:1 |
| 26176: | P:1 |
| 26177: | P:1 |
| 26178: | P:1 |
| 26179: | P:1 |
| 26180: | P:1 |
| 26181: | P:1 |
| 26182: | P:1 |
| 26183: | P:1 |
| 26184: | P:1 |
| 26185: | P:1 |
| 26186: | P:1 |
| 26187: | P:1 |
| 26188: | P:1 |
| 26189: | P:1 |
| 26190: | P:1 |
| 26191: | P:1 |
| 26192: | P:1 |
| 26193: | P:1 |
| 26194: | P:1 |
| 26195: | P:1 |
| 26196: | P:1 |
| 26197: | P:1 |
| 26198: | P:1 |
| 26199: | P:1 |
| 26200: | P:1 |
| 26201: | P:1 |
| 26202: | P:1 |
| 26203: | P:1 |
| 26204: | P:1 |
| 26205: | P:1 |
| 26206: | P:1 |
| 26207: | P:1 |
| 26208: | P:1 |
| 26209: | P:1 |
| 26210: | P:1 |
| 26211: | P:1 |
| 26212: | P:1 |
| 26213: | P:1 |
| 26214: | P:1 |
| 26215: | P:1 |
| 26216: | P:1 |
| 26217: | P:1 |
| 26218: | P:1 |
| 26219: | P:1 |
| 26220: | P:1 |
| 26221: | P:1 |
| 26222: | P:1 |
| 26223: | P:1 |
| 26224: | P:1 |
| 26225: | P:1 |
| 26226: | P:1 |
| 26227: | P:1 |
| 26228: | P:1 |
| 26229: | P:1 |
| 26230: | P:1 |
| 26231: | P:1 |
| 26232: | P:1 |
| 26233: | P:1 |
| 26234: | P:1 |
| 26235: | P:1 |
| 26236: | P:1 |
| 26237: | P:1 |
| 26238: | P:1 |
| 26239: | P:1 |
| 26240: | P:1 |
| 26241: | P:1 |
| 26242: | P:1 |
| 26243: | P:1 |
| 26244: | P:1 |
| 26245: | P:1 |
| 26246: | P:1 |
| 26247: | P:1 |
| 26248: | P:1 |
| 26249: | P:1 |
| 26250: | P:1 |
| 26251: | P:1 |
| 26252: | P:1 |
| 26253: | P:1 |
| 26254: | P:1 |
| 26255: | P:1 |
| 26256: | P:1 |
| 26257: | P:1 |
| 26258: | P:1 |
| 26259: | P:1 |
| 26260: | P:1 |
| 26261: | P:1 |
| 26262: | P:1 |
| 26263: | P:1 |
| 26264: | P:1 |
| 26265: | P:1 |
| 26266: | P:1 |
| 26267: | P:1 |
| 26268: | P:1 |
| 26269: | P:1 |
| 26270: | P:1 |
| 26271: | P:1 |
| 26272: | P:1 |
| 26273: | P:1 |
| 26274: | P:1 |
| 26275: | P:1 |
| 26276: | P:1 |
| 26277: | P:1 |
| 26278: | P:1 |
| 26279: | P:1 |
| 26280: | P:1 |
| 26281: | P:1 |
| 26282: | P:1 |
| 26283: | P:1 |
| 26284: | P:1 |
| 26285: | P:1 |
| 26286: | P:1 |
| 26287: | P:1 |
| 26288: | P:1 |
| 26289: | P:1 |
| 26290: | P:1 |
| 26291: | P:1 |

TABLE II-continued

| SEQ ID NO. | Spatial Distribution |
|---|---|
| 26292: | P:1 |
| 26293: | P:1 |
| 26294: | P:1 |
| 26295: | P:1 |
| 26296: | P:1 |
| 26297: | P:1 |
| 26298: | P:1 |
| 26299: | P:1 |
| 26300: | P:1 |
| 26301: | P:1 |
| 26302: | P:1 |
| 26303: | P:1 |
| 26304: | P:1 |
| 26305: | P:1 |
| 26306: | P:1 |
| 26307: | P:1 |
| 26308: | P:1 |
| 26309: | P:1 |
| 26310: | P:1 |
| 26311: | P:1 |
| 26312: | P:1 |
| 26313: | P:1 |
| 26314: | P:1 |
| 26315: | P:1 |
| 26316: | P:1 |
| 26317: | P:1 |
| 26318: | P:1 |
| 26319: | P:1 |
| 26320: | P:1 |
| 26321: | P:1 |
| 26322: | P:1 |
| 26323: | P:1 |
| 26324: | P:1 |
| 26325: | P:1 |
| 26326: | P:1 |
| 26327: | P:1 |
| 26328: | P:1 |
| 26329: | P:1 |
| 26330: | P:1 |
| 26331: | P:1 |
| 26332: | P:1 |
| 26333: | P:1 |
| 26334: | P:1 |
| 26335: | P:1 |
| 26336: | P:1 |
| 26337: | P:1 |
| 26338: | P:1 |
| 26339: | P:1 |
| 26340: | P:1 |
| 26341: | P:1 |
| 26342: | P:1 |
| 26343: | P:1 |
| 26344: | P:1 |
| 26345: | P:1 |
| 26346: | P:1 |
| 26347: | P:1 |
| 26348: | P:1 |
| 26349: | P:1 |
| 26350: | P:1 |
| 26351: | P:1 |
| 26352: | P:1 |
| 26353: | P:1 |
| 26354: | P:1 |
| 26355: | P:1 |
| 26356: | P:1 |
| 26357: | P:1 |
| 26358: | P:1 |
| 26359: | P:1 |
| 26360: | P:1 |
| 26361: | P:1 |
| 26362: | P:1 |
| 26363: | P:1 |
| 26364: | P:1 |
| 26365: | P:1 |
| 26366: | P:1 |
| 26367: | P:1 |
| 26368: | P:1 |
| 26369: | P:1 |
| 26370: | P:1 |
| 26371: | P:1 |
| 26372: | P:1 |
| 26373: | P:1 |
| 26374: | P:1 |
| 26375: | P:1 |
| 26376: | P:1 |
| 26377: | P:1 |
| 26378: | P:1 |
| 26379: | P:1 |
| 26380: | P:1 |
| 26381: | P:1 |
| 26382: | P:1 |
| 26383: | P:1 |
| 26384: | P:1 |
| 26385: | P:1 |
| 26386: | P:1 |
| 26387: | P:1 |
| 26388: | P:1 |
| 26389: | P:1 |
| 26390: | P:1 |
| 26391: | P:1 |
| 26392: | P:1 |
| 26393: | P:1 |
| 26394: | P:1 |
| 26395: | P:1 |
| 26396: | P:1 |
| 26397: | P:1 |
| 26398: | P:1 |
| 26399: | P:1 |
| 26400: | P:1 |
| 26401: | P:1 |
| 26402: | P:1 |
| 26403: | P:1 |
| 26404: | P:1 |
| 26405: | P:1 |
| 26406: | P:1 |
| 26407: | P:1 |
| 26408: | P:1 |
| 26409: | P:1 |
| 26410: | P:1 |
| 26411: | P:1 |
| 26412: | P:1 |
| 26413: | P:1 |
| 26414: | P:1 |
| 26415: | P:1 |
| 26416: | P:1 |
| 26417: | P:1 |
| 26418: | P:1 |
| 26419: | P:1 |
| 26420: | P:1 |
| 26421: | P:1 |
| 26422: | P:1 |
| 26423: | P:1 |
| 26424: | P:1 |
| 26425: | P:1 |
| 26426: | P:1 |
| 26427: | P:1 |
| 26428: | P:1 |
| 26429: | P:1 |
| 26430: | P:1 |
| 26431: | P:1 |
| 26432: | P:1 |
| 26433: | P:1 |
| 26434: | P:1 |
| 26435: | P:1 |
| 26436: | P:1 |
| 26437: | P:1 |
| 26438: | P:1 |
| 26439: | P:1 |
| 26440: | P:1 |
| 26441: | P:1 |
| 26442: | P:1 |
| 26443: | P:1 |
| 26444: | P:1 |
| 26445: | P:1 |

TABLE II-continued

| SEQ ID NO. | Spatial Distribution |
|---|---|
| 26446: | P:1 |
| 26447: | P:1 |
| 26448: | P:1 |
| 26449: | P:1 |
| 26450: | P:1 |
| 26451: | P:1 |
| 26452: | P:1 |
| 26453: | P:1 |
| 26454: | P:1 |
| 26455: | P:1 |
| 26456: | P:1 |
| 26457: | P:1 |
| 26458: | P:1 |
| 26459: | P:1 |
| 26460: | P:1 |
| 26461: | P:1 |
| 26462: | P:1 |
| 26463: | P:1 |
| 26464: | P:1 |
| 26465: | P:1 |
| 26466: | P:1 |
| 26467: | P:1 |
| 26468: | P:1 |
| 26469: | P:1 |
| 26470: | P:1 |
| 26471: | P:1 |
| 26472: | P:1 |
| 26473: | P:1 |
| 26474: | P:1 |
| 26475: | P:1 |
| 26476: | P:1 |
| 26477: | P:1 |
| 26478: | P:1 |
| 26479: | P:1 |
| 26480: | P:1 |
| 26481: | P:1 |
| 26482: | P:1 |
| 26483: | P:1 |
| 26484: | P:1 |
| 26485: | P:1 |
| 26486: | P:1 |
| 26487: | P:1 |
| 26488: | P:1 |
| 26489: | P:1 |
| 26490: | P:1 |
| 26491: | P:1 |
| 26492: | P:1 |
| 26493: | P:1 |
| 26494: | P:1 |
| 26495: | P:1 |
| 26496: | P:1 |
| 26497: | P:1 |
| 26498: | P:1 |
| 26499: | P:1 |
| 26500: | P:1 |
| 26501: | P:1 |
| 26502: | P:1 |
| 26503: | P:1 |
| 26504: | P:1 |
| 26505: | P:1 |
| 26506: | P:1 |
| 26507: | P:1 |
| 26508: | P:1 |
| 26509: | P:1 |
| 26510: | P:1 |
| 26511: | P:1 |
| 26512: | P:1 |
| 26513: | P:1 |
| 26514: | P:1 |
| 26515: | P:1 |
| 26516: | P:1 |
| 26517: | P:1 |
| 26518: | P:1 |
| 26519: | P:1 |
| 26520: | P:1 |
| 26521: | P:1 |
| 26522: | P:1 |
| 26523: | P:1 |
| 26524: | P:1 |
| 26525: | P:1 |
| 26526: | P:1 |
| 26527: | P:1 |
| 26528: | P:1 |
| 26529: | P:1 |
| 26530: | P:1 |
| 26531: | P:1 |
| 26532: | P:1 |
| 26533: | P:1 |
| 26534: | P:1 |
| 26535: | P:1 |
| 26536: | P:1 |
| 26537: | P:1 |
| 26538: | P:1 |
| 26539: | P:1 |
| 26540: | P:1 |
| 26541: | P:1 |
| 26542: | P:1 |
| 26543: | P:1 |
| 26544: | P:1 |
| 26545: | P:1 |
| 26546: | P:1 |
| 26547: | P:1 |
| 26548: | P:1 |
| 26549: | P:1 |
| 26550: | P:1 |
| 26551: | P:1 |
| 26552: | P:1 |
| 26553: | P:1 |
| 26554: | P:1 |
| 26555: | P:1 |
| 26556: | P:1 |
| 26557: | P:1 |
| 26558: | P:1 |
| 26559: | P:1 |
| 26560: | P:1 |
| 26561: | P:1 |
| 26562: | P:1 |
| 26563: | P:1 |
| 26564: | P:1 |
| 26565: | P:1 |
| 26566: | P:1 |
| 26567: | P:1 |
| 26568: | P:1 |
| 26569: | P:1 |
| 26570: | P:1 |
| 26571: | P:1 |
| 26572: | P:1 |
| 26573: | P:1 |
| 26574: | P:1 |
| 26575: | P:1 |
| 26576: | P:1 |
| 26577: | P:1 |
| 26578: | P:1 |
| 26579: | P:1 |
| 26580: | P:1 |
| 26581: | P:1 |
| 26582: | P:1 |
| 26583: | P:1 |
| 26584: | P:1 |
| 26585: | P:1 |
| 26586: | P:1 |
| 26587: | P:1 |
| 26588: | P:1 |
| 26589: | P:1 |
| 26590: | P:1 |
| 26591: | P:1 |
| 26592: | P:1 |
| 26593: | P:1 |
| 26594: | P:1 |
| 26595: | P:1 |
| 26596: | AA:1 |
| 26597: | AA:1 |
| 26598: | AA:1 |
| 26599: | AA:1 |

TABLE II-continued

| SEQ ID NO. | Spatial Distribution |
|---|---|
| 26600: | AA:1 |
| 26601: | AA:1 |
| 26602: | AA:1 |
| 26603: | AA:1 |
| 26604: | AA:1 |
| 26605: | AA:1 |
| 26606: | AA:1 |
| 26607: | AA:1 |
| 26608: | AA:1 |
| 26609: | AA:1 |
| 26610: | AA:1 |
| 26611: | AA:1 |
| 26612: | AA:1 |
| 26613: | AA:1 |
| 26614: | AA:1 |
| 26615: | AA:1 |
| 26616: | AA:1 |
| 26617: | AA:1 |
| 26618: | AA:1 |
| 26619: | AA:1 |
| 26620: | AA:1 |
| 26621: | AA:1 |
| 26622: | AA:1 |
| 26623: | AA:1 |
| 26624: | AA:1 |
| 26625: | AA:1 |
| 26626: | AA:1 |
| 26627: | AA:1 |
| 26628: | AA:1 |
| 26629: | AA:1 |
| 26630: | AA:1 |
| 26631: | AA:1 |
| 26632: | AA:1 |
| 26633: | AA:1 |
| 26634: | AA:1 |
| 26635: | AA:1 |
| 26636: | AA:1 |
| 26637: | AA:1 |
| 26638: | AA:1 |
| 26639: | AA:1 |
| 26640: | AA:1 |
| 26641: | AA:1 |
| 26642: | AA:1 |
| 26643: | AA:1 |
| 26644: | AA:1 |
| 26645: | AA:1 |
| 26646: | AA:1 |
| 26647: | AA:1 |
| 26648: | AA:1 |
| 26649: | AA:1 |
| 26650: | AA:1 |
| 26651: | AA:1 |
| 26652: | AA:1 |
| 26653: | AA:1 |
| 26654: | AA:1 |
| 26655: | AA:1 |
| 26656: | AA:1 |
| 26657: | AA:1 |
| 26658: | AA:1 |
| 26659: | AA:1 |
| 26660: | AA:1 |
| 26661: | AA:1 |
| 26662: | AA:1 |
| 26663: | AA:1 |
| 26664: | AA:1 |
| 26665: | AA:1 |
| 26666: | AA:1 |
| 26667: | AA:1 |
| 26668: | AA:1 |
| 26669: | AA:1 |
| 26670: | AA:1 |
| 26671: | AA:1 |
| 26672: | AA:1 |
| 26673: | AA:1 |
| 26674: | AA:1 |
| 26675: | AA:1 |
| 26676: | AA:1 |
| 26677: | AA:1 |
| 26678: | AA:1 |
| 26679: | AA:1 |
| 26680: | AA:1 |
| 26681: | AA:1 |
| 26682: | AA:1 |
| 26683: | AA:1 |
| 26684: | AA:1 |
| 26685: | AA:1 |
| 26686: | AA:1 |
| 26687: | AA:1 |
| 26688: | AA:1 |
| 26689: | AA:1 |
| 26690: | AA:1 |
| 26691: | AA:1 |
| 26692: | AA:1 |
| 26693: | AA:1 |
| 26694: | AA:1 |
| 26695: | AA:1 |
| 26696: | AA:1 |
| 26697: | AA:1 |
| 26698: | AA:1 |
| 26699: | AA:1 |
| 26700: | AA:1 |
| 26701: | AA:1 |
| 26702: | AA:1 |
| 26703: | AA:1 |
| 26704: | AA:1 |
| 26705: | AA:1 |
| 26706: | AA:1 |
| 26707: | AA:1 |
| 26708: | AA:1 |
| 26709: | AA:1 |
| 26710: | AA:1 |
| 26711: | AA:1 |
| 26712: | AA:1 |
| 26713: | AA:1 |
| 26714: | AA:1 |
| 26715: | AA:1 |
| 26716: | AA:1 |
| 26717: | AA:1 |
| 26718: | AA:1 |
| 26719: | AA:1 |
| 26720: | AA:1 |
| 26721: | AA:1 |
| 26722: | AA:1 |
| 26723: | AA:1 |
| 26724: | AA:1 |
| 26725: | AA:1 |
| 26726: | AA:1 |
| 26727: | AA:1 |
| 26728: | AA:1 |
| 26729: | AA:1 |
| 26730: | AA:1 |
| 26731: | AA:1 |
| 26732: | AA:1 |
| 26733: | AA:1 |
| 26734: | AA:1 |
| 26735: | AA:1 |
| 26736: | AA:1 |
| 26737: | AA:1 |
| 26738: | AA:1 |
| 26739: | AA:1 |
| 26740: | AA:1 |
| 26741: | AA:1 |
| 26742: | AA:1 |
| 26743: | AA:1 |
| 26744: | AA:1 |
| 26745: | AA:1 |
| 26746: | AA:1 |
| 26747: | AA:1 |
| 26748: | AA:1 |
| 26749: | AA:1 |
| 26750: | AA:1 |
| 26751: | AA:1 |
| 26752: | AA:1 |
| 26753: | AA:1 |

TABLE II-continued

| SEQ ID NO. | Spatial Distribution |
|---|---|
| 26754: | AA:1 |
| 26755: | AA:1 |
| 26756: | AA:1 |
| 26757: | AA:1 |
| 26758: | AA:1 |
| 26759: | AA:1 |
| 26760: | AA:1 |
| 26761: | AA:1 |
| 26762: | AA:1 |
| 26763: | AA:1 |
| 26764: | AA:1 |
| 26765: | AA:1 |
| 26766: | AA:1 |
| 26767: | AA:1 |
| 26768: | AA:1 |
| 26769: | AA:1 |
| 26770: | AA:1 |
| 26771: | AA:1 |
| 26772: | AA:1 |
| 26773: | AA:1 |
| 26774: | AA:1 |
| 26775: | AA:1 |
| 26776: | AA:1 |
| 26777: | AA:1 |
| 26778: | AA:1 |
| 26779: | AA:1 |
| 26780: | AA:1 |
| 26781: | AA:1 |
| 26782: | AA:1 |
| 26783: | AA:1 |
| 26784: | AA:1 |
| 26785: | AA:1 |
| 26786: | AA:1 |
| 26787: | AA:1 |
| 26788: | AA:1 |
| 26789: | AA:1 |
| 26790: | AA:1 |
| 26791: | AA:1 |
| 26792: | AA:1 |
| 26793: | AA:1 |
| 26794: | AA:1 |
| 26795: | AA:1 |
| 26796: | AA:1 |
| 26797: | AA:1 |
| 26798: | AA:1 |
| 26799: | AA:1 |
| 26800: | AA:1 |
| 26801: | AA:1 |
| 26802: | AA:1 |
| 26803: | AA:1 |
| 26804: | AA:1 |
| 26805: | AA:1 |
| 26806: | AA:1 |
| 26807: | AA:1 |
| 26808: | AA:1 |
| 26809: | AA:1 |
| 26810: | AA:1 |
| 26811: | AA:1 |
| 26812: | AA:1 |
| 26813: | AA:1 |
| 26814: | AA:1 |
| 26815: | AA:1 |
| 26816: | AA:1 |
| 26817: | AA:1 |
| 26818: | AA:1 |
| 26819: | AA:1 |
| 26820: | AA:1 |
| 26821: | AA:1 |
| 26822: | AA:1 |
| 26823: | AA:1 |
| 26824: | AA:1 |
| 26825: | AA:1 |
| 26826: | AA:1 |
| 26827: | AA:1 |
| 26828: | AA:1 |
| 26829: | AA:1 |
| 26830: | AA:1 |
| 26831: | AA:1 |
| 26832: | AA:1 |
| 26833: | AA:1 |
| 26834: | AA:1 |
| 26835: | AA:1 |
| 26836: | AA:1 |
| 26837: | AA:1 |
| 26838: | AA:1 |
| 26839: | AA:1 |
| 26840: | AA:1 |
| 26841: | AA:1 |
| 26842: | AA:1 |
| 26843: | AA:1 |
| 26844: | AA:1 |
| 26845: | AA:1 |
| 26846: | AA:1 |
| 26847: | AA:1 |
| 26848: | AA:1 |
| 26849: | AA:1 |
| 26850: | AA:1 |
| 26851: | AA:1 |
| 26852: | AA:1 |
| 26853: | AA:1 |
| 26854: | AA:1 |
| 26855: | AA:1 |
| 26856: | AA:1 |
| 26857: | AA:1 |
| 26858: | AA:1 |
| 26859: | AA:1 |
| 26860: | AA:1 |
| 26861: | AA:1 |
| 26862: | AA:1 |
| 26863: | AA:1 |
| 26864: | AA:1 |
| 26865: | AA:1 |
| 26866: | AA:1 |
| 26867: | AA:1 |
| 26868: | AA:1 |
| 26869: | AA:1 |
| 26870: | AA:1 |
| 26871: | AA:1 |
| 26872: | AA:1 |
| 26873: | AA:1 |
| 26874: | AA:1 |
| 26875: | AA:1 |
| 26876: | AA:1 |
| 26877: | AA:1 |
| 26878: | AA:1 |
| 26879: | AA:1 |
| 26880: | AA:1 |
| 26881: | AA:1 |
| 26882: | AA:1 |
| 26883: | AA:1 |
| 26884: | AA:1 |
| 26885: | AA:1 |
| 26886: | AA:1 |
| 26887: | AA:1 |
| 26888: | AA:1 |
| 26889: | AA:1 |
| 26890: | AA:1 |
| 26891: | AA:1 |
| 26892: | AA:1 |
| 26893: | AA:1 |
| 26894: | AA:1 |
| 26895: | AA:1 |
| 26896: | AA:1 |
| 26897: | AA:1 |
| 26898: | AA:1 |
| 26899: | AA:1 |
| 26900: | AA:1 |
| 26901: | AA:1 |
| 26902: | AA:1 |
| 26903: | AA:1 |
| 26904: | AA:1 |
| 26905: | AA:1 |
| 26906: | AA:1 |
| 26907: | AA:1 |

TABLE II-continued

| SEQ ID NO. | Spatial Distribution |
|---|---|
| 26908: | AA:1 |
| 26909: | AA:1 |
| 26910: | AA:1 |
| 26911: | AA:1 |
| 26912: | AA:1 |
| 26913: | AA:1 |
| 26914: | AA:1 |
| 26915: | AA:1 |
| 26916: | AA:1 |
| 26917: | AA:1 |
| 26918: | AA:1 |
| 26919: | AA:1 |
| 26920: | AA:1 |
| 26921: | AA:1 |
| 26922: | AA:1 |
| 26923: | AA:1 |
| 26924: | AA:1 |
| 26925: | AA:1 |
| 26926: | AA:1 |
| 26927: | AA:1 |
| 26928: | AA:1 |
| 26929: | AA:1 |
| 26930: | AA:1 |
| 26931: | AA:1 |
| 26932: | AA:1 |
| 26933: | AA:1 |
| 26934: | AA:1 |
| 26935: | AA:1 |
| 26936: | AA:1 |
| 26937: | AA:1 |
| 26938: | AA:1 |
| 26939: | AA:1 |
| 26940: | AA:1 |
| 26941: | AA:1 |
| 26942: | AA:1 |
| 26943: | AA:1 |
| 26944: | AA:1 |
| 26945: | AA:1 |
| 26946: | AA:1 |
| 26947: | AA:1 |
| 26948: | AA:1 |
| 26949: | AA:1 |
| 26950: | AA:1 |
| 26951: | AA:1 |
| 26952: | AA:1 |
| 26953: | AA:1 |
| 26954: | AA:1 |
| 26955: | AA:1 |
| 26956: | AA:1 |
| 26957: | AA:1 |
| 26958: | AA:1 |
| 26959: | AA:1 |
| 26960: | AA:1 |
| 26961: | AA:1 |
| 26962: | AA:1 |
| 26963: | AA:1 |
| 26964: | AA:1 |
| 26965: | AA:1 |
| 26966: | AA:1 |
| 26967: | AA:1 |
| 26968: | AA:1 |
| 26969: | AA:1 |
| 26970: | AA:1 |
| 26971: | AA:1 |
| 26972: | AA:1 |
| 26973: | AA:1 |
| 26974: | AA:1 |
| 26975: | AA:1 |
| 26976: | AA:1 |
| 26977: | AA:1 |
| 26978: | AA:1 |
| 26979: | AA:1 |
| 26980: | AA:1 |
| 26981: | AA:1 |
| 26982: | AA:1 |
| 26983: | AA:1 |
| 26984: | AA:1 |
| 26985: | AA:1 |
| 26986: | AA:1 |
| 26987: | AA:1 |
| 26988: | AA:1 |
| 26989: | AA:1 |
| 26990: | AA:1 |
| 26991: | AA:1 |
| 26992: | AA:1 |
| 26993: | AA:1 |
| 26994: | AA:1 |
| 26995: | AA:1 |
| 26996: | AA:1 |
| 26997: | AA:1 |
| 26998: | AA:1 |
| 26999: | AA:1 |
| 27000: | AA:1 |
| 27001: | AA:1 |
| 27002: | AA:1 |
| 27003: | AA:1 |
| 27004: | AA:1 |
| 27005: | AA:1 |
| 27006: | AA:1 |
| 27007: | AA:1 |
| 27008: | AA:1 |
| 27009: | AA:1 |
| 27010: | AA:1 |
| 27011: | AA:1 |
| 27012: | AA:1 |
| 27013: | AA:1 |
| 27014: | AA:1 |
| 27015: | AA:1 |
| 27016: | AA:1 |
| 27017: | AA:1 |
| 27018: | AA:1 |
| 27019: | AA:1 |
| 27020: | AA:1 |
| 27021: | AA:1 |
| 27022: | AA:1 |
| 27023: | AA:1 |
| 27024: | AA:1 |
| 27025: | AA:1 |
| 27026: | AA:1 |
| 27027: | AA:1 |
| 27028: | AA:1 |
| 27029: | AA:1 |
| 27030: | AA:1 |
| 27031: | AA:1 |
| 27032: | AA:1 |
| 27033: | AA:1 |
| 27034: | AA:1 |
| 27035: | AA:1 |
| 27036: | AA:1 |
| 27037: | AA:1 |
| 27038: | AA:1 |
| 27039: | AA:1 |
| 27040: | AA:1 |
| 27041: | AA:1 |
| 27042: | AA:1 |
| 27043: | AA:1 |
| 27044: | AA:1 |
| 27045: | AA:1 |
| 27046: | AA:1 |
| 27047: | AA:1 |
| 27048: | AA:1 |
| 27049: | AA:1 |
| 27050: | AA:1 |
| 27051: | AA:1 |
| 27052: | AA:1 |
| 27053: | AA:1 |
| 27054: | AA:1 |
| 27055: | AA:1 |
| 27056: | AA:1 |
| 27057: | AA:1 |
| 27058: | AA:1 |
| 27059: | AA:1 |
| 27060: | AA:1 |
| 27061: | AA:1 |

TABLE II-continued

| SEQ ID NO. | Spatial Distribution |
|---|---|
| 27062: | AA:1 |
| 27063: | AA:1 |
| 27064: | AA:1 |
| 27065: | AA:1 |
| 27066: | AA:1 |
| 27067: | AA:1 |
| 27068: | AA:1 |
| 27069: | AA:1 |
| 27070: | AA:1 |
| 27071: | AA:1 |
| 27072: | AA:1 |
| 27073: | AA:1 |
| 27074: | AA:1 |
| 27075: | AA:1 |
| 27076: | AA:1 |
| 27077: | AA:1 |
| 27078: | AA:1 |
| 27079: | AA:1 |
| 27080: | AA:1 |
| 27081: | AA:1 |
| 27082: | AA:1 |
| 27083: | AA:1 |
| 27084: | AA:1 |
| 27085: | AA:1 |
| 27086: | AA:1 |
| 27087: | AA:1 |
| 27088: | AA:1 |
| 27089: | AA:1 |
| 27090: | AA:1 |
| 27091: | AA:1 |
| 27092: | AA:1 |
| 27093: | AA:1 |
| 27094: | AA:1 |
| 27095: | AA:1 |
| 27096: | AA:1 |
| 27097: | AA:1 |
| 27098: | AA:1 |
| 27099: | AA:1 |
| 27100: | AA:1 |
| 27101: | AA:1 |
| 27102: | AA:1 |
| 27103: | AA:1 |
| 27104: | AA:1 |
| 27105: | AA:1 |
| 27106: | AA:1 |
| 27107: | AA:1 |
| 27108: | AA:1 |
| 27109: | AA:1 |
| 27110: | AA:1 |
| 27111: | AA:1 |
| 27112: | AA:1 |
| 27113: | AA:1 |
| 27114: | AA:1 |
| 27115: | AA:1 |
| 27116: | AA:1 |
| 27117: | AA:1 |
| 27118: | AA:1 |
| 27119: | AA:1 |
| 27120: | AA:1 |
| 27121: | AA:1 |
| 27122: | AA:1 |
| 27123: | AA:1 |
| 27124: | AA:1 |
| 27125: | AA:1 |
| 27126: | AA:1 |
| 27127: | AA:1 |
| 27128: | AA:1 |
| 27129: | AA:1 |
| 27130: | AA:1 |
| 27131: | AA:1 |
| 27132: | AA:1 |
| 27133: | AA:1 |
| 27134: | AA:1 |
| 27135: | AA:1 |
| 27136: | AA:1 |
| 27137: | AA:1 |
| 27138: | AA:1 |
| 27139: | AA:1 |
| 27140: | AA:1 |
| 27141: | AA:1 |
| 27142: | AA:1 |
| 27143: | AA:1 |
| 27144: | AA:1 |
| 27145: | AA:1 |
| 27146: | AA:1 |
| 27147: | AA:1 |
| 27148: | AA:1 |
| 27149: | AA:1 |
| 27150: | AA:1 |
| 27151: | AA:1 |
| 27152: | AA:1 |
| 27153: | AA:1 |
| 27154: | AA:1 |
| 27155: | AA:1 |
| 27156: | AA:1 |
| 27157: | AA:1 |
| 27158: | AA:1 |
| 27159: | AA:1 |
| 27160: | AA:1 |
| 27161: | AA:1 |
| 27162: | AA:1 |
| 27163: | AA:1 |
| 27164: | AA:1 |
| 27165: | AA:1 |
| 27166: | AA:1 |
| 27167: | AA:1 |
| 27168: | AA:1 |
| 27169: | AA:1 |
| 27170: | AA:1 |
| 27171: | AA:1 |
| 27172: | AA:1 |
| 27173: | AA:1 |
| 27174: | AA:1 |
| 27175: | AA:1 |
| 27176: | AA:1 |
| 27177: | AA:1 |
| 27178: | AA:1 |
| 27179: | AA:1 |
| 27180: | AA:1 |
| 27181: | AA:1 |
| 27182: | AA:1 |
| 27183: | AA:1 |
| 27184: | AA:1 |
| 27185: | AA:1 |
| 27186: | AA:1 |
| 27187: | AA:1 |
| 27188: | AA:1 |
| 27189: | AA:1 |
| 27190: | AA:1 |
| 27191: | AA:1 |
| 27192: | AA:1 |
| 27193: | AA:1 |
| 27194: | AA:1 |
| 27195: | AA:1 |
| 27196: | AA:1 |
| 27197: | AA:1 |
| 27198: | AA:1 |
| 27199: | AA:1 |
| 27200: | AA:1 |
| 27201: | AA:1 |
| 27202: | AA:1 |
| 27203: | AA:1 |
| 27204: | AA:1 |
| 27205: | AA:1 |
| 27206: | AA:1 |
| 27207: | AA:1 |
| 27208: | AA:1 |
| 27209: | AA:1 |
| 27210: | AA:1 |
| 27211: | AA:1 |
| 27212: | AA:1 |
| 27213: | AA:1 |
| 27214: | AA:1 |
| 27215: | AA:1 |

TABLE II-continued

| SEQ ID NO. | Spatial Distribution |
|---|---|
| 27216: | AA:1 |
| 27217: | AA:1 |
| 27218: | AA:1 |
| 27219: | AA:1 |
| 27220: | AA:1 |
| 27221: | AA:1 |
| 27222: | AA:1 |
| 27223: | AA:1 |
| 27224: | AA:1 |
| 27225: | AA:1 |
| 27226: | AA:1 |
| 27227: | AA:1 |
| 27228: | AA:1 |
| 27229: | AA:1 |
| 27230: | AA:1 |
| 27231: | AA:1 |
| 27232: | AA:1 |
| 27233: | AA:1 |
| 27234: | AA:1 |
| 27235: | AA:1 |
| 27236: | AA:1 |
| 27237: | AA:1 |
| 27238: | AA:1 |
| 27239: | AA:1 |
| 27240: | AA:1 |
| 27241: | AA:1 |
| 27242: | AA:1 |
| 27243: | AA:1 |
| 27244: | AA:1 |
| 27245: | AA:1 |
| 27246: | AA:1 |
| 27247: | AA:1 |
| 27248: | AA:1 |
| 27249: | AA:1 |
| 27250: | AA:1 |
| 27251: | AA:1 |
| 27252: | AA:1 |
| 27253: | AA:1 |
| 27254: | AA:1 |
| 27255: | AA:1 |
| 27256: | AA:1 |
| 27257: | AA:1 |
| 27258: | AA:1 |
| 27259: | AA:1 |
| 27260: | AA:1 |
| 27261: | AA:1 |
| 27262: | AA:1 |
| 27263: | AA:1 |
| 27264: | AA:1 |
| 27265: | AA:1 |
| 27266: | AA:1 |
| 27267: | AA:1 |
| 27268: | AA:1 |
| 27269: | AA:1 |
| 27270: | AA:1 |
| 27271: | AA:1 |
| 27272: | AA:1 |
| 27273: | AA:1 |
| 27274: | AA:1 |
| 27275: | AA:1 |
| 27276: | AA:1 |
| 27277: | AA:1 |
| 27278: | AA:1 |
| 27279: | AA:1 |
| 27280: | AA:1 |
| 27281: | AA:1 |
| 27282: | AA:1 |
| 27283: | AA:1 |
| 27284: | AA:1 |
| 27285: | AA:1 |
| 27286: | AA:1 |
| 27287: | AA:1 |
| 27288: | AA:1 |
| 27289: | AA:1 |
| 27290: | AA:1 |
| 27291: | AA:1 |
| 27292: | AA:1 |
| 27293: | AA:1 |
| 27294: | AA:1 |
| 27295: | AA:1 |
| 27296: | AA:1 |
| 27297: | AA:1 |
| 27298: | AA:1 |
| 27299: | AA:1 |
| 27300: | AA:1 |
| 27301: | AA:1 |
| 27302: | AA:1 |
| 27303: | AA:1 |
| 27304: | AA:1 |
| 27305: | AA:1 |
| 27306: | AA:1 |
| 27307: | AA:1 |
| 27308: | AA:1 |
| 27309: | AA:1 |
| 27310: | AA:1 |
| 27311: | AA:1 |
| 27312: | AA:1 |
| 27313: | AA:1 |
| 27314: | AA:1 |
| 27315: | AA:1 |
| 27316: | AA:1 |
| 27317: | AA:1 |
| 27318: | AA:1 |
| 27319: | AA:1 |
| 27320: | AA:1 |
| 27321: | AA:1 |
| 27322: | AA:1 |
| 27323: | AA:1 |
| 27324: | AA:1 |
| 27325: | AA:1 |
| 27326: | AA:1 |
| 27327: | AA:1 |
| 27328: | AA:1 |
| 27329: | AA:1 |
| 27330: | AA:1 |
| 27331: | AA:1 |
| 27332: | AA:1 |
| 27333: | AA:1 |
| 27334: | AA:1 |
| 27335: | AA:1 |
| 27336: | AA:1 |
| 27337: | AA:1 |
| 27338: | AA:1 |
| 27339: | AA:1 |
| 27340: | AA:1 |
| 27341: | AA:1 |
| 27342: | AA:1 |
| 27343: | AA:1 |
| 27344: | AA:1 |
| 27345: | AA:1 |
| 27346: | AA:1 |
| 27347: | AA:1 |
| 27348: | AA:1 |
| 27349: | AA:1 |
| 27350: | AA:1 |
| 27351: | AA:1 |
| 27352: | AA:1 |
| 27353: | AA:1 |
| 27354: | AA:1 |
| 27355: | AA:1 |
| 27356: | AA:1 |
| 27357: | AA:1 |
| 27358: | AA:1 |
| 27359: | AA:1 |
| 27360: | AA:1 |
| 27361: | AA:1 |
| 27362: | AA:1 |
| 27363: | AA:1 |
| 27364: | AA:1 |
| 27365: | AA:1 |
| 27366: | AA:1 |
| 27367: | AA:1 |
| 27368: | AA:1 |
| 27369: | AA:1 |

TABLE II-continued

| SEQ ID NO. | Spatial Distribution |
|---|---|
| 27370: | AA:1 |
| 27371: | AA:1 |
| 27372: | AA:1 |
| 27373: | AA:1 |
| 27374: | AA:1 |
| 27375: | AA:1 |
| 27376: | AA:1 |
| 27377: | AA:1 |
| 27378: | AA:1 |
| 27379: | AA:1 |
| 27380: | AA:1 |
| 27381: | AA:1 |
| 27382: | AA:1 |
| 27383: | AA:1 |
| 27384: | AA:1 |
| 27385: | AA:1 |
| 27386: | AA:1 |
| 27387: | AA:1 |
| 27388: | AA:1 |
| 27389: | AA:1 |
| 27390: | AA:1 |
| 27391: | AA:1 |
| 27392: | AA:1 |
| 27393: | AA:1 |
| 27394: | AA:1 |
| 27395: | AA:1 |
| 27396: | AA:1 |
| 27397: | AA:1 |
| 27398: | AA:1 |
| 27399: | AA:1 |
| 27400: | AA:1 |
| 27401: | AA:1 |
| 27402: | AA:1 |
| 27403: | AA:1 |
| 27404: | AA:1 |
| 27405: | AA:1 |
| 27406: | AA:1 |
| 27407: | AA:1 |
| 27408: | AA:1 |
| 27409: | AA:1 |
| 27410: | AA:1 |
| 27411: | AA:1 |
| 27412: | AA:1 |
| 27413: | AA:1 |
| 27414: | AA:1 |
| 27415: | AA:1 |
| 27416: | AA:1 |
| 27417: | AA:1 |
| 27418: | AA:1 |
| 27419: | AA:1 |
| 27420: | AA:1 |
| 27421: | AA:1 |
| 27422: | AA:1 |
| 27423: | AA:1 |
| 27424: | AA:1 |
| 27425: | AA:1 |
| 27426: | AA:1 |
| 27427: | AA:1 |
| 27428: | AA:1 |
| 27429: | AA:1 |
| 27430: | AA:1 |
| 27431: | AA:1 |
| 27432: | AA:1 |
| 27433: | AA:1 |
| 27434: | AA:1 |
| 27435: | AA:1 |
| 27436: | AA:1 |
| 27437: | AA:1 |
| 27438: | AA:1 |
| 27439: | AA:1 |
| 27440: | AA:1 |
| 27441: | AA:1 |
| 27442: | AA:1 |
| 27443: | AA:1 |
| 27444: | AA:1 |
| 27445: | AA:1 |
| 27446: | AA:1 |
| 27447: | AA:1 |
| 27448: | AA:1 |
| 27449: | AA:1 |
| 27450: | AA:1 |
| 27451: | AA:1 |
| 27452: | AA:1 |
| 27453: | AA:1 |
| 27454: | AA:1 |
| 27455: | AA:1 |
| 27456: | AA:1 |
| 27457: | AA:1 |
| 27458: | AA:1 |
| 27459: | AA:1 |
| 27460: | AA:1 |
| 27461: | AA:1 |
| 27462: | AA:1 |
| 27463: | AA:1 |
| 27464: | AA:1 |
| 27465: | AA:1 |
| 27466: | AA:1 |
| 27467: | AA:1 |
| 27468: | AA:1 |
| 27469: | AA:1 |
| 27470: | AA:1 |
| 27471: | AA:1 |
| 27472: | AA:1 |
| 27473: | AA:1 |
| 27474: | AA:1 |
| 27475: | AA:1 |
| 27476: | AA:1 |
| 27477: | AA:1 |
| 27478: | AA:1 |
| 27479: | AA:1 |
| 27480: | AA:1 |
| 27481: | AA:1 |
| 27482: | AA:1 |
| 27483: | AA:1 |
| 27484: | AA:1 |
| 27485: | AA:1 |
| 27486: | AA:1 |
| 27487: | AA:1 |
| 27488: | AA:1 |
| 27489: | AA:1 |
| 27490: | AA:1 |
| 27491: | AA:1 |
| 27492: | AA:1 |
| 27493: | AA:1 |
| 27494: | AA:1 |
| 27495: | AA:1 |
| 27496: | AA:1 |
| 27497: | AA:1 |
| 27498: | AA:1 |
| 27499: | AA:1 |
| 27500: | AA:1 |
| 27501: | AA:1 |
| 27502: | AA:1 |
| 27503: | AA:1 |
| 27504: | AA:1 |
| 27505: | AA:1 |
| 27506: | AA:1 |
| 27507: | AA:1 |
| 27508: | AA:1 |
| 27509: | AA:1 |
| 27510: | AA:1 |
| 27511: | AA:1 |
| 27512: | AA:1 |
| 27513: | AA:1 |
| 27514: | AA:1 |
| 27515: | AA:1 |
| 27516: | AA:1 |
| 27517: | AA:1 |
| 27518: | AA:1 |
| 27519: | AA:1 |
| 27520: | AA:1 |
| 27521: | AA:1 |
| 27522: | AA:1 |
| 27523: | AA:1 |

TABLE II-continued

| SEQ ID NO. | Spatial Distribution |
|---|---|
| 27524: | AA:1 |
| 27525: | AA:1 |
| 27526: | AA:1 |
| 27527: | AA:1 |
| 27528: | AA:1 |
| 27529: | AA:1 |
| 27530: | AA:1 |
| 27531: | AA:1 |
| 27532: | AA:1 |
| 27533: | AA:1 |
| 27534: | AA:1 |
| 27535: | AA:1 |
| 27536: | AA:1 |
| 27537: | AA:1 |
| 27538: | AA:1 |
| 27539: | AA:1 |
| 27540: | AA:1 |
| 27541: | AA:1 |
| 27542: | AA:1 |
| 27543: | AA:1 |
| 27544: | AA:1 |
| 27545: | AA:1 |
| 27546: | AA:1 |
| 27547: | AA:1 |
| 27548: | AA:1 |
| 27549: | AA:1 |
| 27550: | AA:1 |
| 27551: | AA:1 |
| 27552: | AA:1 |
| 27553: | AA:1 |
| 27554: | AA:1 |
| 27555: | AA:1 |
| 27556: | AA:1 |
| 27557: | AA:1 |
| 27558: | AA:1 |
| 27559: | AA:1 |
| 27560: | AA:1 |
| 27561: | AA:1 |
| 27562: | AA:1 |
| 27563: | AA:1 |
| 27564: | AA:1 |
| 27565: | AA:1 |
| 27566: | AA:1 |
| 27567: | AA:1 |
| 27568: | AA:1 |
| 27569: | AA:1 |
| 27570: | AA:1 |
| 27571: | AA:1 |
| 27572: | AA:1 |
| 27573: | AA:1 |
| 27574: | AA:1 |
| 27575: | AA:1 |
| 27576: | AA:1 |
| 27577: | AA:1 |
| 27578: | AA:1 |
| 27579: | AA:1 |
| 27580: | AA:1 |
| 27581: | AA:1 |
| 27582: | AA:1 |
| 27583: | AA:1 |
| 27584: | AA:1 |
| 27585: | AA:1 |
| 27586: | AA:1 |
| 27587: | AA:1 |
| 27588: | AA:1 |
| 27589: | AA:1 |
| 27590: | AA:1 |
| 27591: | AA:1 |
| 27592: | AA:1 |
| 27593: | AA:1 |
| 27594: | AA:1 |
| 27595: | AA:1 |
| 27596: | AA:1 |
| 27597: | AA:1 |
| 27598: | AA:1 |
| 27599: | AA:1 |
| 27600: | AA:1 |
| 27601: | AA:1 |
| 27602: | AA:1 |
| 27603: | AA:1 |
| 27604: | AA:1 |
| 27605: | AA:1 |
| 27606: | AA:1 |
| 27607: | AA:1 |
| 27608: | AA:1 |
| 27609: | AA:1 |
| 27610: | AA:1 |
| 27611: | AA:1 |
| 27612: | AA:1 |
| 27613: | AA:1 |
| 27614: | AA:1 |
| 27615: | AA:1 |
| 27616: | AA:1 |
| 27617: | AA:1 |
| 27618: | AA:1 |
| 27619: | AA:1 |
| 27620: | AA:1 |
| 27621: | AA:1 |
| 27622: | AA:1 |
| 27623: | AA:1 |
| 27624: | AA:1 |
| 27625: | AA:1 |
| 27626: | AA:1 |
| 27627: | AA:1 |
| 27628: | AA:1 |
| 27629: | AA:1 |
| 27630: | AA:1 |
| 27631: | AA:1 |
| 27632: | AA:1 |
| 27633: | AA:1 |
| 27634: | AA:1 |
| 27635: | AA:1 |
| 27636: | AA:1 |
| 27637: | AA:1 |
| 27638: | AA:1 |
| 27639: | AA:1 |
| 27640: | AA:1 |
| 27641: | AA:1 |
| 27642: | AA:1 |
| 27643: | AA:1 |
| 27644: | AA:1 |
| 27645: | AA:1 |
| 27646: | AA:1 |
| 27647: | AA:1 |
| 27648: | AA:1 |
| 27649: | AA:1 |
| 27650: | AA:1 |
| 27651: | AA:1 |
| 27652: | AA:1 |
| 27653: | AA:1 |
| 27654: | AA:1 |
| 27655: | AA:1 |
| 27656: | AA:1 |
| 27657: | AA:1 |
| 27658: | AA:1 |
| 27659: | AA:1 |
| 27660: | AA:1 |
| 27661: | AA:1 |
| 27662: | AA:1 |
| 27663: | AA:1 |
| 27664: | AA:1 |
| 27665: | AA:1 |
| 27666: | AA:1 |
| 27667: | AA:1 |
| 27668: | AA:1 |
| 27669: | AA:1 |
| 27670: | AA:1 |
| 27671: | AA:1 |
| 27672: | AA:1 |
| 27673: | AA:1 |
| 27674: | AA:1 |
| 27675: | AA:1 |
| 27676: | AA:1 |
| 27677: | AA:1 |

TABLE II-continued

| SEQ ID NO. | Spatial Distribution |
|---|---|
| 27678: | AA:1 |
| 27679: | AA:1 |
| 27680: | AA:1 |
| 27681: | AA:1 |
| 27682: | AA:1 |
| 27683: | AA:1 |
| 27684: | AA:1 |
| 27685: | AA:1 |
| 27686: | AA:1 |
| 27687: | AA:1 |
| 27688: | AA:1 |
| 27689: | AA:1 |
| 27690: | AA:1 |
| 27691: | AA:1 |
| 27692: | AA:1 |
| 27693: | AA:1 |
| 27694: | AA:1 |
| 27695: | AA:1 |
| 27696: | AA:1 |
| 27697: | AA:1 |
| 27698: | AA:1 |
| 27699: | AA:1 |
| 27700: | AA:1 |
| 27701: | AA:1 |
| 27702: | AA:1 |
| 27703: | AA:1 |
| 27704: | AA:1 |
| 27705: | AA:1 |
| 27706: | AA:1 |
| 27707: | AA:1 |
| 27708: | AA:1 |
| 27709: | AA:1 |
| 27710: | AA:1 |
| 27711: | AA:1 |
| 27712: | AA:1 |
| 27713: | AA:1 |
| 27714: | AA:1 |
| 27715: | AA:1 |
| 27716: | AA:1 |
| 27717: | AA:1 |
| 27718: | AA:1 |
| 27719: | AA:1 |
| 27720: | AA:1 |
| 27721: | AA:1 |
| 27722: | AA:1 |
| 27723: | AA:1 |
| 27724: | AA:1 |
| 27725: | AA:1 |
| 27726: | AA:1 |
| 27727: | AA:1 |
| 27728: | AA:1 |
| 27729: | AA:1 |
| 27730: | AA:1 |
| 27731: | AA:1 |
| 27732: | AA:1 |
| 27733: | AA:1 |
| 27734: | AA:1 |
| 27735: | AA:1 |
| 27736: | AA:1 |
| 27737: | AA:1 |
| 27738: | AA:1 |
| 27739: | AA:1 |
| 27740: | AA:1 |
| 27741: | AA:1 |
| 27742: | AA:1 |
| 27743: | AA:1 |
| 27744: | AA:1 |
| 27745: | AA:1 |
| 27746: | AA:1 |
| 27747: | AA:1 |
| 27748: | AA:1 |
| 27749: | AA:1 |
| 27750: | AA:1 |
| 27751: | AA:1 |
| 27752: | AA:1 |
| 27753: | AA:1 |
| 27754: | AA:1 |
| 27755: | AA:1 |
| 27756: | AA:1 |
| 27757: | AA:1 |
| 27758: | AA:1 |
| 27759: | AA:1 |
| 27760: | AA:1 |
| 27761: | AA:1 |
| 27762: | AA:1 |
| 27763: | AA:1 |
| 27764: | AA:1 |
| 27765: | AA:1 |
| 27766: | AA:1 |
| 27767: | AA:1 |
| 27768: | AA:1 |
| 27769: | AA:1 |
| 27770: | AA:1 |
| 27771: | AA:1 |
| 27772: | AA:1 |
| 27773: | AA:1 |
| 27774: | AA:1 |
| 27775: | AA:1 |
| 27776: | AA:1 |
| 27777: | AA:1 |
| 27778: | AA:1 |
| 27779: | AA:1 |
| 27780: | AA:1 |
| 27781: | AA:1 |
| 27782: | AA:1 |
| 27783: | AA:1 |
| 27784: | AA:1 |
| 27785: | AA:1 |
| 27786: | AA:1 |
| 27787: | AA:1 |
| 27788: | AA:1 |
| 27789: | AA:1 |
| 27790: | AA:1 |
| 27791: | AA:1 |
| 27792: | AA:1 |
| 27793: | AA:1 |
| 27794: | AA:1 |
| 27795: | AA:1 |
| 27796: | AA:1 |
| 27797: | AA:1 |
| 27798: | AA:1 |
| 27799: | AA:1 |
| 27800: | AA:1 |
| 27801: | AA:1 |
| 27802: | AA:1 |
| 27803: | AA:1 |
| 27804: | AA:1 |
| 27805: | AA:1 |
| 27806: | AA:1 |
| 27807: | AA:1 |
| 27808: | AA:1 |
| 27809: | AA:1 |
| 27810: | AA:1 |
| 27811: | AA:1 |
| 27812: | AA:1 |
| 27813: | AA:1 |
| 27814: | AA:1 |
| 27815: | AA:1 |
| 27816: | AA:1 |
| 27817: | AA:1 |
| 27818: | AA:1 |
| 27819: | AA:1 |
| 27820: | AA:1 |
| 27821: | AA:1 |
| 27822: | AA:1 |
| 27823: | AA:1 |
| 27824: | AA:1 |
| 27825: | AA:1 |
| 27826: | AA:1 |
| 27827: | AA:1 |
| 27828: | AA:1 |
| 27829: | AA:1 |
| 27830: | AA:1 |
| 27831: | AA:1 |

TABLE II-continued

| SEQ ID NO. | Spatial Distribution |
|---|---|
| 27832: | AA:1 |
| 27833: | AA:1 |
| 27834: | AA:1 |
| 27835: | AA:1 |
| 27836: | AA:1 |
| 27837: | AA:1 |
| 27838: | AA:1 |
| 27839: | AA:1 |
| 27840: | AA:1 |
| 27841: | AA:1 |
| 27842: | AA:1 |
| 27843: | AA:1 |
| 27844: | AA:1 |
| 27845: | AA:1 |
| 27846: | AA:1 |
| 27847: | AA:1 |
| 27848: | AA:1 |
| 27849: | AA:1 |
| 27850: | AA:1 |
| 27851: | AA:1 |
| 27852: | AA:1 |
| 27853: | AA:1 |
| 27854: | AA:1 |
| 27855: | AA:1 |
| 27856: | AA:1 |
| 27857: | AA:1 |
| 27858: | AA:1 |
| 27859: | AA:1 |
| 27860: | AA:1 |
| 27861: | AA:1 |
| 27862: | AA:1 |
| 27863: | AA:1 |
| 27864: | AA:1 |
| 27865: | AA:1 |
| 27866: | AA:1 |
| 27867: | AA:1 |
| 27868: | AA:1 |
| 27869: | AA:1 |
| 27870: | AA:1 |
| 27871: | AA:1 |
| 27872: | AA:1 |
| 27873: | AA:1 |
| 27874: | AA:1 |
| 27875: | AA:1 |
| 27876: | AA:1 |
| 27877: | AA:1 |
| 27878: | AA:1 |
| 27879: | AA:1 |
| 27880: | AA:1 |
| 27881: | AA:1 |
| 27882: | AA:1 |
| 27883: | AA:1 |
| 27884: | AA:1 |
| 27885: | AA:1 |
| 27886: | AA:1 |
| 27887: | AA:1 |
| 27888: | AA:1 |
| 27889: | AA:1 |
| 27890: | AA:1 |
| 27891: | AA:1 |
| 27892: | AA:1 |
| 27893: | AA:1 |
| 27894: | AA:1 |
| 27895: | AA:1 |
| 27896: | AA:1 |
| 27897: | AA:1 |
| 27898: | AA:1 |
| 27899: | AA:1 |
| 27900: | AA:1 |
| 27901: | AA:1 |
| 27902: | AA:1 |
| 27903: | AA:1 |
| 27904: | AA:1 |
| 27905: | AA:1 |
| 27906: | AA:1 |
| 27907: | AA:1 |
| 27908: | AA:1 |
| 27909: | AA:1 |
| 27910: | AA:1 |
| 27911: | AA:1 |
| 27912: | AA:1 |
| 27913: | AA:1 |
| 27914: | AA:1 |
| 27915: | AA:1 |
| 27916: | AA:1 |
| 27917: | AA:1 |
| 27918: | AA:1 |
| 27919: | AA:1 |
| 27920: | AA:1 |
| 27921: | AA:1 |
| 27922: | AA:1 |
| 27923: | AA:1 |
| 27924: | AA:1 |
| 27925: | AA:1 |
| 27926: | AA:1 |
| 27927: | AA:1 |
| 27928: | AA:1 |
| 27929: | AA:1 |
| 27930: | AA:1 |
| 27931: | AA:1 |
| 27932: | AA:1 |
| 27933: | AA:1 |
| 27934: | AA:1 |
| 27935: | AA:1 |
| 27936: | AA:1 |
| 27937: | AA:1 |
| 27938: | AA:1 |
| 27939: | AA:1 |
| 27940: | AA:1 |
| 27941: | AA:1 |
| 27942: | AA:1 |
| 27943: | AA:1 |
| 27944: | AA:1 |
| 27945: | AA:1 |
| 27946: | AA:1 |
| 27947: | AA:1 |
| 27948: | AA:1 |
| 27949: | AA:1 |
| 27950: | AA:1 |
| 27951: | AA:1 |
| 27952: | AA:1 |
| 27953: | AA:1 |
| 27954: | AA:1 |
| 27955: | AA:1 |
| 27956: | AA:1 |
| 27957: | AA:1 |
| 27958: | AA:1 |
| 27959: | AA:1 |
| 27960: | AA:1 |
| 27961: | AA:1 |
| 27962: | AA:1 |
| 27963: | AA:1 |
| 27964: | AA:1 |
| 27965: | AA:1 |
| 27966: | AA:1 |
| 27967: | AA:1 |
| 27968: | AA:1 |
| 27969: | AA:1 |
| 27970: | AA:1 |
| 27971: | AA:1 |
| 27972: | AA:1 |
| 27973: | AA:1 |
| 27974: | AA:1 |
| 27975: | AA:1 |
| 27976: | AA:1 |
| 27977: | AA:1 |
| 27978: | AA:1 |
| 27979: | AA:1 |
| 27980: | AA:1 |
| 27981: | AA:1 |
| 27982: | AA:1 |
| 27983: | AA:1 |
| 27984: | AA:1 |
| 27985: | AA:1 |

TABLE II-continued

| SEQ ID NO. | Spatial Distribution |
|---|---|
| 27986: | AA:1 |
| 27987: | AA:1 |
| 27988: | AA:1 |
| 27989: | AA:1 |
| 27990: | AA:1 |
| 27991: | AA:1 |
| 27992: | AA:1 |
| 27993: | AA:1 |
| 27994: | AA:1 |
| 27995: | AA:1 |
| 27996: | AA:1 |
| 27997: | AA:1 |
| 27998: | AA:1 |
| 27999: | AA:1 |
| 28000: | AA:1 |
| 28001: | AA:1 |
| 28002: | AA:1 |
| 28003: | AA:1 |
| 28004: | AA:1 |
| 28005: | AA:1 |
| 28006: | AA:1 |
| 28007: | AA:1 |
| 28008: | AA:1 |
| 28009: | AA:1 |
| 28010: | AA:1 |
| 28011: | AA:1 |
| 28012: | AA:1 |
| 28013: | AA:1 |
| 28014: | AA:1 |
| 28015: | AA:1 |
| 28016: | AA:1 |
| 28017: | AA:1 |
| 28018: | AA:1 |
| 28019: | AA:1 |
| 28020: | AA:1 |
| 28021: | AA:1 |
| 28022: | AA:1 |
| 28023: | AA:1 |
| 28024: | AA:1 |
| 28025: | AA:1 |
| 28026: | AA:1 |
| 28027: | AA:1 |
| 28028: | AA:1 |
| 28029: | AA:1 |
| 28030: | AA:1 |
| 28031: | AA:1 |
| 28032: | AA:1 |
| 28033: | AA:1 |
| 28034: | AA:1 |
| 28035: | AA:1 |
| 28036: | AA:1 |
| 28037: | AA:1 |
| 28038: | AA:1 |
| 28039: | AA:1 |
| 28040: | AA:1 |
| 28041: | AA:1 |
| 28042: | AA:1 |
| 28043: | AA:1 |
| 28044: | AA:1 |
| 28045: | AA:1 |
| 28046: | AA:1 |
| 28047: | AA:1 |
| 28048: | AA:1 |
| 28049: | AA:1 |
| 28050: | AA:1 |
| 28051: | AA:1 |
| 28052: | AA:1 |
| 28053: | AA:1 |
| 28054: | AA:1 |
| 28055: | AA:1 |
| 28056: | AA:1 |
| 28057: | AA:1 |
| 28058: | AA:1 |
| 28059: | AA:1 |
| 28060: | AA:1 |
| 28061: | AA:1 |
| 28062: | AA:1 |
| 28063: | AA:1 |
| 28064: | AA:1 |
| 28065: | AA:1 |
| 28066: | AA:1 |
| 28067: | AA:1 |
| 28068: | AA:1 |
| 28069: | AA:1 |
| 28070: | AA:1 |
| 28071: | AA:1 |
| 28072: | AA:1 |
| 28073: | AA:1 |
| 28074: | AA:1 |
| 28075: | AA:1 |
| 28076: | AA:1 |
| 28077: | AA:1 |
| 28078: | AA:1 |
| 28079: | AA:1 |
| 28080: | AA:1 |
| 28081: | AA:1 |
| 28082: | AA:1 |
| 28083: | AA:1 |
| 28084: | AA:1 |
| 28085: | AA:1 |
| 28086: | AA:1 |
| 28087: | AA:1 |
| 28088: | AA:1 |
| 28089: | AA:1 |
| 28090: | AA:1 |
| 28091: | AA:1 |
| 28092: | AA:1 |
| 28093: | AA:1 |
| 28094: | AA:1 |
| 28095: | AA:1 |
| 28096: | AA:1 |
| 28097: | AA:1 |
| 28098: | AA:1 |
| 28099: | AA:1 |
| 28100: | AA:1 |
| 28101: | AA:1 |
| 28102: | AA:1 |
| 28103: | AA:1 |
| 28104: | AA:1 |
| 28105: | AA:1 |
| 28106: | AA:1 |
| 28107: | AA:1 |
| 28108: | AA:1 |
| 28109: | AA:1 |
| 28110: | AA:1 |
| 28111: | AA:1 |
| 28112: | AA:1 |
| 28113: | AA:1 |
| 28114: | AA:1 |
| 28115: | AA:1 |
| 28116: | AA:1 |
| 28117: | AA:1 |
| 28118: | AA:1 |
| 28119: | AA:1 |
| 28120: | AA:1 |
| 28121: | AA:1 |
| 28122: | AA:1 |
| 28123: | AA:1 |
| 28124: | AA:1 |
| 28125: | AA:1 |
| 28126: | AA:1 |
| 28127: | AA:1 |
| 28128: | AA:1 |
| 28129: | AA:1 |
| 28130: | AA:1 |
| 28131: | AA:1 |
| 28132: | AA:1 |
| 28133: | AA:1 |
| 28134: | AA:1 |
| 28135: | AA:1 |
| 28136: | AA:1 |
| 28137: | AA:1 |
| 28138: | AA:1 |
| 28139: | AA:1 |

TABLE II-continued

| SEQ ID NO. | Spatial Distribution |
|---|---|
| 28140: | AA:1 |
| 28141: | AA:1 |
| 28142: | AA:1 |
| 28143: | AA:1 |
| 28144: | AA:1 |
| 28145: | AA:1 |
| 28146: | AA:1 |
| 28147: | AA:1 |
| 28148: | AA:1 |
| 28149: | AA:1 |
| 28150: | AA:1 |
| 28151: | AA:1 |
| 28152: | AA:1 |
| 28153: | AA:1 |
| 28154: | AA:1 |
| 28155: | AA:1 |
| 28156: | AA:1 |
| 28157: | AA:1 |
| 28158: | AA:1 |
| 28159: | AA:1 |
| 28160: | AA:1 |
| 28161: | AA:1 |
| 28162: | AA:1 |
| 28163: | AA:1 |
| 28164: | AA:1 |
| 28165: | AA:1 |
| 28166: | AA:1 |
| 28167: | AA:1 |
| 28168: | AA:1 |
| 28169: | AA:1 |
| 28170: | AA:1 |
| 28171: | AA:1 |
| 28172: | AA:1 |
| 28173: | AA:1 |
| 28174: | AA:1 |
| 28175: | AA:1 |
| 28176: | N:1 |
| 28177: | N:1 |
| 28178: | N:1 |
| 28179: | N:1 |
| 28180: | N:1 |
| 28181: | N:1 |
| 28182: | N:1 |
| 28183: | N:1 |
| 28184: | N:1 |
| 28185: | N:1 |
| 28186: | N:1 |
| 28187: | N:1 |
| 28188: | N:1 |
| 28189: | N:1 |
| 28190: | N:1 |
| 28191: | N:1 |
| 28192: | N:1 |
| 28193: | N:1 |
| 28194: | N:1 |
| 28195: | N:1 |
| 28196: | N:1 |
| 28197: | N:1 |
| 28198: | N:1 |
| 28199: | N:1 |
| 28200: | N:1 |
| 28201: | N:1 |
| 28202: | N:1 |
| 28203: | N:1 |
| 28204: | N:1 |
| 28205: | N:1 |
| 28206: | N:1 |
| 28207: | N:1 |
| 28208: | N:1 |
| 28209: | N:1 |
| 28210: | N:1 |
| 28211: | N:1 |
| 28212: | N:1 |
| 28213: | N:1 |
| 28214: | N:1 |
| 28215: | N:1 |
| 28216: | N:1 |
| 28217: | N:1 |
| 28218: | N:1 |
| 28219: | N:1 |
| 28220: | N:1 |
| 28221: | N:1 |
| 28222: | N:1 |
| 28223: | N:1 |
| 28224: | N:1 |
| 28225: | N:1 |
| 28226: | N:1 |
| 28227: | N:1 |
| 28228: | N:1 |
| 28229: | N:1 |
| 28230: | N:1 |
| 28231: | N:1 |
| 28232: | X:1 |
| 28233: | X:1 |
| 28234: | X:1 |
| 28235: | X:1 |
| 28236: | X:1 |
| 28237: | X:1 |
| 28238: | X:1 |
| 28239: | X:1 |
| 28240: | X:1 |
| 28241: | X:1 |
| 28242: | X:1 |
| 28243: | X:1 |
| 28244: | X:1 |
| 28245: | X:1 |
| 28246: | X:1 |
| 28247: | X:1 |
| 28248: | X:1 |
| 28249: | X:1 |
| 28250: | X:1 |
| 28251: | X:1 |
| 28252: | X:1 |
| 28253: | X:1 |
| 28254: | X:1 |
| 28255: | X:1 |
| 28256: | X:1 |
| 28257: | X:1 |
| 28258: | X:1 |
| 28259: | X:1 |
| 28260: | X:1 |
| 28261: | X:1 |
| 28262: | X:1 |
| 28263: | X:1 |
| 28264: | X:1 |
| 28265: | X:1 |
| 28266: | X:1 |
| 28267: | X:1 |
| 28268: | X:1 |
| 28269: | X:1 |
| 28270: | X:1 |
| 28271: | X:1 |
| 28272: | X:1 |
| 28273: | X:1 |
| 28274: | X:1 |
| 28275: | X:1 |
| 28276: | X:1 |
| 28277: | X:1 |
| 28278: | X:1 |
| 28279: | X:1 |
| 28280: | X:1 |
| 28281: | X:1 |
| 28282: | X:1 |
| 28283: | X:1 |
| 28284: | X:1 |
| 28285: | X:1 |
| 28286: | X:1 |
| 28287: | X:1 |
| 28288: | X:1 |
| 28289: | X:1 |
| 28290: | X:1 |
| 28291: | X:1 |
| 28292: | X:1 |
| 28293: | X:1 |

TABLE II-continued

| SEQ ID NO. | Spatial Distribution |
|---|---|
| 28294: | X:1 |
| 28295: | X:1 |
| 28296: | X:1 |
| 28297: | X:1 |
| 28298: | X:1 |
| 28299: | X:1 |
| 28300: | X:1 |
| 28301: | X:1 |
| 28302: | X:1 |
| 28303: | X:1 |
| 28304: | X:1 |
| 28305: | X:1 |
| 28306: | X:1 |
| 28307: | X:1 |
| 28308: | X:1 |
| 28309: | X:1 |
| 28310: | X:1 |
| 28311: | X:1 |
| 28312: | X:1 |
| 28313: | X:1 |
| 28314: | X:1 |
| 28315: | X:1 |
| 28316: | X:1 |
| 28317: | X:1 |
| 28318: | X:1 |
| 28319: | D:1 |
| 28320: | D:1 |
| 28321: | D:1 |
| 28322: | D:1 |
| 28323: | D:1 |
| 28324: | D:1 |
| 28325: | D:1 |
| 28326: | D:1 |
| 28327: | D:1 |
| 28328: | D:1 |
| 28329: | D:1 |
| 28330: | D:1 |
| 28331: | D:1 |
| 28332: | D:1 |
| 28333: | D:1 |
| 28334: | D:1 |
| 28335: | D:1 |
| 28336: | D:1 |
| 28337: | D:1 |
| 28338: | D:1 |
| 28339: | D:1 |
| 28340: | D:1 |
| 28341: | D:1 |
| 28342: | D:1 |
| 28343: | D:1 |
| 28344: | D:1 |
| 28345: | D:1 |
| 28346: | D:1 |
| 28347: | D:1 |
| 28348: | D:1 |
| 28349: | D:1 |
| 28350: | D:1 |
| 28351: | D:1 |
| 28352: | D:1 |
| 28353: | D:1 |
| 28354: | D:1 |
| 28355: | D:1 |
| 28356: | D:1 |
| 28357: | D:1 |
| 28358: | D:1 |
| 28359: | D:1 |
| 28360: | D:1 |
| 28361: | D:1 |
| 28362: | D:1 |
| 28363: | D:1 |
| 28364: | D:1 |
| 28365: | D:1 |
| 28366: | D:1 |
| 28367: | D:1 |
| 28368: | D:1 |
| 28369: | D:1 |
| 28370: | D:1 |
| 28371: | D:1 |
| 28372: | D:1 |
| 28373: | D:1 |
| 28374: | D:1 |
| 28375: | D:1 |
| 28376: | D:1 |
| 28377: | D:1 |
| 28378: | D:1 |
| 28379: | D:1 |
| 28380: | D:1 |
| 28381: | D:1 |
| 28382: | D:1 |
| 28383: | D:1 |
| 28384: | D:1 |
| 28385: | D:1 |
| 28386: | D:1 |
| 28387: | D:1 |
| 28388: | D:1 |
| 28389: | D:1 |
| 28390: | D:1 |
| 28391: | D:1 |
| 28392: | D:1 |
| 28393: | D:1 |
| 28394: | D:1 |
| 28395: | D:1 |
| 28396: | D:1 |
| 28397: | D:1 |
| 28398: | D:1 |
| 28399: | D:1 |
| 28400: | D:1 |
| 28401: | D:1 |
| 28402: | D:1 |
| 28403: | D:1 |
| 28404: | D:1 |
| 28405: | D:1 |
| 28406: | D:1 |
| 28407: | D:1 |
| 28408: | D:1 |
| 28409: | D:1 |
| 28410: | D:1 |
| 28411: | D:1 |
| 28412: | D:1 |
| 28413: | D:1 |
| 28414: | D:1 |
| 28415: | D:1 |
| 28416: | D:1 |
| 28417: | D:1 |
| 28418: | D:1 |
| 28419: | D:1 |
| 28420: | D:1 |
| 28421: | D:1 |
| 28422: | D:1 |
| 28423: | D:1 |
| 28424: | D:1 |
| 28425: | D:1 |
| 28426: | D:1 |
| 28427: | D:1 |
| 28428: | D:1 |
| 28429: | D:1 |
| 28430: | D:1 |
| 28431: | D:1 |
| 28432: | D:1 |
| 28433: | D:1 |
| 28434: | D:1 |
| 28435: | D:1 |
| 28436: | D:1 |
| 28437: | D:1 |
| 28438: | D:1 |
| 28439: | D:1 |
| 28440: | D:1 |
| 28441: | D:1 |
| 28442: | D:1 |
| 28443: | D:1 |
| 28444: | D:1 |
| 28445: | D:1 |
| 28446: | D:1 |
| 28447: | D:1 |

TABLE II-continued

| SEQ ID NO. | Spatial Distribution |
|---|---|
| 28448: | D:1 |
| 28449: | D:1 |
| 28450: | D:1 |
| 28451: | D:1 |
| 28452: | D:1 |
| 28453: | D:1 |
| 28454: | D:1 |
| 28455: | D:1 |
| 28456: | D:1 |
| 28457: | D:1 |
| 28458: | D:1 |
| 28459: | D:1 |
| 28460: | D:1 |
| 28461: | D:1 |
| 28462: | D:1 |
| 28463: | D:1 |
| 28464: | D:1 |
| 28465: | D:1 |
| 28466: | D:1 |
| 28467: | D:1 |
| 28468: | D:1 |
| 28469: | D:1 |
| 28470: | D:1 |
| 28471: | D:1 |
| 28472: | D:1 |
| 28473: | D:1 |
| 28474: | D:1 |
| 28475: | D:1 |
| 28476: | D:1 |
| 28477: | D:1 |
| 28478: | D:1 |
| 28479: | D:1 |
| 28480: | D:1 |
| 28481: | D:1 |
| 28482: | D:1 |
| 28483: | D:1 |
| 28484: | D:1 |
| 28485: | D:1 |
| 28486: | D:1 |
| 28487: | D:1 |
| 28488: | D:1 |
| 28489: | D:1 |
| 28490: | D:1 |
| 28491: | D:1 |
| 28492: | D:1 |
| 28493: | D:1 |
| 28494: | D:1 |
| 28495: | D:1 |
| 28496: | D:1 |
| 28497: | D:1 |
| 28498: | D:1 |
| 28499: | D:1 |
| 28500: | D:1 |
| 28501: | D:1 |
| 28502: | D:1 |
| 28503: | D:1 |
| 28504: | D:1 |
| 28505: | D:1 |
| 28506: | D:1 |
| 28507: | D:1 |
| 28508: | D:1 |
| 28509: | D:1 |
| 28510: | D:1 |
| 28511: | D:1 |
| 28512: | D:1 |
| 28513: | D:1 |
| 28514: | D:1 |
| 28515: | D:1 |
| 28516: | D:1 |
| 28517: | D:1 |
| 28518: | D:1 |
| 28519: | D:1 |
| 28520: | D:1 |
| 28521: | D:1 |
| 28522: | D:1 |
| 28523: | D:1 |
| 28524: | D:1 |
| 28525: | D:1 |
| 28526: | D:1 |
| 28527: | D:1 |
| 28528: | D:1 |
| 28529: | D:1 |
| 28530: | D:1 |
| 28531: | D:1 |
| 28532: | D:1 |
| 28533: | D:1 |
| 28534: | D:1 |
| 28535: | D:1 |
| 28536: | D:1 |
| 28537: | D:1 |
| 28538: | D:1 |
| 28539: | D:1 |
| 28540: | D:1 |
| 28541: | D:1 |
| 28542: | D:1 |
| 28543: | D:1 |
| 28544: | D:1 |
| 28545: | D:1 |
| 28546: | D:1 |
| 28547: | D:1 |
| 28548: | D:1 |
| 28549: | D:1 |
| 28550: | D:1 |
| 28551: | D:1 |
| 28552: | D:1 |
| 28553: | D:1 |
| 28554: | D:1 |
| 28555: | D:1 |
| 28556: | D:1 |
| 28557: | D:1 |
| 28558: | D:1 |
| 28559: | D:1 |
| 28560: | D:1 |
| 28561: | D:1 |
| 28562: | D:1 |
| 28563: | D:1 |
| 28564: | D:1 |
| 28565: | D:1 |
| 28566: | D:1 |
| 28567: | D:1 |
| 28568: | D:1 |
| 28569: | D:1 |
| 28570: | D:1 |
| 28571: | D:1 |
| 28572: | D:1 |
| 28573: | D:1 |
| 28574: | D:1 |
| 28575: | D:1 |
| 28576: | D:1 |
| 28577: | D:1 |
| 28578: | D:1 |
| 28579: | D:1 |
| 28580: | D:1 |
| 28581: | D:1 |
| 28582: | D:1 |
| 28583: | D:1 |
| 28584: | D:1 |
| 28585: | D:1 |
| 28586: | D:1 |
| 28587: | D:1 |
| 28588: | D:1 |
| 28589: | D:1 |
| 28590: | D:1 |
| 28591: | D:1 |
| 28592: | D:1 |
| 28593: | D:1 |
| 28594: | D:1 |
| 28595: | D:1 |
| 28596: | D:1 |
| 28597: | D:1 |
| 28598: | D:1 |
| 28599: | D:1 |
| 28600: | D:1 |
| 28601: | D:1 |

TABLE II-continued

| SEQ ID NO. | Spatial Distribution |
|---|---|
| 28602: | D:1 |
| 28603: | G:1 |
| 28604: | G:1 |
| 28605: | G:1 |
| 28606: | G:1 |
| 28607: | G:1 |
| 28608: | G:1 |
| 28609: | G:1 |
| 28610: | G:1 |
| 28611: | G:1 |
| 28612: | G:1 |
| 28613: | G:1 |
| 28614: | G:1 |
| 28615: | G:1 |
| 28616: | G:1 |
| 28617: | G:1 |
| 28618: | G:1 |
| 28619: | G:1 |
| 28620: | G:1 |
| 28621: | G:1 |
| 28622: | G:1 |
| 28623: | G:1 |
| 28624: | G:1 |
| 28625: | G:1 |
| 28626: | G:1 |
| 28627: | G:1 |
| 28628: | G:1 |
| 28629: | G:1 |
| 28630: | G:1 |
| 28631: | G:1 |
| 28632: | G:1 |
| 28633: | G:1 |
| 28634: | G:1 |
| 28635: | G:1 |
| 28636: | G:1 |
| 28637: | G:1 |
| 28638: | G:1 |
| 28639: | G:1 |
| 28640: | G:1 |
| 28641: | G:1 |
| 28642: | G:1 |
| 28643: | G:1 |
| 28644: | G:1 |
| 28645: | G:1 |
| 28646: | G:1 |
| 28647: | G:1 |
| 28648: | G:1 |
| 28649: | G:1 |
| 28650: | G:1 |
| 28651: | G:1 |
| 28652: | G:1 |
| 28653: | G:1 |
| 28654: | G:1 |
| 28655: | G:1 |
| 28656: | G:1 |
| 28657: | G:1 |
| 28658: | G:1 |
| 28659: | G:1 |
| 28660: | G:1 |
| 28661: | G:1 |
| 28662: | G:1 |
| 28663: | G:1 |
| 28664: | G:1 |
| 28665: | G:1 |
| 28666: | G:1 |
| 28667: | G:1 |
| 28668: | G:1 |
| 28669: | G:1 |
| 28670: | G:1 |
| 28671: | G:1 |
| 28672: | G:1 |
| 28673: | G:1 |
| 28674: | G:1 |
| 28675: | G:1 |
| 28676: | G:1 |
| 28677: | G:1 |
| 28678: | G:1 |
| 28679: | G:1 |
| 28680: | G:1 |
| 28681: | G:1 |
| 28682: | G:1 |
| 28683: | G:1 |
| 28684: | G:1 |
| 28685: | G:1 |
| 28686: | G:1 |
| 28687: | G:1 |
| 28688: | G:1 |
| 28689: | G:1 |
| 28690: | G:1 |
| 28691: | G:1 |
| 28692: | G:1 |
| 28693: | G:1 |
| 28694: | G:1 |
| 28695: | G:1 |
| 28696: | G:1 |
| 28697: | G:1 |
| 28698: | G:1 |
| 28699: | G:1 |
| 28700: | G:1 |
| 28701: | G:1 |
| 28702: | G:1 |
| 28703: | G:1 |
| 28704: | G:1 |
| 28705: | G:1 |
| 28706: | G:1 |
| 28707: | G:1 |
| 28708: | G:1 |
| 28709: | G:1 |
| 28710: | G:1 |
| 28711: | G:1 |
| 28712: | G:1 |
| 28713: | G:1 |
| 28714: | G:1 |
| 28715: | G:1 |
| 28716: | G:1 |
| 28717: | G:1 |
| 28718: | G:1 |
| 28719: | G:1 |
| 28720: | G:1 |
| 28721: | G:1 |
| 28722: | G:1 |
| 28723: | G:1 |
| 28724: | G:1 |
| 28725: | G:1 |
| 28726: | G:1 |
| 28727: | G:1 |
| 28728: | G:1 |
| 28729: | G:1 |
| 28730: | G:1 |
| 28731: | G:1 |
| 28732: | G:1 |
| 28733: | G:1 |
| 28734: | G:1 |
| 28735: | G:1 |
| 28736: | G:1 |
| 28737: | G:1 |
| 28738: | G:1 |
| 28739: | G:1 |
| 28740: | G:1 |
| 28741: | G:1 |
| 28742: | G:1 |
| 28743: | G:1 |
| 28744: | G:1 |
| 28745: | G:1 |
| 28746: | G:1 |
| 28747: | G:1 |
| 28748: | G:1 |
| 28749: | G:1 |
| 28750: | G:1 |
| 28751: | G:1 |
| 28752: | G:1 |
| 28753: | G:1 |
| 28754: | G:1 |
| 28755: | G:1 |

TABLE II-continued

| SEQ ID NO. | Spatial Distribution |
|---|---|
| 28756: | G:1 |
| 28757: | G:1 |
| 28758: | G:1 |
| 28759: | G:1 |
| 28760: | G:1 |
| 28761: | G:1 |
| 28762: | G:1 |
| 28763: | G:1 |
| 28764: | G:1 |
| 28765: | G:1 |
| 28766: | G:1 |
| 28767: | G:1 |
| 28768: | G:1 |
| 28769: | G:1 |
| 28770: | G:1 |
| 28771: | G:1 |
| 28772: | G:1 |
| 28773: | G:1 |
| 28774: | G:1 |
| 28775: | G:1 |
| 28776: | G:1 |
| 28777: | G:1 |
| 28778: | G:1 |
| 28779: | G:1 |
| 28780: | G:1 |
| 28781: | G:1 |
| 28782: | G:1 |
| 28783: | G:1 |
| 28784: | G:1 |
| 28785: | G:1 |
| 28786: | G:1 |
| 28787: | G:1 |
| 28788: | G:1 |
| 28789: | G:1 |
| 28790: | G:1 |
| 28791: | G:1 |
| 28792: | G:1 |
| 28793: | G:1 |
| 28794: | G:1 |
| 28795: | G:1 |
| 28796: | G:1 |
| 28797: | G:1 |
| 28798: | G:1 |
| 28799: | G:1 |
| 28800: | G:1 |
| 28801: | G:1 |
| 28802: | G:1 |
| 28803: | G:1 |
| 28804: | G:1 |
| 28805: | G:1 |
| 28806: | G:1 |
| 28807: | G:1 |
| 28808: | G:1 |
| 28809: | G:1 |
| 28810: | G:1 |
| 28811: | G:1 |
| 28812: | G:1 |
| 28813: | G:1 |
| 28814: | G:1 |
| 28815: | G:1 |
| 28816: | G:1 |
| 28817: | G:1 |
| 28818: | G:1 |
| 28819: | G:1 |
| 28820: | G:1 |
| 28821: | G:1 |
| 28822: | G:1 |
| 28823: | G:1 |
| 28824: | G:1 |
| 28825: | G:1 |
| 28826: | G:1 |
| 28827: | G:1 |
| 28828: | G:1 |
| 28829: | G:1 |
| 28830: | G:1 |
| 28831: | G:1 |
| 28832: | G:1 |
| 28833: | G:1 |
| 28834: | G:1 |
| 28835: | G:1 |
| 28836: | G:1 |
| 28837: | G:1 |
| 28838: | G:1 |
| 28839: | G:1 |
| 28840: | G:1 |
| 28841: | G:1 |
| 28842: | G:1 |
| 28843: | G:1 |
| 28844: | G:1 |
| 28845: | G:1 |
| 28846: | G:1 |
| 28847: | G:1 |
| 28848: | G:1 |
| 28849: | G:1 |
| 28850: | G:1 |
| 28851: | G:1 |
| 28852: | G:1 |
| 28853: | G:1 |
| 28854: | G:1 |
| 28855: | G:1 |
| 28856: | G:1 |
| 28857: | G:1 |
| 28858: | G:1 |
| 28859: | G:1 |
| 28860: | G:1 |
| 28861: | G:1 |
| 28862: | G:1 |
| 28863: | G:1 |
| 28864: | G:1 |
| 28865: | G:1 |
| 28866: | G:1 |
| 28867: | G:1 |
| 28868: | G:1 |
| 28869: | G:1 |
| 28870: | G:1 |
| 28871: | G:1 |
| 28872: | G:1 |
| 28873: | G:1 |
| 28874: | G:1 |
| 28875: | G:1 |
| 28876: | G:1 |
| 28877: | G:1 |
| 28878: | G:1 |
| 28879: | G:1 |
| 28880: | G:1 |
| 28881: | G:1 |
| 28882: | G:1 |
| 28883: | G:1 |
| 28884: | G:1 |
| 28885: | G:1 |
| 28886: | G:1 |
| 28887: | G:1 |
| 28888: | G:1 |
| 28889: | G:1 |
| 28890: | G:1 |
| 28891: | G:1 |
| 28892: | G:1 |
| 28893: | G:1 |
| 28894: | G:1 |
| 28895: | G:1 |
| 28896: | G:1 |
| 28897: | G:1 |
| 28898: | G:1 |
| 28899: | G:1 |
| 28900: | G:1 |
| 28901: | G:1 |
| 28902: | G:1 |
| 28903: | G:1 |
| 28904: | G:1 |
| 28905: | G:1 |
| 28906: | G:1 |
| 28907: | G:1 |
| 28908: | G:1 |
| 28909: | G:1 |

TABLE II-continued

| SEQ ID NO. | Spatial Distribution |
|---|---|
| 28910: | G:1 |
| 28911: | G:1 |
| 28912: | G:1 |
| 28913: | G:1 |
| 28914: | G:1 |
| 28915: | G:1 |
| 28916: | G:1 |
| 28917: | G:1 |
| 28918: | G:1 |
| 28919: | G:1 |
| 28920: | G:1 |
| 28921: | G:1 |
| 28922: | G:1 |
| 28923: | G:1 |
| 28924: | G:1 |
| 28925: | G:1 |
| 28926: | G:1 |
| 28927: | G:1 |
| 28928: | G:1 |
| 28929: | G:1 |
| 28930: | G:1 |
| 28931: | G:1 |
| 28932: | G:1 |
| 28933: | G:1 |
| 28934: | G:1 |
| 28935: | G:1 |
| 28936: | G:1 |
| 28937: | G:1 |
| 28938: | G:1 |
| 28939: | G:1 |
| 28940: | G:1 |
| 28941: | G:1 |
| 28942: | G:1 |
| 28943: | G:1 |
| 28944: | G:1 |
| 28945: | G:1 |
| 28946: | G:1 |
| 28947: | G:1 |
| 28948: | G:1 |
| 28949: | G:1 |
| 28950: | G:1 |
| 28951: | G:1 |
| 28952: | G:1 |
| 28953: | G:1 |
| 28954: | G:1 |
| 28955: | G:1 |
| 28956: | G:1 |
| 28957: | G:1 |
| 28958: | G:1 |
| 28959: | G:1 |
| 28960: | G:1 |
| 28961: | G:1 |
| 28962: | G:1 |
| 28963: | G:1 |
| 28964: | G:1 |
| 28965: | G:1 |
| 28966: | G:1 |
| 28967: | G:1 |
| 28968: | G:1 |
| 28969: | G:1 |
| 28970: | G:1 |
| 28971: | G:1 |
| 28972: | G:1 |
| 28973: | G:1 |
| 28974: | G:1 |
| 28975: | G:1 |
| 28976: | G:1 |
| 28977: | G:1 |
| 28978: | G:1 |
| 28979: | G:1 |
| 28980: | G:1 |
| 28981: | G:1 |
| 28982: | G:1 |
| 28983: | G:1 |
| 28984: | G:1 |
| 28985: | G:1 |
| 28986: | G:1 |
| 28987: | G:1 |
| 28988: | G:1 |
| 28989: | G:1 |
| 28990: | G:1 |
| 28991: | G:1 |
| 28992: | G:1 |
| 28993: | G:1 |
| 28994: | G:1 |
| 28995: | G:1 |
| 28996: | G:1 |
| 28997: | G:1 |
| 28998: | G:1 |
| 28999: | G:1 |
| 29000: | G:1 |
| 29001: | G:1 |
| 29002: | G:1 |
| 29003: | G:1 |
| 29004: | G:1 |
| 29005: | G:1 |
| 29006: | G:1 |
| 29007: | G:1 |
| 29008: | G:1 |
| 29009: | G:1 |
| 29010: | G:1 |
| 29011: | G:1 |
| 29012: | G:1 |
| 29013: | G:1 |
| 29014: | G:1 |
| 29015: | G:1 |
| 29016: | G:1 |
| 29017: | G:1 |
| 29018: | G:1 |
| 29019: | G:1 |
| 29020: | G:1 |
| 29021: | G:1 |
| 29022: | G:1 |
| 29023: | G:1 |
| 29024: | G:1 |
| 29025: | G:1 |
| 29026: | G:1 |
| 29027: | G:1 |
| 29028: | G:1 |
| 29029: | G:1 |
| 29030: | G:1 |
| 29031: | G:1 |
| 29032: | G:1 |
| 29033: | G:1 |
| 29034: | G:1 |
| 29035: | G:1 |
| 29036: | G:1 |
| 29037: | G:1 |
| 29038: | G:1 |
| 29039: | G:1 |
| 29040: | G:1 |
| 29041: | G:1 |
| 29042: | G:1 |
| 29043: | G:1 |
| 29044: | G:1 |
| 29045: | G:1 |
| 29046: | G:1 |
| 29047: | G:1 |
| 29048: | G:1 |
| 29049: | G:1 |
| 29050: | G:1 |
| 29051: | G:1 |
| 29052: | G:1 |
| 29053: | G:1 |
| 29054: | G:1 |
| 29055: | G:1 |
| 29056: | G:1 |
| 29057: | G:1 |
| 29058: | G:1 |
| 29059: | G:1 |
| 29060: | G:1 |
| 29061: | G:1 |
| 29062: | G:1 |
| 29063: | G:1 |

TABLE II-continued

| SEQ ID NO. | Spatial Distribution |
|---|---|
| 29064: | G:1 |
| 29065: | G:1 |
| 29066: | G:1 |
| 29067: | G:1 |
| 29068: | G:1 |
| 29069: | G:1 |
| 29070: | G:1 |
| 29071: | G:1 |
| 29072: | G:1 |
| 29073: | G:1 |
| 29074: | G:1 |
| 29075: | G:1 |
| 29076: | G:1 |
| 29077: | G:1 |
| 29078: | G:1 |
| 29079: | G:1 |
| 29080: | G:1 |
| 29081: | G:1 |
| 29082: | G:1 |
| 29083: | G:1 |
| 29084: | G:1 |
| 29085: | G:1 |
| 29086: | G:1 |
| 29087: | G:1 |
| 29088: | G:1 |
| 29089: | G:1 |
| 29090: | G:1 |
| 29091: | G:1 |
| 29092: | G:1 |
| 29093: | G:1 |
| 29094: | G:1 |
| 29095: | G:1 |
| 29096: | G:1 |
| 29097: | G:1 |
| 29098: | G:1 |
| 29099: | G:1 |
| 29100: | G:1 |
| 29101: | G:1 |
| 29102: | G:1 |
| 29103: | G:1 |
| 29104: | G:1 |
| 29105: | G:1 |
| 29106: | G:1 |
| 29107: | G:1 |
| 29108: | G:1 |
| 29109: | G:1 |
| 29110: | G:1 |
| 29111: | G:1 |
| 29112: | G:1 |
| 29113: | G:1 |
| 29114: | G:1 |
| 29115: | G:1 |
| 29116: | G:1 |
| 29117: | G:1 |
| 29118: | G:1 |
| 29119: | G:1 |
| 29120: | G:1 |
| 29121: | G:1 |
| 29122: | G:1 |
| 29123: | G:1 |
| 29124: | G:1 |
| 29125: | G:1 |
| 29126: | G:1 |
| 29127: | G:1 |
| 29128: | G:1 |
| 29129: | G:1 |
| 29130: | G:1 |
| 29131: | G:1 |
| 29132: | G:1 |
| 29133: | G:1 |
| 29134: | G:1 |
| 29135: | G:1 |
| 29136: | G:1 |
| 29137: | G:1 |
| 29138: | G:1 |
| 29139: | G:1 |
| 29140: | G:1 |
| 29141: | G:1 |
| 29142: | G:1 |
| 29143: | G:1 |
| 29144: | G:1 |
| 29145: | G:1 |
| 29146: | G:1 |
| 29147: | G:1 |
| 29148: | G:1 |
| 29149: | G:1 |
| 29150: | G:1 |
| 29151: | G:1 |
| 29152: | G:1 |
| 29153: | G:1 |
| 29154: | G:1 |
| 29155: | G:1 |
| 29156: | G:1 |
| 29157: | G:1 |
| 29158: | G:1 |
| 29159: | G:1 |
| 29160: | G:1 |
| 29161: | G:1 |
| 29162: | G:1 |
| 29163: | G:1 |
| 29164: | G:1 |
| 29165: | G:1 |
| 29166: | G:1 |
| 29167: | G:1 |
| 29168: | G:1 |
| 29169: | G:1 |
| 29170: | G:1 |
| 29171: | G:1 |
| 29172: | G:1 |
| 29173: | G:1 |
| 29174: | G:1 |
| 29175: | G:1 |
| 29176: | G:1 |
| 29177: | G:1 |
| 29178: | G:1 |
| 29179: | G:1 |
| 29180: | G:1 |
| 29181: | G:1 |
| 29182: | G:1 |
| 29183: | G:1 |
| 29184: | G:1 |
| 29185: | G:1 |
| 29186: | G:1 |
| 29187: | G:1 |
| 29188: | G:1 |
| 29189: | G:1 |
| 29190: | G:1 |
| 29191: | G:1 |
| 29192: | G:1 |
| 29193: | G:1 |
| 29194: | G:1 |
| 29195: | G:1 |
| 29196: | G:1 |
| 29197: | G:1 |
| 29198: | G:1 |
| 29199: | G:1 |
| 29200: | G:1 |
| 29201: | G:1 |
| 29202: | G:1 |
| 29203: | G:1 |
| 29204: | G:1 |
| 29205: | G:1 |
| 29206: | G:1 |
| 29207: | G:1 |
| 29208: | G:1 |
| 29209: | G:1 |
| 29210: | G:1 |
| 29211: | G:1 |
| 29212: | G:1 |
| 29213: | G:1 |
| 29214: | G:1 |
| 29215: | G:1 |
| 29216: | G:1 |
| 29217: | G:1 |

TABLE II-continued

| SEQ ID NO. | Spatial Distribution |
|---|---|
| 29218: | G:1 |
| 29219: | G:1 |
| 29220: | G:1 |
| 29221: | G:1 |
| 29222: | G:1 |
| 29223: | G:1 |
| 29224: | G:1 |
| 29225: | G:1 |
| 29226: | G:1 |
| 29227: | G:1 |
| 29228: | G:1 |
| 29229: | G:1 |
| 29230: | G:1 |
| 29231: | G:1 |
| 29232: | G:1 |
| 29233: | G:1 |
| 29234: | G:1 |
| 29235: | G:1 |
| 29236: | G:1 |
| 29237: | G:1 |
| 29238: | G:1 |
| 29239: | G:1 |
| 29240: | G:1 |
| 29241: | G:1 |
| 29242: | G:1 |
| 29243: | G:1 |
| 29244: | G:1 |
| 29245: | G:1 |
| 29246: | G:1 |
| 29247: | G:1 |
| 29248: | G:1 |
| 29249: | G:1 |
| 29250: | G:1 |
| 29251: | G:1 |
| 29252: | G:1 |
| 29253: | G:1 |
| 29254: | G:1 |
| 29255: | G:1 |
| 29256: | G:1 |
| 29257: | G:1 |
| 29258: | G:1 |
| 29259: | G:1 |
| 29260: | G:1 |
| 29261: | G:1 |
| 29262: | G:1 |
| 29263: | G:1 |
| 29264: | G:1 |
| 29265: | G:1 |
| 29266: | G:1 |
| 29267: | G:1 |
| 29268: | G:1 |
| 29269: | G:1 |
| 29270: | G:1 |
| 29271: | G:1 |
| 29272: | G:1 |
| 29273: | G:1 |
| 29274: | G:1 |
| 29275: | G:1 |
| 29276: | G:1 |
| 29277: | G:1 |
| 29278: | G:1 |
| 29279: | G:1 |
| 29280: | G:1 |
| 29281: | G:1 |
| 29282: | G:1 |
| 29283: | G:1 |
| 29284: | G:1 |
| 29285: | G:1 |
| 29286: | G:1 |
| 29287: | G:1 |
| 29288: | G:1 |
| 29289: | G:1 |
| 29290: | G:1 |
| 29291: | G:1 |
| 29292: | G:1 |
| 29293: | G:1 |
| 29294: | G:1 |
| 29295: | G:1 |
| 29296: | G:1 |
| 29297: | G:1 |
| 29298: | G:1 |
| 29299: | G:1 |
| 29300: | G:1 |
| 29301: | G:1 |
| 29302: | G:1 |
| 29303: | G:1 |
| 29304: | G:1 |
| 29305: | G:1 |
| 29306: | G:1 |
| 29307: | G:1 |
| 29308: | G:1 |
| 29309: | G:1 |
| 29310: | G:1 |
| 29311: | G:1 |
| 29312: | G:1 |
| 29313: | G:1 |
| 29314: | G:1 |
| 29315: | G:1 |
| 29316: | G:1 |
| 29317: | G:1 |
| 29318: | G:1 |
| 29319: | G:1 |
| 29320: | G:1 |
| 29321: | G:1 |
| 29322: | G:1 |
| 29323: | G:1 |
| 29324: | G:1 |
| 29325: | G:1 |
| 29326: | G:1 |
| 29327: | G:1 |
| 29328: | G:1 |
| 29329: | G:1 |
| 29330: | G:1 |
| 29331: | G:1 |
| 29332: | G:1 |
| 29333: | G:1 |
| 29334: | G:1 |
| 29335: | G:1 |
| 29336: | G:1 |
| 29337: | G:1 |
| 29338: | G:1 |
| 29339: | G:1 |
| 29340: | G:1 |
| 29341: | G:1 |
| 29342: | G:1 |
| 29343: | G:1 |
| 29344: | G:1 |
| 29345: | G:1 |
| 29346: | G:1 |
| 29347: | G:1 |
| 29348: | G:1 |
| 29349: | G:1 |
| 29350: | G:1 |
| 29351: | G:1 |
| 29352: | G:1 |
| 29353: | G:1 |
| 29354: | G:1 |
| 29355: | G:1 |
| 29356: | G:1 |
| 29357: | G:1 |
| 29358: | G:1 |
| 29359: | G:1 |
| 29360: | G:1 |
| 29361: | G:1 |
| 29362: | G:1 |
| 29363: | G:1 |
| 29364: | G:1 |
| 29365: | G:1 |
| 29366: | G:1 |
| 29367: | G:1 |
| 29368: | G:1 |
| 29369: | G:1 |
| 29370: | G:1 |
| 29371: | G:1 |

TABLE II-continued

| SEQ ID NO. | Spatial Distribution |
|---|---|
| 29372: | G:1 |
| 29373: | G:1 |
| 29374: | G:1 |
| 29375: | G:1 |
| 29376: | G:1 |
| 29377: | G:1 |
| 29378: | G:1 |
| 29379: | G:1 |
| 29380: | G:1 |
| 29381: | G:1 |
| 29382: | G:1 |
| 29383: | G:1 |
| 29384: | G:1 |
| 29385: | G:1 |
| 29386: | G:1 |
| 29387: | G:1 |
| 29388: | G:1 |
| 29389: | G:1 |
| 29390: | G:1 |
| 29391: | G:1 |
| 29392: | G:1 |
| 29393: | G:1 |
| 29394: | G:1 |
| 29395: | G:1 |
| 29396: | G:1 |
| 29397: | G:1 |
| 29398: | G:1 |
| 29399: | G:1 |
| 29400: | G:1 |
| 29401: | G:1 |
| 29402: | G:1 |
| 29403: | G:1 |
| 29404: | G:1 |
| 29405: | G:1 |
| 29406: | G:1 |
| 29407: | G:1 |
| 29408: | G:1 |
| 29409: | G:1 |
| 29410: | G:1 |
| 29411: | G:1 |
| 29412: | G:1 |
| 29413: | G:1 |
| 29414: | G:1 |
| 29415: | G:1 |
| 29416: | G:1 |
| 29417: | G:1 |
| 29418: | G:1 |
| 29419: | G:1 |
| 29420: | G:1 |
| 29421: | G:1 |
| 29422: | G:1 |
| 29423: | G:1 |
| 29424: | G:1 |
| 29425: | G:1 |
| 29426: | G:1 |
| 29427: | G:1 |
| 29428: | G:1 |
| 29429: | G:1 |
| 29430: | G:1 |
| 29431: | G:1 |
| 29432: | G:1 |
| 29433: | G:1 |
| 29434: | G:1 |
| 29435: | G:1 |
| 29436: | G:1 |
| 29437: | G:1 |
| 29438: | G:1 |
| 29439: | G:1 |
| 29440: | G:1 |
| 29441: | G:1 |
| 29442: | G:1 |
| 29443: | G:1 |
| 29444: | G:1 |
| 29445: | G:1 |
| 29446: | G:1 |
| 29447: | G:1 |
| 29448: | G:1 |
| 29449: | G:1 |
| 29450: | G:1 |
| 29451: | G:1 |
| 29452: | G:1 |
| 29453: | G:1 |
| 29454: | G:1 |
| 29455: | G:1 |
| 29456: | G:1 |
| 29457: | G:1 |
| 29458: | G:1 |
| 29459: | G:1 |
| 29460: | G:1 |
| 29461: | G:1 |
| 29462: | G:1 |
| 29463: | G:1 |
| 29464: | G:1 |
| 29465: | G:1 |
| 29466: | G:1 |
| 29467: | G:1 |
| 29468: | G:1 |
| 29469: | G:1 |
| 29470: | G:1 |
| 29471: | G:1 |
| 29472: | G:1 |
| 29473: | G:1 |
| 29474: | G:1 |
| 29475: | G:1 |
| 29476: | G:1 |
| 29477: | G:1 |
| 29478: | G:1 |
| 29479: | G:1 |
| 29480: | G:1 |
| 29481: | G:1 |
| 29482: | G:1 |
| 29483: | G:1 |
| 29484: | G:1 |
| 29485: | G:1 |
| 29486: | G:1 |
| 29487: | G:1 |
| 29488: | G:1 |
| 29489: | G:1 |
| 29490: | G:1 |
| 29491: | G:1 |
| 29492: | G:1 |
| 29493: | G:1 |
| 29494: | G:1 |
| 29495: | G:1 |
| 29496: | G:1 |
| 29497: | G:1 |
| 29498: | G:1 |
| 29499: | G:1 |
| 29500: | G:1 |
| 29501: | G:1 |
| 29502: | G:1 |
| 29503: | G:1 |
| 29504: | G:1 |
| 29505: | G:1 |
| 29506: | G:1 |
| 29507: | G:1 |
| 29508: | G:1 |
| 29509: | G:1 |
| 29510: | G:1 |
| 29511: | G:1 |
| 29512: | G:1 |
| 29513: | G:1 |
| 29514: | G:1 |
| 29515: | G:1 |
| 29516: | G:1 |
| 29517: | G:1 |
| 29518: | G:1 |
| 29519: | G:1 |
| 29520: | G:1 |
| 29521: | G:1 |
| 29522: | G:1 |
| 29523: | G:1 |
| 29524: | G:1 |
| 29525: | G:1 |

TABLE II-continued

| SEQ ID NO. | Spatial Distribution |
|---|---|
| 29526: | G:1 |
| 29527: | G:1 |
| 29528: | G:1 |
| 29529: | G:1 |
| 29530: | G:1 |
| 29531: | G:1 |
| 29532: | G:1 |
| 29533: | G:1 |
| 29534: | G:1 |
| 29535: | G:1 |
| 29536: | G:1 |
| 29537: | G:1 |
| 29538: | G:1 |
| 29539: | G:1 |
| 29540: | G:1 |
| 29541: | G:1 |
| 29542: | G:1 |
| 29543: | G:1 |
| 29544: | G:1 |
| 29545: | G:1 |
| 29546: | G:1 |
| 29547: | G:1 |
| 29548: | G:1 |
| 29549: | G:1 |
| 29550: | G:1 |
| 29551: | G:1 |
| 29552: | G:1 |
| 29553: | G:1 |
| 29554: | G:1 |
| 29555: | G:1 |
| 29556: | G:1 |
| 29557: | G:1 |
| 29558: | G:1 |
| 29559: | G:1 |
| 29560: | G:1 |
| 29561: | G:1 |
| 29562: | G:1 |
| 29563: | G:1 |
| 29564: | G:1 |
| 29565: | G:1 |
| 29566: | G:1 |
| 29567: | G:1 |
| 29568: | G:1 |
| 29569: | G:1 |
| 29570: | G:1 |
| 29571: | G:1 |
| 29572: | G:1 |
| 29573: | G:1 |
| 29574: | G:1 |
| 29575: | G:1 |
| 29576: | G:1 |
| 29577: | G:1 |
| 29578: | G:1 |
| 29579: | G:1 |
| 29580: | G:1 |
| 29581: | G:1 |
| 29582: | G:1 |
| 29583: | G:1 |
| 29584: | G:1 |
| 29585: | G:1 |
| 29586: | G:1 |
| 29587: | G:1 |
| 29588: | G:1 |
| 29589: | G:1 |
| 29590: | G:1 |
| 29591: | G:1 |
| 29592: | G:1 |
| 29593: | G:1 |
| 29594: | G:1 |
| 29595: | G:1 |
| 29596: | G:1 |
| 29597: | G:1 |
| 29598: | G:1 |
| 29599: | G:1 |
| 29600: | G:1 |
| 29601: | G:1 |
| 29602: | G:1 |
| 29603: | G:1 |
| 29604: | G:1 |
| 29605: | G:1 |
| 29606: | G:1 |
| 29607: | G:1 |
| 29608: | G:1 |
| 29609: | G:1 |
| 29610: | G:1 |
| 29611: | G:1 |
| 29612: | G:1 |
| 29613: | G:1 |
| 29614: | G:1 |
| 29615: | G:1 |
| 29616: | G:1 |
| 29617: | G:1 |
| 29618: | G:1 |
| 29619: | G:1 |
| 29620: | G:1 |
| 29621: | G:1 |
| 29622: | G:1 |
| 29623: | G:1 |
| 29624: | G:1 |
| 29625: | G:1 |
| 29626: | G:1 |
| 29627: | G:1 |
| 29628: | G:1 |
| 29629: | G:1 |
| 29630: | G:1 |
| 29631: | G:1 |
| 29632: | G:1 |
| 29633: | G:1 |
| 29634: | G:1 |
| 29635: | G:1 |
| 29636: | G:1 |
| 29637: | G:1 |
| 29638: | G:1 |
| 29639: | G:1 |
| 29640: | G:1 |
| 29641: | G:1 |
| 29642: | G:1 |
| 29643: | G:1 |
| 29644: | G:1 |
| 29645: | G:1 |
| 29646: | G:1 |
| 29647: | G:1 |
| 29648: | G:1 |
| 29649: | G:1 |
| 29650: | G:1 |
| 29651: | G:1 |
| 29652: | G:1 |
| 29653: | G:1 |
| 29654: | G:1 |
| 29655: | G:1 |
| 29656: | G:1 |
| 29657: | G:1 |
| 29658: | G:1 |
| 29659: | G:1 |
| 29660: | G:1 |
| 29661: | G:1 |
| 29662: | G:1 |
| 29663: | G:1 |
| 29664: | G:1 |
| 29665: | G:1 |
| 29666: | G:1 |
| 29667: | G:1 |
| 29668: | G:1 |
| 29669: | G:1 |
| 29670: | G:1 |
| 29671: | G:1 |
| 29672: | G:1 |
| 29673: | G:1 |
| 29674: | G:1 |
| 29675: | G:1 |
| 29676: | G:1 |
| 29677: | G:1 |
| 29678: | G:1 |
| 29679: | G:1 |

TABLE II-continued

| SEQ ID NO. | Spatial Distribution |
|---|---|
| 29680: | G:1 |
| 29681: | G:1 |
| 29682: | G:1 |
| 29683: | G:1 |
| 29684: | G:1 |
| 29685: | G:1 |
| 29686: | G:1 |
| 29687: | G:1 |
| 29688: | G:1 |
| 29689: | G:1 |
| 29690: | G:1 |
| 29691: | G:1 |
| 29692: | G:1 |
| 29693: | G:1 |
| 29694: | G:1 |
| 29695: | G:1 |
| 29696: | G:1 |
| 29697: | G:1 |
| 29698: | G:1 |
| 29699: | G:1 |
| 29700: | G:1 |
| 29701: | G:1 |
| 29702: | G:1 |
| 29703: | G:1 |
| 29704: | G:1 |
| 29705: | G:1 |
| 29706: | G:1 |
| 29707: | G:1 |
| 29708: | G:1 |
| 29709: | G:1 |
| 29710: | G:1 |
| 29711: | G:1 |
| 29712: | G:1 |
| 29713: | G:1 |
| 29714: | G:1 |
| 29715: | G:1 |
| 29716: | G:1 |
| 29717: | G:1 |
| 29718: | G:1 |
| 29719: | G:1 |
| 29720: | G:1 |
| 29721: | G:1 |
| 29722: | G:1 |
| 29723: | G:1 |
| 29724: | G:1 |
| 29725: | G:1 |
| 29726: | G:1 |
| 29727: | G:1 |
| 29728: | G:1 |
| 29729: | G:1 |
| 29730: | G:1 |
| 29731: | G:1 |
| 29732: | G:1 |
| 29733: | G:1 |
| 29734: | G:1 |
| 29735: | G:1 |
| 29736: | G:1 |
| 29737: | G:1 |
| 29738: | G:1 |
| 29739: | G:1 |
| 29740: | G:1 |
| 29741: | G:1 |
| 29742: | G:1 |
| 29743: | G:1 |
| 29744: | G:1 |
| 29745: | G:1 |
| 29746: | G:1 |
| 29747: | G:1 |
| 29748: | G:1 |
| 29749: | G:1 |
| 29750: | G:1 |
| 29751: | G:1 |
| 29752: | G:1 |
| 29753: | G:1 |
| 29754: | G:1 |
| 29755: | G:1 |
| 29756: | G:1 |
| 29757: | G:1 |
| 29758: | G:1 |
| 29759: | G:1 |
| 29760: | G:1 |
| 29761: | G:1 |
| 29762: | G:1 |
| 29763: | G:1 |
| 29764: | G:1 |
| 29765: | G:1 |
| 29766: | G:1 |
| 29767: | G:1 |
| 29768: | G:1 |
| 29769: | G:1 |
| 29770: | G:1 |
| 29771: | G:1 |
| 29772: | G:1 |
| 29773: | G:1 |
| 29774: | G:1 |
| 29775: | G:1 |
| 29776: | G:1 |
| 29777: | G:1 |
| 29778: | G:1 |
| 29779: | G:1 |
| 29780: | G:1 |
| 29781: | G:1 |
| 29782: | G:1 |
| 29783: | G:1 |
| 29784: | G:1 |
| 29785: | G:1 |
| 29786: | G:1 |
| 29787: | G:1 |
| 29788: | G:1 |
| 29789: | G:1 |
| 29790: | G:1 |
| 29791: | G:1 |
| 29792: | G:1 |
| 29793: | G:1 |
| 29794: | G:1 |
| 29795: | G:1 |
| 29796: | G:1 |
| 29797: | G:1 |
| 29798: | G:1 |
| 29799: | G:1 |
| 29800: | G:1 |
| 29801: | G:1 |
| 29802: | G:1 |
| 29803: | G:1 |
| 29804: | G:1 |
| 29805: | G:1 |
| 29806: | G:1 |
| 29807: | G:1 |
| 29808: | G:1 |
| 29809: | G:1 |
| 29810: | G:1 |
| 29811: | G:1 |
| 29812: | G:1 |
| 29813: | G:1 |
| 29814: | G:1 |
| 29815: | G:1 |
| 29816: | G:1 |
| 29817: | G:1 |
| 29818: | G:1 |
| 29819: | G:1 |
| 29820: | G:1 |
| 29821: | G:1 |
| 29822: | G:1 |
| 29823: | G:1 |
| 29824: | G:1 |
| 29825: | G:1 |
| 29826: | G:1 |
| 29827: | G:1 |
| 29828: | G:1 |
| 29829: | G:1 |
| 29830: | G:1 |
| 29831: | G:1 |
| 29832: | G:1 |
| 29833: | G:1 |

TABLE II-continued

| SEQ ID NO. | Spatial Distribution |
|---|---|
| 29834: | G:1 |
| 29835: | G:1 |
| 29836: | G:1 |
| 29837: | G:1 |
| 29838: | G:1 |
| 29839: | G:1 |
| 29840: | G:1 |
| 29841: | G:1 |
| 29842: | G:1 |
| 29843: | G:1 |
| 29844: | G:1 |
| 29845: | G:1 |
| 29846: | G:1 |
| 29847: | G:1 |
| 29848: | G:1 |
| 29849: | G:1 |
| 29850: | G:1 |
| 29851: | G:1 |
| 29852: | G:1 |
| 29853: | G:1 |
| 29854: | G:1 |
| 29855: | G:1 |
| 29856: | G:1 |
| 29857: | G:1 |
| 29858: | G:1 |
| 29859: | G:1 |
| 29860: | G:1 |
| 29861: | G:1 |
| 29862: | G:1 |
| 29863: | G:1 |
| 29864: | G:1 |
| 29865: | G:1 |
| 29866: | G:1 |
| 29867: | G:1 |
| 29868: | G:1 |
| 29869: | G:1 |
| 29870: | G:1 |
| 29871: | G:1 |
| 29872: | G:1 |
| 29873: | G:1 |
| 29874: | G:1 |
| 29875: | G:1 |
| 29876: | G:1 |
| 29877: | G:1 |
| 29878: | G:1 |
| 29879: | G:1 |
| 29880: | G:1 |
| 29881: | G:1 |
| 29882: | G:1 |
| 29883: | G:1 |
| 29884: | G:1 |
| 29885: | G:1 |
| 29886: | G:1 |
| 29887: | G:1 |
| 29888: | G:1 |
| 29889: | G:1 |
| 29890: | G:1 |
| 29891: | G:1 |
| 29892: | G:1 |
| 29893: | G:1 |
| 29894: | G:1 |
| 29895: | G:1 |
| 29896: | G:1 |
| 29897: | G:1 |
| 29898: | G:1 |
| 29899: | G:1 |
| 29900: | G:1 |
| 29901: | G:1 |
| 29902: | G:1 |
| 29903: | G:1 |
| 29904: | G:1 |
| 29905: | G:1 |
| 29906: | G:1 |
| 29907: | G:1 |
| 29908: | G:1 |
| 29909: | G:1 |
| 29910: | G:1 |
| 29911: | G:1 |
| 29912: | G:1 |
| 29913: | G:1 |
| 29914: | G:1 |
| 29915: | G:1 |
| 29916: | G:1 |
| 29917: | G:1 |
| 29918: | G:1 |
| 29919: | G:1 |
| 29920: | G:1 |
| 29921: | G:1 |
| 29922: | G:1 |
| 29923: | G:1 |
| 29924: | G:1 |
| 29925: | G:1 |
| 29926: | G:1 |
| 29927: | G:1 |
| 29928: | G:1 |
| 29929: | G:1 |
| 29930: | G:1 |
| 29931: | G:1 |
| 29932: | G:1 |
| 29933: | G:1 |
| 29934: | G:1 |
| 29935: | G:1 |
| 29936: | G:1 |
| 29937: | G:1 |
| 29938: | G:1 |
| 29939: | G:1 |
| 29940: | G:1 |
| 29941: | G:1 |
| 29942: | G:1 |
| 29943: | G:1 |
| 29944: | G:1 |
| 29945: | G:1 |
| 29946: | G:1 |
| 29947: | G:1 |
| 29948: | G:1 |
| 29949: | G:1 |
| 29950: | G:1 |
| 29951: | G:1 |
| 29952: | G:1 |
| 29953: | G:1 |
| 29954: | G:1 |
| 29955: | G:1 |
| 29956: | G:1 |
| 29957: | G:1 |
| 29958: | G:1 |
| 29959: | G:1 |
| 29960: | G:1 |
| 29961: | G:1 |
| 29962: | G:1 |
| 29963: | G:1 |
| 29964: | G:1 |
| 29965: | G:1 |
| 29966: | G:1 |
| 29967: | G:1 |
| 29968: | G:1 |
| 29969: | G:1 |
| 29970: | G:1 |
| 29971: | G:1 |
| 29972: | G:1 |
| 29973: | G:1 |
| 29974: | G:1 |
| 29975: | G:1 |
| 29976: | G:1 |
| 29977: | G:1 |
| 29978: | G:1 |
| 29979: | G:1 |
| 29980: | G:1 |
| 29981: | G:1 |
| 29982: | G:1 |
| 29983: | G:1 |
| 29984: | G:1 |
| 29985: | G:1 |
| 29986: | G:1 |
| 29987: | G:1 |

TABLE II-continued

| SEQ ID NO. | Spatial Distribution |
|---|---|
| 29988: | G:1 |
| 29989: | G:1 |
| 29990: | G:1 |
| 29991: | G:1 |
| 29992: | G:1 |
| 29993: | G:1 |
| 29994: | G:1 |
| 29995: | G:1 |
| 29996: | G:1 |
| 29997: | G:1 |
| 29998: | G:1 |
| 29999: | G:1 |
| 30000: | G:1 |
| 30001: | G:1 |
| 30002: | G:1 |
| 30003: | G:1 |
| 30004: | G:1 |
| 30005: | G:1 |
| 30006: | G:1 |
| 30007: | G:1 |
| 30008: | G:1 |
| 30009: | G:1 |
| 30010: | G:1 |
| 30011: | G:1 |
| 30012: | G:1 |
| 30013: | G:1 |
| 30014: | G:1 |
| 30015: | G:1 |
| 30016: | G:1 |
| 30017: | G:1 |
| 30018: | G:1 |
| 30019: | G:1 |
| 30020: | G:1 |
| 30021: | G:1 |
| 30022: | G:1 |
| 30023: | G:1 |
| 30024: | G:1 |
| 30025: | G:1 |
| 30026: | G:1 |
| 30027: | G:1 |
| 30028: | G:1 |
| 30029: | G:1 |
| 30030: | G:1 |
| 30031: | G:1 |
| 30032: | G:1 |
| 30033: | G:1 |
| 30034: | G:1 |
| 30035: | G:1 |
| 30036: | G:1 |
| 30037: | G:1 |
| 30038: | G:1 |
| 30039: | G:1 |
| 30040: | G:1 |
| 30041: | G:1 |
| 30042: | G:1 |
| 30043: | G:1 |
| 30044: | G:1 |
| 30045: | G:1 |
| 30046: | G:1 |
| 30047: | G:1 |
| 30048: | G:1 |
| 30049: | G:1 |
| 30050: | G:1 |
| 30051: | G:1 |
| 30052: | G:1 |
| 30053: | G:1 |
| 30054: | G:1 |
| 30055: | G:1 |
| 30056: | G:1 |
| 30057: | G:1 |
| 30058: | G:1 |
| 30059: | G:1 |
| 30060: | G:1 |
| 30061: | G:1 |
| 30062: | G:1 |
| 30063: | G:1 |
| 30064: | G:1 |
| 30065: | G:1 |
| 30066: | G:1 |
| 30067: | G:1 |
| 30068: | G:1 |
| 30069: | G:1 |
| 30070: | G:1 |
| 30071: | G:1 |
| 30072: | G:1 |
| 30073: | G:1 |
| 30074: | G:1 |
| 30075: | G:1 |
| 30076: | G:1 |
| 30077: | G:1 |
| 30078: | G:1 |
| 30079: | G:1 |
| 30080: | G:1 |
| 30081: | G:1 |
| 30082: | G:1 |
| 30083: | G:1 |
| 30084: | G:1 |
| 30085: | G:1 |
| 30086: | G:1 |
| 30087: | G:1 |
| 30088: | G:1 |
| 30089: | G:1 |
| 30090: | G:1 |
| 30091: | G:1 |
| 30092: | G:1 |
| 30093: | G:1 |
| 30094: | G:1 |
| 30095: | G:1 |
| 30096: | G:1 |
| 30097: | G:1 |
| 30098: | G:1 |
| 30099: | G:1 |
| 30100: | G:1 |
| 30101: | G:1 |
| 30102: | G:1 |
| 30103: | G:1 |
| 30104: | G:1 |
| 30105: | G:1 |
| 30106: | G:1 |
| 30107: | G:1 |
| 30108: | G:1 |
| 30109: | G:1 |
| 30110: | G:1 |
| 30111: | G:1 |
| 30112: | G:1 |
| 30113: | G:1 |
| 30114: | G:1 |
| 30115: | G:1 |
| 30116: | G:1 |
| 30117: | G:1 |
| 30118: | G:1 |
| 30119: | G:1 |
| 30120: | G:1 |
| 30121: | G:1 |
| 30122: | G:1 |
| 30123: | G:1 |
| 30124: | G:1 |
| 30125: | G:1 |
| 30126: | G:1 |
| 30127: | G:1 |
| 30128: | G:1 |
| 30129: | G:1 |
| 30130: | G:1 |
| 30131: | G:1 |
| 30132: | G:1 |
| 30133: | G:1 |
| 30134: | G:1 |
| 30135: | G:1 |
| 30136: | G:1 |
| 30137: | G:1 |
| 30138: | G:1 |
| 30139: | G:1 |
| 30140: | G:1 |
| 30141: | G:1 |

TABLE II-continued

| SEQ ID NO. | Spatial Distribution |
|---|---|
| 30142: | G:1 |
| 30143: | G:1 |
| 30144: | G:1 |
| 30145: | G:1 |
| 30146: | G:1 |
| 30147: | G:1 |
| 30148: | G:1 |
| 30149: | G:1 |
| 30150: | G:1 |
| 30151: | G:1 |
| 30152: | G:1 |
| 30153: | G:1 |
| 30154: | G:1 |
| 30155: | G:1 |
| 30156: | G:1 |
| 30157: | G:1 |
| 30158: | G:1 |
| 30159: | G:1 |
| 30160: | G:1 |
| 30161: | G:1 |
| 30162: | G:1 |
| 30163: | G:1 |
| 30164: | G:1 |
| 30165: | G:1 |
| 30166: | G:1 |
| 30167: | G:1 |
| 30168: | G:1 |
| 30169: | G:1 |
| 30170: | G:1 |
| 30171: | G:1 |
| 30172: | G:1 |
| 30173: | G:1 |
| 30174: | G:1 |
| 30175: | G:1 |
| 30176: | G:1 |
| 30177: | G:1 |
| 30178: | G:1 |
| 30179: | G:1 |
| 30180: | G:1 |
| 30181: | G:1 |
| 30182: | G:1 |
| 30183: | G:1 |
| 30184: | G:1 |
| 30185: | G:1 |
| 30186: | G:1 |
| 30187: | G:1 |
| 30188: | G:1 |
| 30189: | G:1 |
| 30190: | G:1 |
| 30191: | G:1 |
| 30192: | G:1 |
| 30193: | G:1 |
| 30194: | G:1 |
| 30195: | G:1 |
| 30196: | G:1 |
| 30197: | G:1 |
| 30198: | G:1 |
| 30199: | G:1 |
| 30200: | G:1 |
| 30201: | G:1 |
| 30202: | G:1 |
| 30203: | G:1 |
| 30204: | G:1 |
| 30205: | G:1 |
| 30206: | G:1 |
| 30207: | G:1 |
| 30208: | G:1 |
| 30209: | G:1 |
| 30210: | G:1 |
| 30211: | G:1 |
| 30212: | G:1 |
| 30213: | G:1 |
| 30214: | G:1 |
| 30215: | G:1 |
| 30216: | G:1 |
| 30217: | G:1 |
| 30218: | G:1 |
| 30219: | G:1 |
| 30220: | G:1 |
| 30221: | G:1 |
| 30222: | G:1 |
| 30223: | G:1 |
| 30224: | G:1 |
| 30225: | G:1 |
| 30226: | G:1 |
| 30227: | G:1 |
| 30228: | G:1 |
| 30229: | G:1 |
| 30230: | G:1 |
| 30231: | G:1 |
| 30232: | G:1 |
| 30233: | G:1 |
| 30234: | G:1 |
| 30235: | G:1 |
| 30236: | G:1 |
| 30237: | G:1 |
| 30238: | G:1 |
| 30239: | G:1 |
| 30240: | G:1 |
| 30241: | G:1 |
| 30242: | G:1 |
| 30243: | G:1 |
| 30244: | G:1 |
| 30245: | G:1 |
| 30246: | G:1 |
| 30247: | G:1 |
| 30248: | G:1 |
| 30249: | G:1 |
| 30250: | G:1 |
| 30251: | G:1 |
| 30252: | G:1 |
| 30253: | G:1 |
| 30254: | G:1 |
| 30255: | G:1 |
| 30256: | G:1 |
| 30257: | G:1 |
| 30258: | G:1 |
| 30259: | G:1 |
| 30260: | G:1 |
| 30261: | G:1 |
| 30262: | G:1 |
| 30263: | G:1 |
| 30264: | G:1 |
| 30265: | G:1 |
| 30266: | G:1 |
| 30267: | G:1 |
| 30268: | G:1 |
| 30269: | G:1 |
| 30270: | G:1 |
| 30271: | G:1 |
| 30272: | G:1 |
| 30273: | G:1 |
| 30274: | G:1 |
| 30275: | G:1 |
| 30276: | G:1 |
| 30277: | G:1 |
| 30278: | G:1 |
| 30279: | G:1 |
| 30280: | G:1 |
| 30281: | G:1 |
| 30282: | G:1 |
| 30283: | G:1 |
| 30284: | G:1 |
| 30285: | G:1 |
| 30286: | G:1 |
| 30287: | G:1 |
| 30288: | G:1 |
| 30289: | G:1 |
| 30290: | G:1 |
| 30291: | G:1 |
| 30292: | G:1 |
| 30293: | G:1 |
| 30294: | G:1 |
| 30295: | G:1 |

TABLE II-continued

| SEQ ID NO. | Spatial Distribution |
|---|---|
| 30296: | G:1 |
| 30297: | G:1 |
| 30298: | G:1 |
| 30299: | G:1 |
| 30300: | G:1 |
| 30301: | G:1 |
| 30302: | G:1 |
| 30303: | G:1 |
| 30304: | G:1 |
| 30305: | G:1 |
| 30306: | G:1 |
| 30307: | G:1 |
| 30308: | G:1 |
| 30309: | G:1 |
| 30310: | G:1 |
| 30311: | G:1 |
| 30312: | G:1 |
| 30313: | G:1 |
| 30314: | G:1 |
| 30315: | G:1 |
| 30316: | G:1 |
| 30317: | G:1 |
| 30318: | G:1 |
| 30319: | G:1 |
| 30320: | G:1 |
| 30321: | G:1 |
| 30322: | G:1 |
| 30323: | G:1 |
| 30324: | G:1 |
| 30325: | G:1 |
| 30326: | G:1 |
| 30327: | G:1 |
| 30328: | G:1 |
| 30329: | G:1 |
| 30330: | G:1 |
| 30331: | G:1 |
| 30332: | G:1 |
| 30333: | G:1 |
| 30334: | G:1 |
| 30335: | G:1 |
| 30336: | G:1 |
| 30337: | G:1 |
| 30338: | G:1 |
| 30339: | G:1 |
| 30340: | G:1 |
| 30341: | G:1 |
| 30342: | G:1 |
| 30343: | G:1 |
| 30344: | G:1 |
| 30345: | G:1 |
| 30346: | G:1 |
| 30347: | G:1 |
| 30348: | G:1 |
| 30349: | G:1 |
| 30350: | G:1 |
| 30351: | G:1 |
| 30352: | G:1 |
| 30353: | G:1 |
| 30354: | G:1 |
| 30355: | G:1 |
| 30356: | G:1 |
| 30357: | G:1 |
| 30358: | G:1 |
| 30359: | G:1 |
| 30360: | G:1 |
| 30361: | G:1 |
| 30362: | G:1 |
| 30363: | G:1 |
| 30364: | G:1 |
| 30365: | G:1 |
| 30366: | G:1 |
| 30367: | G:1 |
| 30368: | G:1 |
| 30369: | G:1 |
| 30370: | G:1 |
| 30371: | G:1 |
| 30372: | G:1 |
| 30373: | G:1 |
| 30374: | G:1 |
| 30375: | G:1 |
| 30376: | G:1 |
| 30377: | G:1 |
| 30378: | G:1 |
| 30379: | G:1 |
| 30380: | G:1 |
| 30381: | G:1 |
| 30382: | G:1 |
| 30383: | G:1 |
| 30384: | G:1 |
| 30385: | G:1 |
| 30386: | G:1 |
| 30387: | H:1 |
| 30388: | H:1 |
| 30389: | H:1 |
| 30390: | H:1 |
| 30391: | H:1 |
| 30392: | H:1 |
| 30393: | H:1 |
| 30394: | H:1 |
| 30395: | H:1 |
| 30396: | H:1 |
| 30397: | H:1 |
| 30398: | H:1 |
| 30399: | H:1 |
| 30400: | H:1 |
| 30401: | H:1 |
| 30402: | H:1 |
| 30403: | H:1 |
| 30404: | H:1 |
| 30405: | H:1 |
| 30406: | H:1 |
| 30407: | H:1 |
| 30408: | H:1 |
| 30409: | H:1 |
| 30410: | H:1 |
| 30411: | H:1 |
| 30412: | H:1 |
| 30413: | H:1 |
| 30414: | H:1 |
| 30415: | H:1 |
| 30416: | H:1 |
| 30417: | H:1 |
| 30418: | H:1 |
| 30419: | H:1 |
| 30420: | H:1 |
| 30421: | H:1 |
| 30422: | H:1 |
| 30423: | H:1 |
| 30424: | H:1 |
| 30425: | H:1 |
| 30426: | H:1 |
| 30427: | H:1 |
| 30428: | H:1 |
| 30429: | H:1 |
| 30430: | H:1 |
| 30431: | H:1 |
| 30432: | H:1 |
| 30433: | H:1 |
| 30434: | H:1 |
| 30435: | H:1 |
| 30436: | H:1 |
| 30437: | H:1 |
| 30438: | H:1 |
| 30439: | H:1 |
| 30440: | H:1 |
| 30441: | H:1 |
| 30442: | H:1 |
| 30443: | H:1 |
| 30444: | H:1 |
| 30445: | H:1 |
| 30446: | H:1 |
| 30447: | H:1 |
| 30448: | H:1 |
| 30449: | H:1 |

TABLE II-continued

| SEQ ID NO. | Spatial Distribution |
|---|---|
| 30450: | H:1 |
| 30451: | H:1 |
| 30452: | H:1 |
| 30453: | H:1 |
| 30454: | H:1 |
| 30455: | H:1 |
| 30456: | H:1 |
| 30457: | H:1 |
| 30458: | H:1 |
| 30459: | H:1 |
| 30460: | H:1 |
| 30461: | H:1 |
| 30462: | H:1 |
| 30463: | H:1 |
| 30464: | H:1 |
| 30465: | H:1 |
| 30466: | H:1 |
| 30467: | H:1 |
| 30468: | H:1 |
| 30469: | H:1 |
| 30470: | H:1 |
| 30471: | H:1 |
| 30472: | H:1 |
| 30473: | H:1 |
| 30474: | H:1 |
| 30475: | H:1 |
| 30476: | H:1 |
| 30477: | H:1 |
| 30478: | H:1 |
| 30479: | H:1 |
| 30480: | H:1 |
| 30481: | H:1 |
| 30482: | H:1 |
| 30483: | H:1 |
| 30484: | H:1 |
| 30485: | H:1 |
| 30486: | H:1 |
| 30487: | H:1 |
| 30488: | H:1 |
| 30489: | H:1 |
| 30490: | H:1 |
| 30491: | H:1 |
| 30492: | H:1 |
| 30493: | H:1 |
| 30494: | H:1 |
| 30495: | H:1 |
| 30496: | H:1 |
| 30497: | H:1 |
| 30498: | H:1 |
| 30499: | H:1 |
| 30500: | H:1 |
| 30501: | H:1 |
| 30502: | H:1 |
| 30503: | H:1 |
| 30504: | H:1 |
| 30505: | H:1 |
| 30506: | H:1 |
| 30507: | H:1 |
| 30508: | H:1 |
| 30509: | H:1 |
| 30510: | H:1 |
| 30511: | H:1 |
| 30512: | H:1 |
| 30513: | H:1 |
| 30514: | H:1 |
| 30515: | H:1 |
| 30516: | H:1 |
| 30517: | H:1 |
| 30518: | H:1 |
| 30519: | H:1 |
| 30520: | H:1 |
| 30521: | H:1 |
| 30522: | H:1 |
| 30523: | H:1 |
| 30524: | H:1 |
| 30525: | H:1 |
| 30526: | H:1 |
| 30527: | H:1 |
| 30528: | H:1 |
| 30529: | H:1 |
| 30530: | H:1 |
| 30531: | H:1 |
| 30532: | H:1 |
| 30533: | H:1 |
| 30534: | H:1 |
| 30535: | H:1 |
| 30536: | H:1 |
| 30537: | H:1 |
| 30538: | H:1 |
| 30539: | H:1 |
| 30540: | H:1 |
| 30541: | H:1 |
| 30542: | H:1 |
| 30543: | H:1 |
| 30544: | H:1 |
| 30545: | H:1 |
| 30546: | H:1 |
| 30547: | H:1 |
| 30548: | H:1 |
| 30549: | H:1 |
| 30550: | H:1 |
| 30551: | H:1 |
| 30552: | H:1 |
| 30553: | H:1 |
| 30554: | H:1 |
| 30555: | H:1 |
| 30556: | H:1 |
| 30557: | H:1 |
| 30558: | H:1 |
| 30559: | H:1 |
| 30560: | H:1 |
| 30561: | H:1 |
| 30562: | H:1 |
| 30563: | H:1 |
| 30564: | H:1 |
| 30565: | H:1 |
| 30566: | H:1 |
| 30567: | H:1 |
| 30568: | H:1 |
| 30569: | H:1 |
| 30570: | H:1 |
| 30571: | H:1 |
| 30572: | H:1 |
| 30573: | H:1 |
| 30574: | H:1 |
| 30575: | H:1 |
| 30576: | H:1 |
| 30577: | H:1 |
| 30578: | H:1 |
| 30579: | H:1 |
| 30580: | H:1 |
| 30581: | H:1 |
| 30582: | H:1 |
| 30583: | H:1 |
| 30584: | H:1 |
| 30585: | H:1 |
| 30586: | H:1 |
| 30587: | H:1 |
| 30588: | H:1 |
| 30589: | H:1 |
| 30590: | H:1 |
| 30591: | H:1 |
| 30592: | H:1 |
| 30593: | H:1 |
| 30594: | H:1 |
| 30595: | H:1 |
| 30596: | H:1 |
| 30597: | H:1 |
| 30598: | H:1 |
| 30599: | H:1 |
| 30600: | H:1 |
| 30601: | H:1 |
| 30602: | H:1 |
| 30603: | H:1 |

TABLE II-continued

| SEQ ID NO. | Spatial Distribution |
|---|---|
| 30604: | H:1 |
| 30605: | H:1 |
| 30606: | H:1 |
| 30607: | H:1 |
| 30608: | H:1 |
| 30609: | H:1 |
| 30610: | H:1 |
| 30611: | H:1 |
| 30612: | H:1 |
| 30613: | H:1 |
| 30614: | H:1 |
| 30615: | H:1 |
| 30616: | H:1 |
| 30617: | H:1 |
| 30618: | H:1 |
| 30619: | H:1 |
| 30620: | H:1 |
| 30621: | H:1 |
| 30622: | H:1 |
| 30623: | H:1 |
| 30624: | H:1 |
| 30625: | H:1 |
| 30626: | H:1 |
| 30627: | H:1 |
| 30628: | H:1 |
| 30629: | H:1 |
| 30630: | H:1 |
| 30631: | H:1 |
| 30632: | H:1 |
| 30633: | H:1 |
| 30634: | H:1 |
| 30635: | H:1 |
| 30636: | H:1 |
| 30637: | H:1 |
| 30638: | H:1 |
| 30639: | H:1 |
| 30640: | H:1 |
| 30641: | H:1 |
| 30642: | H:1 |
| 30643: | H:1 |
| 30644: | H:1 |
| 30645: | H:1 |
| 30646: | H:1 |
| 30647: | H:1 |
| 30648: | H:1 |
| 30649: | H:1 |
| 30650: | H:1 |
| 30651: | H:1 |
| 30652: | H:1 |
| 30653: | H:1 |
| 30654: | H:1 |
| 30655: | H:1 |
| 30656: | H:1 |
| 30657: | H:1 |
| 30658: | H:1 |
| 30659: | H:1 |
| 30660: | H:1 |
| 30661: | H:1 |
| 30662: | H:1 |
| 30663: | H:1 |
| 30664: | H:1 |
| 30665: | H:1 |
| 30666: | H:1 |
| 30667: | H:1 |
| 30668: | H:1 |
| 30669: | H:1 |
| 30670: | H:1 |
| 30671: | H:1 |
| 30672: | H:1 |
| 30673: | H:1 |
| 30674: | H:1 |
| 30675: | H:1 |
| 30676: | H:1 |
| 30677: | H:1 |
| 30678: | H:1 |
| 30679: | H:1 |
| 30680: | H:1 |
| 30681: | H:1 |
| 30682: | H:1 |
| 30683: | H:1 |
| 30684: | H:1 |
| 30685: | H:1 |
| 30686: | H:1 |
| 30687: | H:1 |
| 30688: | H:1 |
| 30689: | H:1 |
| 30690: | H:1 |
| 30691: | H:1 |
| 30692: | H:1 |
| 30693: | H:1 |
| 30694: | H:1 |
| 30695: | H:1 |
| 30696: | H:1 |
| 30697: | H:1 |
| 30698: | H:1 |
| 30699: | H:1 |
| 30700: | H:1 |
| 30701: | H:1 |
| 30702: | H:1 |
| 30703: | H:1 |
| 30704: | H:1 |
| 30705: | H:1 |
| 30706: | H:1 |
| 30707: | H:1 |
| 30708: | H:1 |
| 30709: | H:1 |
| 30710: | H:1 |
| 30711: | H:1 |
| 30712: | H:1 |
| 30713: | H:1 |
| 30714: | H:1 |
| 30715: | H:1 |
| 30716: | H:1 |
| 30717: | H:1 |
| 30718: | H:1 |
| 30719: | H:1 |
| 30720: | H:1 |
| 30721: | H:1 |
| 30722: | H:1 |
| 30723: | H:1 |
| 30724: | H:1 |
| 30725: | H:1 |
| 30726: | H:1 |
| 30727: | H:1 |
| 30728: | H:1 |
| 30729: | H:1 |
| 30730: | H:1 |
| 30731: | H:1 |
| 30732: | H:1 |
| 30733: | H:1 |
| 30734: | H:1 |
| 30735: | H:1 |
| 30736: | H:1 |
| 30737: | H:1 |
| 30738: | H:1 |
| 30739: | H:1 |
| 30740: | H:1 |
| 30741: | H:1 |
| 30742: | H:1 |
| 30743: | H:1 |
| 30744: | H:1 |
| 30745: | H:1 |
| 30746: | H:1 |
| 30747: | H:1 |
| 30748: | H:1 |
| 30749: | H:1 |
| 30750: | H:1 |
| 30751: | H:1 |
| 30752: | H:1 |
| 30753: | H:1 |
| 30754: | H:1 |
| 30755: | H:1 |
| 30756: | H:1 |
| 30757: | H:1 |

TABLE II-continued

| SEQ ID NO. | Spatial Distribution |
|---|---|
| 30758: | H:1 |
| 30759: | H:1 |
| 30760: | H:1 |
| 30761: | H:1 |
| 30762: | H:1 |
| 30763: | H:1 |
| 30764: | H:1 |
| 30765: | H:1 |
| 30766: | H:1 |
| 30767: | H:1 |
| 30768: | H:1 |
| 30769: | H:1 |
| 30770: | H:1 |
| 30771: | H:1 |
| 30772: | H:1 |
| 30773: | H:1 |
| 30774: | H:1 |
| 30775: | H:1 |
| 30776: | H:1 |
| 30777: | H:1 |
| 30778: | H:1 |
| 30779: | H:1 |
| 30780: | H:1 |
| 30781: | H:1 |
| 30782: | H:1 |
| 30783: | H:1 |
| 30784: | H:1 |
| 30785: | H:1 |
| 30786: | H:1 |
| 30787: | H:1 |
| 30788: | H:1 |
| 30789: | H:1 |
| 30790: | H:1 |
| 30791: | H:1 |
| 30792: | H:1 |
| 30793: | H:1 |
| 30794: | H:1 |
| 30795: | H:1 |
| 30796: | H:1 |
| 30797: | H:1 |
| 30798: | H:1 |
| 30799: | H:1 |
| 30800: | H:1 |
| 30801: | H:1 |
| 30802: | H:1 |
| 30803: | H:1 |
| 30804: | H:1 |
| 30805: | H:1 |
| 30806: | H:1 |
| 30807: | H:1 |
| 30808: | H:1 |
| 30809: | H:1 |
| 30810: | H:1 |
| 30811: | H:1 |
| 30812: | H:1 |
| 30813: | H:1 |
| 30814: | H:1 |
| 30815: | H:1 |
| 30816: | H:1 |
| 30817: | H:1 |
| 30818: | H:1 |
| 30819: | H:1 |
| 30820: | H:1 |
| 30821: | H:1 |
| 30822: | H:1 |
| 30823: | H:1 |
| 30824: | H:1 |
| 30825: | H:1 |
| 30826: | H:1 |
| 30827: | H:1 |
| 30828: | H:1 |
| 30829: | H:1 |
| 30830: | H:1 |
| 30831: | H:1 |
| 30832: | H:1 |
| 30833: | H:1 |
| 30834: | H:1 |
| 30835: | H:1 |
| 30836: | H:1 |
| 30837: | H:1 |
| 30838: | H:1 |
| 30839: | H:1 |
| 30840: | H:1 |
| 30841: | H:1 |
| 30842: | H:1 |
| 30843: | H:1 |
| 30844: | H:1 |
| 30845: | H:1 |
| 30846: | H:1 |
| 30847: | H:1 |
| 30848: | H:1 |
| 30849: | H:1 |
| 30850: | H:1 |
| 30851: | H:1 |
| 30852: | H:1 |
| 30853: | H:1 |
| 30854: | H:1 |
| 30855: | H:1 |
| 30856: | H:1 |
| 30857: | H:1 |
| 30858: | H:1 |
| 30859: | H:1 |
| 30860: | H:1 |
| 30861: | H:1 |
| 30862: | H:1 |
| 30863: | H:1 |
| 30864: | H:1 |
| 30865: | H:1 |
| 30866: | H:1 |
| 30867: | H:1 |
| 30868: | H:1 |
| 30869: | H:1 |
| 30870: | H:1 |
| 30871: | H:1 |
| 30872: | H:1 |
| 30873: | H:1 |
| 30874: | H:1 |
| 30875: | H:1 |
| 30876: | H:1 |
| 30877: | H:1 |
| 30878: | H:1 |
| 30879: | H:1 |
| 30880: | H:1 |
| 30881: | H:1 |
| 30882: | H:1 |
| 30883: | H:1 |
| 30884: | H:1 |
| 30885: | H:1 |
| 30886: | H:1 |
| 30887: | H:1 |
| 30888: | H:1 |
| 30889: | H:1 |
| 30890: | H:1 |
| 30891: | H:1 |
| 30892: | H:1 |
| 30893: | H:1 |
| 30894: | H:1 |
| 30895: | H:1 |
| 30896: | H:1 |
| 30897: | H:1 |
| 30898: | H:1 |
| 30899: | H:1 |
| 30900: | H:1 |
| 30901: | H:1 |
| 30902: | H:1 |
| 30903: | H:1 |
| 30904: | H:1 |
| 30905: | H:1 |
| 30906: | H:1 |
| 30907: | H:1 |
| 30908: | H:1 |
| 30909: | H:1 |
| 30910: | H:1 |
| 30911: | H:1 |

TABLE II-continued

| SEQ ID NO. | Spatial Distribution |
|---|---|
| 30912: | H:1 |
| 30913: | H:1 |
| 30914: | H:1 |
| 30915: | H:1 |
| 30916: | H:1 |
| 30917: | H:1 |
| 30918: | H:1 |
| 30919: | H:1 |
| 30920: | H:1 |
| 30921: | H:1 |
| 30922: | H:1 |
| 30923: | H:1 |
| 30924: | H:1 |
| 30925: | H:1 |
| 30926: | H:1 |
| 30927: | H:1 |
| 30928: | H:1 |
| 30929: | H:1 |
| 30930: | H:1 |
| 30931: | H:1 |
| 30932: | H:1 |
| 30933: | H:1 |
| 30934: | H:1 |
| 30935: | H:1 |
| 30936: | H:1 |
| 30937: | H:1 |
| 30938: | H:1 |
| 30939: | H:1 |
| 30940: | H:1 |
| 30941: | H:1 |
| 30942: | H:1 |
| 30943: | H.1 |
| 30944: | H:1 |
| 30945: | H:1 |
| 30946: | H:1 |
| 30947: | H:1 |
| 30948: | H:1 |
| 30949: | H:1 |
| 30950: | H:1 |
| 30951: | H:1 |
| 30952: | H:1 |
| 30953: | H:1 |
| 30954: | H:1 |
| 30955: | H:1 |
| 30956: | H:1 |
| 30957: | H:1 |
| 30958: | H:1 |
| 30959: | H:1 |
| 30960: | H:1 |
| 30961: | H:1 |
| 30962: | H:1 |
| 30963: | H:1 |
| 30964: | H:1 |
| 30965: | H:1 |
| 30966: | H:1 |
| 30967: | H:1 |
| 30968: | H:1 |
| 30969: | H:1 |
| 30970: | H:1 |
| 30971: | H:1 |
| 30972: | H:1 |
| 30973: | H:1 |
| 30974: | H:1 |
| 30975: | H:1 |
| 30976: | H:1 |
| 30977: | H:1 |
| 30978: | H:1 |
| 30979: | H:1 |
| 30980: | H:1 |
| 30981: | H:1 |
| 30982: | H:1 |
| 30983: | H:1 |
| 30984: | H:1 |
| 30985: | H:1 |
| 30986: | H:1 |
| 30987: | H:1 |
| 30988: | H:1 |
| 30989: | H:1 |
| 30990: | H:1 |
| 30991: | H:1 |
| 30992: | H:1 |
| 30993: | H:1 |
| 30994: | H:1 |
| 30995: | H:1 |
| 30996: | H:1 |
| 30997: | H:1 |
| 30998: | H:1 |
| 30999: | H:1 |
| 31000: | H:1 |
| 31001: | H:1 |
| 31002: | H:1 |
| 31003: | H:1 |
| 31004: | H:1 |
| 31005: | H:1 |
| 31006: | H:1 |
| 31007: | H:1 |
| 31008: | H:1 |
| 31009: | H:1 |
| 31010: | H:1 |
| 31011: | H:1 |
| 31012: | H:1 |
| 31013: | H:1 |
| 31014: | H:1 |
| 31015: | H:1 |
| 31016: | H:1 |
| 31017: | H:1 |
| 31018: | H:1 |
| 31019: | H:1 |
| 31020: | H:1 |
| 31021: | H:1 |
| 31022: | H:1 |
| 31023: | H:1 |
| 31024: | H:1 |
| 31025: | H:1 |
| 31026: | H:1 |
| 31027: | H:1 |
| 31028: | H:1 |
| 31029: | H:1 |
| 31030: | H:1 |
| 31031: | H:1 |
| 31032: | H:1 |
| 31033: | H:1 |
| 31034: | H:1 |
| 31035: | H:1 |
| 31036: | H:1 |
| 31037: | H:1 |
| 31038: | H:1 |
| 31039: | H:1 |
| 31040: | H:1 |
| 31041: | H:1 |
| 31042: | H:1 |
| 31043: | H:1 |
| 31044: | H:1 |
| 31045: | H:1 |
| 31046: | H:1 |
| 31047: | H:1 |
| 31048: | H:1 |
| 31049: | H:1 |
| 31050: | H:1 |
| 31051: | H:1 |
| 31052: | H:1 |
| 31053: | H:1 |
| 31054: | H:1 |
| 31055: | H:1 |
| 31056: | H:1 |
| 31057: | H:1 |
| 31058: | H:1 |
| 31059: | H:1 |
| 31060: | H:1 |
| 31061: | H:1 |
| 31062: | H:1 |
| 31063: | H:1 |
| 31064: | H:1 |
| 31065: | H:1 |

TABLE II-continued

| SEQ ID NO. | Spatial Distribution |
|---|---|
| 31066: | H:1 |
| 31067: | H:1 |
| 31068: | H:1 |
| 31069: | H:1 |
| 31070: | H:1 |
| 31071: | H:1 |
| 31072: | H:1 |
| 31073: | H:1 |
| 31074: | H:1 |
| 31075: | H:1 |
| 31076: | H:1 |
| 31077: | H:1 |
| 31078: | H:1 |
| 31079: | H:1 |
| 31080: | H:1 |
| 31081: | H:1 |
| 31082: | H:1 |
| 31083: | H:1 |
| 31084: | H:1 |
| 31085: | H:1 |
| 31036: | H:1 |
| 31087: | H:1 |
| 31088: | H:1 |
| 31089: | H:1 |
| 31090: | H:1 |
| 31091: | H:1 |
| 31092: | H:1 |
| 31093: | H:1 |
| 31094: | H:1 |
| 31095: | H:1 |
| 31096: | H:1 |
| 31097: | H:1 |
| 31098: | H:1 |
| 31099: | H:1 |
| 31100: | H:1 |
| 31101: | H:1 |
| 31102: | H:1 |
| 31103: | H:1 |
| 31104: | H:1 |
| 31105: | H:1 |
| 31106: | H:1 |
| 31107: | H:1 |
| 31108: | H:1 |
| 31109: | H:1 |
| 31110: | H:1 |
| 31111: | H:1 |
| 31112: | H:1 |
| 31113: | H:1 |
| 31114: | H:1 |
| 31115: | H:1 |
| 31116: | H:1 |
| 31117: | H:1 |
| 31118: | H:1 |
| 31119: | H:1 |
| 31120: | H:1 |
| 31121: | H:1 |
| 31122: | H:1 |
| 31123: | H:1 |
| 31124: | H:1 |
| 31125: | H:1 |
| 31126: | H:1 |
| 31127: | H:1 |
| 31128: | H:1 |
| 31129: | H:1 |
| 31130: | H:1 |
| 31131: | H:1 |
| 31132: | H:1 |
| 31133: | H:1 |
| 31134: | H:1 |
| 31135: | H:1 |
| 31136: | H:1 |
| 31137: | H:1 |
| 31138: | H:1 |
| 31139: | H:1 |
| 31140: | H:1 |
| 31141: | H:1 |
| 31142: | H:1 |
| 31143: | H:1 |
| 31144: | H:1 |
| 31145: | H:1 |
| 31146: | H:1 |
| 31147: | H:1 |
| 31148: | H:1 |
| 31149: | H:1 |
| 31150: | H:1 |
| 31151: | H:1 |
| 31152: | H:1 |
| 31153: | H:1 |
| 31154: | H:1 |
| 31155: | H:1 |
| 31156: | H:1 |
| 31157: | H:1 |
| 31158: | H:1 |
| 31159: | H:1 |
| 31160: | H:1 |
| 31161: | H:1 |
| 31162: | H:1 |
| 31163: | H:1 |
| 31164: | H:1 |
| 31165: | H:1 |
| 31166: | H:1 |
| 31167: | H:1 |
| 31168: | H:1 |
| 31169: | H:1 |
| 31170: | H:1 |
| 31171: | H:1 |
| 31172: | H:1 |
| 31173: | H:1 |
| 31174: | H:1 |
| 31175: | H:1 |
| 31176: | H:1 |
| 31177: | H:1 |
| 31178: | H:1 |
| 31179: | H:1 |
| 31180: | H:1 |
| 31181: | H:1 |
| 31182: | H:1 |
| 31183: | H:1 |
| 31184: | H:1 |
| 31185: | H:1 |
| 31186: | H:1 |
| 31187: | H:1 |
| 31188: | H:1 |
| 31189: | H:1 |
| 31190: | H:1 |
| 31191: | H:1 |
| 31192: | H:1 |
| 31193: | H:1 |
| 31194: | H:1 |
| 31195: | H:1 |
| 31196: | H:1 |
| 31197: | H:1 |
| 31198: | H:1 |
| 31199: | H:1 |
| 31200: | H:1 |
| 31201: | H:1 |
| 31202: | H:1 |
| 31203: | H:1 |
| 31204: | H:1 |
| 31205: | H:1 |
| 31206: | H:1 |
| 31207: | H:1 |
| 31208: | H:1 |
| 31209: | H:1 |
| 31210: | H:1 |
| 31211: | H:1 |
| 31212: | H:1 |
| 31213: | H:1 |
| 31214: | H:1 |
| 31215: | H:1 |
| 31216: | H:1 |
| 31217: | H:1 |
| 31218: | H:1 |
| 31219: | H:1 |

TABLE II-continued

| SEQ ID NO. | Spatial Distribution |
|---|---|
| 31220: | H:1 |
| 31221: | H:1 |
| 31222: | H:1 |
| 31223: | H:1 |
| 31224: | H:1 |
| 31225: | H:1 |
| 31226: | H:1 |
| 31227: | H:1 |
| 31228: | H:1 |
| 31229: | H:1 |
| 31230: | H:1 |
| 31231: | H:1 |
| 31232: | H:1 |
| 31233: | H:1 |
| 31234: | H:1 |
| 31235: | H:1 |
| 31236: | H:1 |
| 31237: | H:1 |
| 31238: | H:1 |
| 31239: | H:1 |
| 31240: | H:1 |
| 31241: | H:1 |
| 31242: | H:1 |
| 31243: | H:1 |
| 31244: | H:1 |
| 31245: | H:1 |
| 31246: | H:1 |
| 31247: | H:1 |
| 31248: | H:1 |
| 31249: | H:1 |
| 31250: | H:1 |
| 31251: | H:1 |
| 31252: | H:1 |
| 31253: | H:1 |
| 31254: | H:1 |
| 31255: | H:1 |
| 31256: | H:1 |
| 31257: | H:1 |
| 31258: | H:1 |
| 31259: | H:1 |
| 31260: | H:1 |
| 31261: | H:1 |
| 31262: | H:1 |
| 31263: | H:1 |
| 31264: | H:1 |
| 31265: | H:1 |
| 31266: | H:1 |
| 31267: | H:1 |
| 31268: | H:1 |
| 31269: | H:1 |
| 31270: | H:1 |
| 31271: | H:1 |
| 31272: | H:1 |
| 31273: | H:1 |
| 31274: | H:1 |
| 31275: | H:1 |
| 31276: | H:1 |
| 31277: | H:1 |
| 31278: | H:1 |
| 31279: | H:1 |
| 31280: | H:1 |
| 31281: | H:1 |
| 31282: | H:1 |
| 31283: | H:1 |
| 31284: | H:1 |
| 31285: | H:1 |
| 31286: | H:1 |
| 31287: | H:1 |
| 31288: | H:1 |
| 31289: | H:1 |
| 31290: | H:1 |
| 31291: | H:1 |
| 31292: | H:1 |
| 31293: | H:1 |
| 31294: | H:1 |
| 31295: | H:1 |
| 31296: | H:1 |
| 31297: | H:1 |
| 31298: | H:1 |
| 31299: | H:1 |
| 31300: | H:1 |
| 31301: | H:1 |
| 31302: | H:1 |
| 31303: | H:1 |
| 31304: | H:1 |
| 31305: | H:1 |
| 31306: | H:1 |
| 31307: | H:1 |
| 31308: | H:1 |
| 31309: | H:1 |
| 31310: | H:1 |
| 31311: | H:1 |
| 31312: | H:1 |
| 31313: | H:1 |
| 31314: | H:1 |
| 31315: | H:1 |
| 31316: | H:1 |
| 31317: | H:1 |
| 31318: | H:1 |
| 31319: | H:1 |
| 31320: | H:1 |
| 31321: | H:1 |
| 31322: | H:1 |
| 31323: | H:1 |
| 31324: | H:1 |
| 31325: | H:1 |
| 31326: | H:1 |
| 31327: | H:1 |
| 31328: | H:1 |
| 31329: | H:1 |
| 31330: | H:1 |
| 31331: | H:1 |
| 31332: | H:1 |
| 31333: | H:1 |
| 31334: | H:1 |
| 31335: | H:1 |
| 31336: | H:1 |
| 31337: | H:1 |
| 31338: | H:1 |
| 31339: | H:1 |
| 31340: | H:1 |
| 31341: | H:1 |
| 31342: | H:1 |
| 31343: | H:1 |
| 31344: | H:1 |
| 31345: | H:1 |
| 31346: | H:1 |
| 31347: | H:1 |
| 31348: | H:1 |
| 31349: | H:1 |
| 31350: | H:1 |
| 31351: | H:1 |
| 31352: | H:1 |
| 31353: | H:1 |
| 31354: | H:1 |
| 31355: | H:1 |
| 31356: | H:1 |
| 31357: | H:1 |
| 31358: | H:1 |
| 31359: | H:1 |
| 31360: | H:1 |
| 31361: | H:1 |
| 31362: | H:1 |
| 31363: | H:1 |
| 31364: | H:1 |
| 31365: | H:1 |
| 31366: | H:1 |
| 31367: | H:1 |
| 31368: | H:1 |
| 31369: | H:1 |
| 31370: | H:1 |
| 31371: | H:1 |
| 31372: | H:1 |
| 31373: | H:1 |

TABLE II-continued

| SEQ ID NO. | Spatial Distribution |
|---|---|
| 31374: | H:1 |
| 31375: | H:1 |
| 31376: | H:1 |
| 31377: | H:1 |
| 31378: | H:1 |
| 31379: | H:1 |
| 31380: | H:1 |
| 31381: | H:1 |
| 31382: | H:1 |
| 31383: | H:1 |
| 31384: | H:1 |
| 31385: | H:1 |
| 31386: | H:1 |
| 31387: | H:1 |
| 31388: | H:1 |
| 31389: | H:1 |
| 31390: | H:1 |
| 31391: | H:1 |
| 31392: | H:1 |
| 31393: | H:1 |
| 31394: | H:1 |
| 31395: | H:1 |
| 31396: | H:1 |
| 31397: | H:1 |
| 31398: | H:1 |
| 31399: | H:1 |
| 31400: | H:1 |
| 31401: | H:1 |
| 31402: | H:1 |
| 31403: | H:1 |
| 31404: | H:1 |
| 31405: | H:1 |
| 31406: | H:1 |
| 31407: | H:1 |
| 31408: | H:1 |
| 31409: | H:1 |
| 31410: | H:1 |
| 31411: | H:1 |
| 31412: | H:1 |
| 31413: | H:1 |
| 31414: | H:1 |
| 31415: | H:1 |
| 31416: | H:1 |
| 31417: | H:1 |
| 31418: | H:1 |
| 31419: | H:1 |
| 31420: | H:1 |
| 31421: | H:1 |
| 31422: | H:1 |
| 31423: | H:1 |
| 31424: | H:1 |
| 31425: | H:1 |
| 31426: | H:1 |
| 31427: | H:1 |
| 31428: | H:1 |
| 31429: | H:1 |
| 31430: | H:1 |
| 31431: | H:1 |
| 31432: | H:1 |
| 31433: | H:1 |
| 31434: | H:1 |
| 31435: | H:1 |
| 31436: | H:1 |
| 31437: | H:1 |
| 31438: | H:1 |
| 31439: | H:1 |
| 31440: | H:1 |
| 31441: | H:1 |
| 31442: | H:1 |
| 31443: | H:1 |
| 31444: | H:1 |
| 31445: | H:1 |
| 31446: | H:1 |
| 31447: | H:1 |
| 31448: | H:1 |
| 31449: | H:1 |
| 31450: | H:1 |
| 31451: | H:1 |
| 31452: | H:1 |
| 31453: | H:1 |
| 31454: | H:1 |
| 31455: | H:1 |
| 31456: | H:1 |
| 31457: | H:1 |
| 31458: | H:1 |
| 31459: | H:1 |
| 31460: | H:1 |
| 31461: | H:1 |
| 31462: | H:1 |
| 31463: | H:1 |
| 31464: | H:1 |
| 31465: | H:1 |
| 31466: | H:1 |
| 31467: | H:1 |
| 31468: | H:1 |
| 31469: | H:1 |
| 31470: | H:1 |
| 31471: | H:1 |
| 31472: | H:1 |
| 31473: | H:1 |
| 31474: | H:1 |
| 31475: | H:1 |
| 31476: | H:1 |
| 31477: | H:1 |
| 31478: | H:1 |
| 31479: | H:1 |
| 31480: | H:1 |
| 31481: | H:1 |
| 31482: | H:1 |
| 31483: | H:1 |
| 31484: | H:1 |
| 31485: | H:1 |
| 31486: | H:1 |
| 31487: | H:1 |
| 31488: | H:1 |
| 31489: | H:1 |
| 31490: | H:1 |
| 31491: | H:1 |
| 31492: | H:1 |
| 31493: | H:1 |
| 31494: | H:1 |
| 31495: | H:1 |
| 31496: | H:1 |
| 31497: | H:1 |
| 31498: | H:1 |
| 31499: | H:1 |
| 31500: | H:1 |
| 31501: | H:1 |
| 31502: | H:1 |
| 31503: | H:1 |
| 31504: | H:1 |
| 31505: | H:1 |
| 31506: | H:1 |
| 31507: | H:1 |
| 31508: | H:1 |
| 31509: | H:1 |
| 31510: | H:1 |
| 31511: | H:1 |
| 31512: | H:1 |
| 31513: | H:1 |
| 31514: | H:1 |
| 31515: | H:1 |
| 31516: | H:1 |
| 31517: | H:1 |
| 31518: | H:1 |
| 31519: | H:1 |
| 31520: | H:1 |
| 31521: | H:1 |
| 31522: | H:1 |
| 31523: | H:1 |
| 31524: | H:1 |
| 31525: | H:1 |
| 31526: | H:1 |
| 31527: | H:1 |

TABLE II-continued

| SEQ ID NO. | Spatial Distribution |
|---|---|
| 31528: | H:1 |
| 31529: | H:1 |
| 31530: | H:1 |
| 31531: | H:1 |
| 31532: | H:1 |
| 31533: | H:1 |
| 31534: | H:1 |
| 31535: | H:1 |
| 31536: | H:1 |
| 31537: | H:1 |
| 31538: | H:1 |
| 31539: | H:1 |
| 31540: | H:1 |
| 31541: | H:1 |
| 31542: | H:1 |
| 31543: | H:1 |
| 31544: | H:1 |
| 31545: | H:1 |
| 31546: | H:1 |
| 31547: | H:1 |
| 31548: | H:1 |
| 31549: | H:1 |
| 31550: | H:1 |
| 31551: | H:1 |
| 31552: | H:1 |
| 31553: | H:1 |
| 31554: | H:1 |
| 31555: | H:1 |
| 31556: | H:1 |
| 31557: | H:1 |
| 31558: | H:1 |
| 31559: | H:1 |
| 31560: | H:1 |
| 31561: | H:1 |
| 31562: | H:1 |
| 31563: | H:1 |
| 31564: | H:1 |
| 31565: | H:1 |
| 31566: | H:1 |
| 31567: | H:1 |
| 31568: | H:1 |
| 31569: | H:1 |
| 31570: | H:1 |
| 31571: | H:1 |
| 31572: | H:1 |
| 31573: | H:1 |
| 31574: | H:1 |
| 31575: | H:1 |
| 31576: | H:1 |
| 31577: | H:1 |
| 31578: | H:1 |
| 31579: | H:1 |
| 31580: | H:1 |
| 31581: | H:1 |
| 31582: | H:1 |
| 31583: | H:1 |
| 31584: | H:1 |
| 31585: | H:1 |
| 31586: | H:1 |
| 31587: | H:1 |
| 31588: | H:1 |
| 31589: | H:1 |
| 31590: | H:1 |
| 31591: | H:1 |
| 31592: | H:1 |
| 31593: | H:1 |
| 31594: | H:1 |
| 31595: | H:1 |
| 31596: | H:1 |
| 31597: | H:1 |
| 31598: | H:1 |
| 31599: | H:1 |
| 31600: | H:1 |
| 31601: | H:1 |
| 31602: | H:1 |
| 31603: | H:1 |
| 31604: | H:1 |
| 31605: | H:1 |
| 31606: | H:1 |
| 31607: | H:1 |
| 31608: | H:1 |
| 31609: | H:1 |
| 31610: | H:1 |
| 31611: | H:1 |
| 31612: | H:1 |
| 31613: | H:1 |
| 31614: | H:1 |
| 31615: | H:1 |
| 31616: | H:1 |
| 31617: | H:1 |
| 31618: | H:1 |
| 31619: | H:1 |
| 31620: | H:1 |
| 31621: | H:1 |
| 31622: | H:1 |
| 31623: | H:1 |
| 31624: | H:1 |
| 31625: | H:1 |
| 31626: | H:1 |
| 31627: | H:1 |
| 31628: | H:1 |
| 31629: | H:1 |
| 31630: | H:1 |
| 31631: | H:1 |
| 31632: | H:1 |
| 31633: | H:1 |
| 31634: | H:1 |
| 31635: | H:1 |
| 31636: | H:1 |
| 31637: | H:1 |
| 31638: | H:1 |
| 31639: | H:1 |
| 31640: | H:1 |
| 31641: | H:1 |
| 31642: | H:1 |
| 31643: | H:1 |
| 31644: | H:1 |
| 31645: | H:1 |
| 31646: | H:1 |
| 31647: | H:1 |
| 31648: | H:1 |
| 31649: | H:1 |
| 31650: | H:1 |
| 31651: | H:1 |
| 31652: | H:1 |
| 31653: | H:1 |
| 31654: | H:1 |
| 31655: | H:1 |
| 31656: | H:1 |
| 31657: | H:1 |
| 31658: | H:1 |
| 31659: | H:1 |
| 31660: | H:1 |
| 31661: | H:1 |
| 31662: | H:1 |
| 31663: | H:1 |
| 31664: | H:1 |
| 31665: | H:1 |
| 31666: | H:1 |
| 31667: | H:1 |
| 31668: | H:1 |
| 31669: | H:1 |
| 31670: | H:1 |
| 31671: | H:1 |
| 31672: | H:1 |
| 31673: | H:1 |
| 31674: | H:1 |
| 31675: | H:1 |
| 31676: | H:1 |
| 31677: | H:1 |
| 31678: | H:1 |
| 31679: | H:1 |
| 31680: | H:1 |
| 31681: | H:1 |

TABLE II-continued

| SEQ ID NO. | Spatial Distribution |
|---|---|
| 31682: | H:1 |
| 31683: | H:1 |
| 31684: | H:1 |
| 31685: | H:1 |
| 31686: | H:1 |
| 31687: | H:1 |
| 31688: | H:1 |
| 31689: | H:1 |
| 31690: | H:1 |
| 31691: | H:1 |
| 31692: | H:1 |
| 31693: | H:1 |
| 31694: | H:1 |
| 31695: | H:1 |
| 31696: | H:1 |
| 31697: | H:1 |
| 31698: | H:1 |
| 31699: | H:1 |
| 31700: | H:1 |
| 31701: | H:1 |
| 31702: | H:1 |
| 31703: | H:1 |
| 31704: | H:1 |
| 31705: | H:1 |
| 31706: | H:1 |
| 31707: | H:1 |
| 31708: | H:1 |
| 31709: | H:1 |
| 31710: | H:1 |
| 31711: | H:1 |
| 31712: | H:1 |
| 31713: | H:1 |
| 31714: | H:1 |
| 31715: | H:1 |
| 31716: | H:1 |
| 31717: | H:1 |
| 31718: | H:1 |
| 31719: | H:1 |
| 31720: | H:1 |
| 31721: | H:1 |
| 31722: | H:1 |
| 31723: | H:1 |
| 31724: | H:1 |
| 31725: | H:1 |
| 31726: | H:1 |
| 31727: | H:1 |
| 31728: | H:1 |
| 31729: | H:1 |
| 31730: | H:1 |
| 31731: | H:1 |
| 31732: | H:1 |
| 31733: | H:1 |
| 31734: | H:1 |
| 31735: | H:1 |
| 31736: | H:1 |
| 31737: | H:1 |
| 31738: | H:1 |
| 31739: | H:1 |
| 31740: | H:1 |
| 31741: | H:1 |
| 31742: | H:1 |
| 31743: | H:1 |
| 31744: | H:1 |
| 31745: | H:1 |
| 31746: | H:1 |
| 31747: | H:1 |
| 31748: | H:1 |
| 31749: | H:1 |
| 31750: | H:1 |
| 31751: | H:1 |
| 31752: | H:1 |
| 31753: | H:1 |
| 31754: | H:1 |
| 31755: | H:1 |
| 31756: | H:1 |
| 31757: | H:1 |
| 31758: | H:1 |
| 31759: | H:1 |
| 31760: | H:1 |
| 31761: | H:1 |
| 31762: | H:1 |
| 31763: | H:1 |
| 31764: | H:1 |
| 31765: | H:1 |
| 31766: | H:1 |
| 31767: | H:1 |
| 31768: | H:1 |
| 31769: | H:1 |
| 31770: | H:1 |
| 31771: | H:1 |
| 31772: | H:1 |
| 31773: | H:1 |
| 31774: | H:1 |
| 31775: | H:1 |
| 31776: | H:1 |
| 31777: | H:1 |
| 31778: | H:1 |
| 31779: | H:1 |
| 31780: | H:1 |
| 31781: | H:1 |
| 31782: | H:1 |
| 31783: | H:1 |
| 31784: | H:1 |
| 31785: | H:1 |
| 31786: | H:1 |
| 31787: | H:1 |
| 31788: | H:1 |
| 31789: | H:1 |
| 31790: | H:1 |
| 31791: | H:1 |
| 31792: | H:1 |
| 31793: | H:1 |
| 31794: | H:1 |
| 31795: | H:1 |
| 31796: | H:1 |
| 31797: | H:1 |
| 31798: | H:1 |
| 31799: | H:1 |
| 31800: | H:1 |
| 31801: | H:1 |
| 31802: | H:1 |
| 31803: | H:1 |
| 31804: | H:1 |
| 31805: | H:1 |
| 31806: | H:1 |
| 31807: | H:1 |
| 31808: | H:1 |
| 31809: | H:1 |
| 31810: | H:1 |
| 31811: | H:1 |
| 31812: | H:1 |
| 31813: | H:1 |
| 31814: | H:1 |
| 31815: | H:1 |
| 31816: | H:1 |
| 31817: | H:1 |
| 31818: | H:1 |
| 31819: | H:1 |
| 31820: | H:1 |
| 31821: | H:1 |
| 31822: | H:1 |
| 31823: | H:1 |
| 31824: | H:1 |
| 31825: | H:1 |
| 31826: | H:1 |
| 31827: | H:1 |
| 31828: | H:1 |
| 31829: | H:1 |
| 31830: | H:1 |
| 31831: | H:1 |
| 31832: | H:1 |
| 31833: | H:1 |
| 31834: | H:1 |
| 31835: | H:1 |

TABLE II-continued

| SEQ ID NO. | Spatial Distribution |
|---|---|
| 31836: | H:1 |
| 31837: | H:1 |
| 31838: | H:1 |
| 31839: | H:1 |
| 31840: | H:1 |
| 31841: | H:1 |
| 31842: | H:1 |
| 31843: | H:1 |
| 31844: | H:1 |
| 31845: | H:1 |
| 31846: | H:1 |
| 31847: | H:1 |
| 31848: | H:1 |
| 31849: | H:1 |
| 31850: | H:1 |
| 31851: | H:1 |
| 31852: | H:1 |
| 31853: | H:1 |
| 31854: | H:1 |
| 31855: | H:1 |
| 31856: | H:1 |
| 31857: | H:1 |
| 31858: | H:1 |
| 31859: | H:1 |
| 31860: | H:1 |
| 31861: | H:1 |
| 31862: | H:1 |
| 31863: | H:1 |
| 31864: | H:1 |
| 31865: | H:1 |
| 31866: | H:1 |
| 31867: | H:1 |
| 31868: | H:1 |
| 31869: | H:1 |
| 31870: | H:1 |
| 31871: | H:1 |
| 31872: | H:1 |
| 31873: | H:1 |
| 31874: | H:1 |
| 31875: | H:1 |
| 31876: | H:1 |
| 31877: | H:1 |
| 31878: | H:1 |
| 31879: | H:1 |
| 31880: | H:1 |
| 31881: | H:1 |
| 31882: | H:1 |
| 31883: | H:1 |
| 31884: | H:1 |
| 31885: | H:1 |
| 31886: | H:1 |
| 31887: | H:1 |
| 31888: | H:1 |
| 31889: | H:1 |
| 31890: | H:1 |
| 31891: | H:1 |
| 31892: | H:1 |
| 31893: | H:1 |
| 31894: | H:1 |
| 31895: | H:1 |
| 31896: | H:1 |
| 31897: | H:1 |
| 31898: | H:1 |
| 31899: | H:1 |
| 31900: | H:1 |
| 31901: | H:1 |
| 31902: | H:1 |
| 31903: | H:1 |
| 31904: | H:1 |
| 31905: | H:1 |
| 31906: | H:1 |
| 31907: | H:1 |
| 31908: | H:1 |
| 31909: | H:1 |
| 31910: | H:1 |
| 31911: | H:1 |
| 31912: | H:1 |
| 31913: | H:1 |
| 31914: | H:1 |
| 31915: | H:1 |
| 31916: | H:1 |
| 31917: | H:1 |
| 31918: | H:1 |
| 31919: | H:1 |
| 31920: | H:1 |
| 31921: | H:1 |
| 31922: | H:1 |
| 31923: | H:1 |
| 31924: | H:1 |
| 31925: | H:1 |
| 31926: | H:1 |
| 31927: | H:1 |
| 31928: | H:1 |
| 31929: | H:1 |
| 31930: | H:1 |
| 31931: | H:1 |
| 31932: | H:1 |
| 31933: | H:1 |
| 31934: | H:1 |
| 31935: | H:1 |
| 31936: | H:1 |
| 31937: | H:1 |
| 31938: | H:1 |
| 31939: | H:1 |
| 31940: | H:1 |
| 31941: | H:1 |
| 31942: | H:1 |
| 31943: | H:1 |
| 31944: | H:1 |
| 31945: | H:1 |
| 31946: | H:1 |
| 31947: | H:1 |
| 31948: | H:1 |
| 31949: | H:1 |
| 31950: | H:1 |
| 31951: | H:1 |
| 31952: | H:1 |
| 31953: | H:1 |
| 31954: | H:1 |
| 31955: | H:1 |
| 31956: | H:1 |
| 31957: | H:1 |
| 31958: | H:1 |
| 31959: | H:1 |
| 31960: | H:1 |
| 31961: | H:1 |
| 31962: | H:1 |
| 31963: | H:1 |
| 31964: | H:1 |
| 31965: | H:1 |
| 31966: | H:1 |
| 31967: | H:1 |
| 31968: | H:1 |
| 31969: | H:1 |
| 31970: | H:1 |
| 31971: | H:1 |
| 31972: | H:1 |
| 31973: | H:1 |
| 31974: | H:1 |
| 31975: | H:1 |
| 31976: | H:1 |
| 31977: | H:1 |
| 31978: | H:1 |
| 31979: | H:1 |
| 31980: | H:1 |
| 31981: | H:1 |
| 31982: | H:1 |
| 31983: | H:1 |
| 31984: | H:1 |
| 31985: | H:1 |
| 31986: | H:1 |
| 31987: | H:1 |
| 31988: | H:1 |
| 31989: | H:1 |

TABLE II-continued

| SEQ ID NO. | Spatial Distribution |
|---|---|
| 31990: | H:1 |
| 31991: | H:1 |
| 31992: | H:1 |
| 31993: | H:1 |
| 31994: | H:1 |
| 31995: | H:1 |
| 31996: | H:1 |
| 31997: | H:1 |
| 31998: | H:1 |
| 31999: | H:1 |
| 32000: | H:1 |
| 32001: | H:1 |
| 32002: | H:1 |
| 32003: | H:1 |
| 32004: | H:1 |
| 32005: | H:1 |
| 32006: | H:1 |
| 32007: | H:1 |
| 32008: | H:1 |
| 32009: | H:1 |
| 32010: | H:1 |
| 32011: | H:1 |
| 32012: | H:1 |
| 32013: | H:1 |
| 32014: | H:1 |
| 32015: | H:1 |
| 32016: | H:1 |
| 32017: | H:1 |
| 32018: | H:1 |
| 32019: | H:1 |
| 32020: | H:1 |
| 32021: | H:1 |
| 32022: | H:1 |
| 32023: | H:1 |
| 32024: | H:1 |
| 32025: | H:1 |
| 32026: | H:1 |
| 32027: | H:1 |
| 32028: | H:1 |
| 32029: | H:1 |
| 32030: | H:1 |
| 32031: | H:1 |
| 32032: | H:1 |
| 32033: | H:1 |
| 32034: | H:1 |
| 32035: | H:1 |
| 32036: | H:1 |
| 32037: | H:1 |
| 32038: | H:1 |
| 32039: | H:1 |
| 32040: | H:1 |
| 32041: | H:1 |
| 32042: | H:1 |
| 32043: | H:1 |
| 32044: | H:1 |
| 32045: | H:1 |
| 32046: | H:1 |
| 32047: | H:1 |
| 32048: | H:1 |
| 32049: | H:1 |
| 32050: | H:1 |
| 32051: | H:1 |
| 32052: | H:1 |
| 32053: | H:1 |
| 32054: | H:1 |
| 32055: | H:1 |
| 32056: | H:1 |
| 32057: | H:1 |
| 32058: | H:1 |
| 32059: | H:1 |
| 32060: | H:1 |
| 32061: | H:1 |
| 32062: | H:1 |
| 32063: | H:1 |
| 32064: | H:1 |
| 32065: | H:1 |
| 32066: | H:1 |
| 32067: | H:1 |
| 32068: | H:1 |
| 32069: | H:1 |
| 32070: | H:1 |
| 32071: | H:1 |
| 32072: | H:1 |
| 32073: | H:1 |
| 32074: | H:1 |
| 32075: | H:1 |
| 32076: | H:1 |
| 32077: | H:1 |
| 32078: | H:1 |
| 32079: | H:1 |
| 32080: | H:1 |
| 32081: | H:1 |
| 32082: | H:1 |
| 32083: | H:1 |
| 32084: | H:1 |
| 32085: | H:1 |
| 32086: | H:1 |
| 32087: | H:1 |
| 32088: | H:1 |
| 32089: | H:1 |
| 32090: | H:1 |
| 32091: | H:1 |
| 32092: | H:1 |
| 32093: | H:1 |
| 32094: | H:1 |
| 32095: | H:1 |
| 32096: | H:1 |
| 32097: | H:1 |
| 32098: | H:1 |
| 32099: | H:1 |
| 32100: | H:1 |
| 32101: | H:1 |
| 32102: | H:1 |
| 32103: | H:1 |
| 32104: | H:1 |
| 32105: | H:1 |
| 32106: | H:1 |
| 32107: | H:1 |
| 32108: | H:1 |
| 32109: | H:1 |
| 32110: | H:1 |
| 32111: | H:1 |
| 32112: | H:1 |
| 32113: | H:1 |
| 32114: | H:1 |
| 32115: | H:1 |
| 32116: | H:1 |
| 32117: | H:1 |
| 32118: | H:1 |
| 32119: | H:1 |
| 32120: | H:1 |
| 32121: | H:1 |
| 32122: | H:1 |
| 32123: | H:1 |
| 32124: | H:1 |
| 32125: | H:1 |
| 32126: | H:1 |
| 32127: | H:1 |
| 32128: | H:1 |
| 32129: | H:1 |
| 32130: | H:1 |
| 32131: | H:1 |
| 32132: | H:1 |
| 32133: | H:1 |
| 32134: | H:1 |
| 32135: | H:1 |
| 32136: | H:1 |
| 32137: | H:1 |
| 32138: | H:1 |
| 32139: | H:1 |
| 32140: | H:1 |
| 32141: | H:1 |
| 32142: | H:1 |
| 32143: | H:1 |

TABLE II-continued

| SEQ ID NO. | Spatial Distribution |
|---|---|
| 32144: | H:1 |
| 32145: | H:1 |
| 32146: | H:1 |
| 32147: | H:1 |
| 32148: | H:1 |
| 32149: | H:1 |
| 32150: | H:1 |
| 32151: | H:1 |
| 32152: | H:1 |
| 32153: | H:1 |
| 32154: | H:1 |
| 32155: | H:1 |
| 32156: | H:1 |
| 32157: | H:1 |
| 32158: | H:1 |
| 32159: | H:1 |
| 32160: | H:1 |
| 32161: | H:1 |
| 32162: | H:1 |
| 32163: | H:1 |
| 32164: | H:1 |
| 32165: | H:1 |
| 32166: | H:1 |
| 32167: | H:1 |
| 32168: | H:1 |
| 32169: | H:1 |
| 32170: | H:1 |
| 32171: | H:1 |
| 32172: | H:1 |
| 32173: | H:1 |
| 32174: | H:1 |
| 32175: | H:1 |
| 32176: | H:1 |
| 32177: | H:1 |
| 32178: | H:1 |
| 32179: | H:1 |
| 32180: | H:1 |
| 32181: | H:1 |
| 32182: | H:1 |
| 32183: | H:1 |
| 32184: | H:1 |
| 32185: | H:1 |
| 32186: | H:1 |
| 32187: | H:1 |
| 32188: | H:1 |
| 32189: | H:1 |
| 32190: | H:1 |
| 32191: | H:1 |
| 32192: | H:1 |
| 32193: | H:1 |
| 32194: | H:1 |
| 32195: | H:1 |
| 32196: | H:1 |
| 32197: | H:1 |
| 32198: | H:1 |
| 32199: | H:1 |
| 32200: | H:1 |
| 32201: | H:1 |
| 32202: | H:1 |
| 32203: | H:1 |
| 32204: | H:1 |
| 32205: | H:1 |
| 32206: | H:1 |
| 32207: | H:1 |
| 32208: | H:1 |
| 32209: | H:1 |
| 32210: | H:1 |
| 32211: | H:1 |
| 32212: | H:1 |
| 32213: | H:1 |
| 32214: | H:1 |
| 32215: | H:1 |
| 32216: | H:1 |
| 32217: | H:1 |
| 32218: | H:1 |
| 32219: | H:1 |
| 32220: | H:1 |
| 32221: | H:1 |
| 32222: | H:1 |
| 32223: | H:1 |
| 32224: | H:1 |
| 32225: | H:1 |
| 32226: | H:1 |
| 32227: | H:1 |
| 32228: | H:1 |
| 32229: | H:1 |
| 32230: | H:1 |
| 32231: | H:1 |
| 32232: | H:1 |
| 32233: | H:1 |
| 32234: | H:1 |
| 32235: | H:1 |
| 32236: | H:1 |
| 32237: | H:1 |
| 32238: | H:1 |
| 32239: | H:1 |
| 32240: | H:1 |
| 32241: | H:1 |
| 32242: | H:1 |
| 32243: | H:1 |
| 32244: | H:1 |
| 32245: | H:1 |
| 32246: | H:1 |
| 32247: | H:1 |
| 32248: | H:1 |
| 32249: | H:1 |
| 32250: | H:1 |
| 32251: | H:1 |
| 32252: | H:1 |
| 32253: | H:1 |
| 32254: | H:1 |
| 32255: | H:1 |
| 32256: | H:1 |
| 32257: | H:1 |
| 32258: | H:1 |
| 32259: | H:1 |
| 32260: | H:1 |
| 32261: | H:1 |
| 32262: | H:1 |
| 32263: | H:1 |
| 32264: | H:1 |
| 32265: | H:1 |
| 32266: | H:1 |
| 32267: | H:1 |
| 32268: | H:1 |
| 32269: | H:1 |
| 32270: | H:1 |
| 32271: | H:1 |
| 32272: | H:1 |
| 32273: | H:1 |
| 32274: | H:1 |
| 32275: | H:1 |
| 32276: | H:1 |
| 32277: | H:1 |
| 32278: | H:1 |
| 32279: | H:1 |
| 32280: | H:1 |
| 32281: | H:1 |
| 32282: | H:1 |
| 32283: | H:1 |
| 32284: | H:1 |
| 32285: | H:1 |
| 32286: | H:1 |
| 32287: | H:1 |
| 32288: | H:1 |
| 32289: | H:1 |
| 32290: | H:1 |
| 32291: | H:1 |
| 32292: | H:1 |
| 32293: | H:1 |
| 32294: | H:1 |
| 32295: | H:1 |
| 32296: | H:1 |
| 32297: | H:1 |

TABLE II-continued

| SEQ ID NO. | Spatial Distribution |
|---|---|
| 32298: | H:1 |
| 32299: | H:1 |
| 32300: | H:1 |
| 32301: | H:1 |
| 32302: | H:1 |
| 32303: | H:1 |
| 32304: | H:1 |
| 32305: | H:1 |
| 32306: | H:1 |
| 32307: | H:1 |
| 32308: | H:1 |
| 32309: | H:1 |
| 32310: | H:1 |
| 32311: | H:1 |
| 32312: | H:1 |
| 32313: | H:1 |
| 32314: | H:1 |
| 32315: | H:1 |
| 32316: | H:1 |
| 32317: | H:1 |
| 32318: | H:1 |
| 32319: | H:1 |
| 32320: | H:1 |
| 32321: | H:1 |
| 32322: | H:1 |
| 32323: | H:1 |
| 32324: | H:1 |
| 32325: | H:1 |
| 32326: | H:1 |
| 32327: | H:1 |
| 32328: | H:1 |
| 32329: | H:1 |
| 32330: | H:1 |
| 32331: | H:1 |
| 32332: | H:1 |
| 32333: | H:1 |
| 32334: | H:1 |
| 32335: | H:1 |
| 32336: | H:1 |
| 32337: | H:1 |
| 32338: | H:1 |
| 32339: | H:1 |
| 32340: | H:1 |
| 32341: | H:1 |
| 32342: | H:1 |
| 32343: | H:1 |
| 32344: | H:1 |
| 32345: | H:1 |
| 32346: | H:1 |
| 32347: | H:1 |
| 32348: | H:1 |
| 32349: | H:1 |
| 32350: | H:1 |
| 32351: | H:1 |
| 32352: | H:1 |
| 32353: | H:1 |
| 32354: | H:1 |
| 32355: | H:1 |
| 32356: | H:1 |
| 32357: | H:1 |
| 32358: | H:1 |
| 32359: | H:1 |
| 32360: | H:1 |
| 32361: | H:1 |
| 32362: | H:1 |
| 32363: | H:1 |
| 32364: | H:1 |
| 32365: | H:1 |
| 32366: | H:1 |
| 32367: | H:1 |
| 32368: | H:1 |
| 32369: | H:1 |
| 32370: | H:1 |
| 32371: | H:1 |
| 32372: | H:1 |
| 32373: | H:1 |
| 32374: | H:1 |
| 32375: | H:1 |
| 32376: | H:1 |
| 32377: | H:1 |
| 32378: | H:1 |
| 32379: | H:1 |
| 32380: | H:1 |
| 32381: | H:1 |
| 32382: | H:1 |
| 32383: | H:1 |
| 32384: | H:1 |
| 32385: | H:1 |
| 32386: | H:1 |
| 32387: | H:1 |
| 32388: | H:1 |
| 32389: | H:1 |
| 32390: | H:1 |
| 32391: | H:1 |
| 32392: | H:1 |
| 32393: | H:1 |
| 32394: | H:1 |
| 32395: | H:1 |
| 32396: | H:1 |
| 32397: | H:1 |
| 32398: | H:1 |
| 32399: | H:1 |
| 32400: | H:1 |
| 32401: | H:1 |
| 32402: | H:1 |
| 32403: | H:1 |
| 32404: | H:1 |
| 32405: | H:1 |
| 32406: | H:1 |
| 32407: | H:1 |
| 32408: | H:1 |
| 32409: | H:1 |
| 32410: | H:1 |
| 32411: | H:1 |
| 32412: | H:1 |
| 32413: | H:1 |
| 32414: | H:1 |
| 32415: | H:1 |
| 32416: | H:1 |
| 32417: | H:1 |
| 32418: | H:1 |
| 32419: | H:1 |
| 32420: | H:1 |
| 32421: | H:1 |
| 32422: | H:1 |
| 32423: | H:1 |
| 32424: | H:1 |
| 32425: | H:1 |
| 32426: | H:1 |
| 32427: | H:1 |
| 32428: | H:1 |
| 32429: | H:1 |
| 32430: | H:1 |
| 32431: | H:1 |
| 32432: | H:1 |
| 32433: | H:1 |
| 32434: | H:1 |
| 32435: | H:1 |
| 32436: | H:1 |
| 32437: | H:1 |
| 32438: | H:1 |
| 32439: | H:1 |
| 32440: | H:1 |
| 32441: | H:1 |
| 32442: | H:1 |
| 32443: | H:1 |
| 32444: | H:1 |
| 32445: | H:1 |
| 32446: | H:1 |
| 32447: | H:1 |
| 32448: | H:1 |
| 32449: | H:1 |
| 32450: | H:1 |
| 32451: | H:1 |

TABLE II-continued

| SEQ ID NO. | Spatial Distribution |
|---|---|
| 32452: | H:1 |
| 32453: | H:1 |
| 32454: | H:1 |
| 32455: | H:1 |
| 32456: | H:1 |
| 32457: | H:1 |
| 32458: | H:1 |
| 32459: | H:1 |
| 32460: | H:1 |
| 32461: | H:1 |
| 32462: | H:1 |
| 32463: | H:1 |
| 32464: | H:1 |
| 32465: | H:1 |
| 32466: | H:1 |
| 32467: | H:1 |
| 32468: | H:1 |
| 32469: | H:1 |
| 32470: | H:1 |
| 32471: | H:1 |
| 32472: | H:1 |
| 32473: | H:1 |
| 32474: | H:1 |
| 32475: | H:1 |
| 32476: | H:1 |
| 32477: | H:1 |
| 32478: | H:1 |
| 32479: | H:1 |
| 32480: | H:1 |
| 32481: | H:1 |
| 32482: | H:1 |
| 32483: | H:1 |
| 32484: | H:1 |
| 32485: | H:1 |
| 32486: | H:1 |
| 32487: | H:1 |
| 32488: | H:1 |
| 32489: | H:1 |
| 32490: | H:1 |
| 32491: | H:1 |
| 32492: | H:1 |
| 32493: | H:1 |
| 32494: | H:1 |
| 32495: | H:1 |
| 32496: | H:1 |
| 32497: | H:1 |
| 32498: | H:1 |
| 32499: | H:1 |
| 32500: | H:1 |
| 32501: | H:1 |
| 32502: | H:1 |
| 32503: | H:1 |
| 32504: | H:1 |
| 32505: | H:1 |
| 32506: | H:1 |
| 32507: | H:1 |
| 32508: | H:1 |
| 32509: | H:1 |
| 32510: | H:1 |
| 32511: | H:1 |
| 32512: | H:1 |
| 32513: | H:1 |
| 32514: | H:1 |
| 32515: | H:1 |
| 32516: | H:1 |
| 32517: | H:1 |
| 32518: | H:1 |
| 32519: | H:1 |
| 32520: | H:1 |
| 32521: | H:1 |
| 32522: | H:1 |
| 32523: | H:1 |
| 32524: | H:1 |
| 32525: | H:1 |
| 32526: | H:1 |
| 32527: | H:1 |
| 32528: | H:1 |
| 32529: | H:1 |
| 32530: | H:1 |
| 32531: | H:1 |
| 32532: | H:1 |
| 32533: | H:1 |
| 32534: | H:1 |
| 32535: | H:1 |
| 32536: | H:1 |
| 32537: | H:1 |
| 32538: | H:1 |
| 32539: | H:1 |
| 32540: | H:1 |
| 32541: | H:1 |
| 32542: | H:1 |
| 32543: | H:1 |
| 32544: | H:1 |
| 32545: | H:1 |
| 32546: | H:1 |
| 32547: | H:1 |
| 32548: | H:1 |
| 32549: | H:1 |
| 32550: | H:1 |
| 32551: | H:1 |
| 32552: | H:1 |
| 32553: | H:1 |
| 32554: | H:1 |
| 32555: | H:1 |
| 32556: | H:1 |
| 32557: | H:1 |
| 32558: | H:1 |
| 32559: | H:1 |
| 32560: | H:1 |
| 32561: | H:1 |
| 32562: | H:1 |
| 32563: | H:1 |
| 32564: | H:1 |
| 32565: | H:1 |
| 32566: | H:1 |
| 32567: | H:1 |
| 32568: | H:1 |
| 32569: | H:1 |
| 32570: | H:1 |
| 32571: | H:1 |
| 32572: | H:1 |
| 32573: | H:1 |
| 32574: | H:1 |
| 32575: | H:1 |
| 32576: | H:1 |
| 32577: | H:1 |
| 32578: | H:1 |
| 32579: | H:1 |
| 32580: | H:1 |
| 32581: | H:1 |
| 32582: | H:1 |
| 32583: | H:1 |
| 32584: | H:1 |
| 32585: | H:1 |
| 32586: | H:1 |
| 32587: | H:1 |
| 32588: | H:1 |
| 32589: | H:1 |
| 32590: | H:1 |
| 32591: | H:1 |
| 32592: | H:1 |
| 32593: | H:1 |
| 32594: | H:1 |
| 32595: | H:1 |
| 32596: | H:1 |
| 32597: | H:1 |
| 32598: | H:1 |
| 32599: | H:1 |
| 32600: | H:1 |
| 32601: | H:1 |
| 32602: | H:1 |
| 32603: | H:1 |
| 32604: | H:1 |
| 32605: | H:1 |

TABLE II-continued

| SEQ ID NO. | Spatial Distribution |
|---|---|
| 32606: | H:1 |
| 32607: | H:1 |
| 32608: | H:1 |
| 32609: | H:1 |
| 32610: | H:1 |
| 32611: | H:1 |
| 32612: | H:1 |
| 32613: | H:1 |
| 32614: | H:1 |
| 32615: | H:1 |
| 32616: | H:1 |
| 32617: | H:1 |
| 32618: | H:1 |
| 32619: | H:1 |
| 32620: | H:1 |
| 32621: | H:1 |
| 32622: | H:1 |
| 32623: | H:1 |
| 32624: | H:1 |
| 32625: | H:1 |
| 32626: | H:1 |
| 32627: | H:1 |
| 32628: | H:1 |
| 32629: | H:1 |
| 32630: | H:1 |
| 32631: | H:1 |
| 32632: | H:1 |
| 32633: | H:1 |
| 32634: | H:1 |
| 32635: | H:1 |
| 32636: | H:1 |
| 32637: | H:1 |
| 32638: | H:1 |
| 32639: | H:1 |
| 32640: | H:1 |
| 32641: | H:1 |
| 32642: | H:1 |
| 32643: | H:1 |
| 32644: | H:1 |
| 32645: | H:1 |
| 32646: | H:1 |
| 32647: | H:1 |
| 32648: | H:1 |
| 32649: | H:1 |
| 32650: | H:1 |
| 32651: | H:1 |
| 32652: | H:1 |
| 32653: | H:1 |
| 32654: | H:1 |
| 32655: | H:1 |
| 32656: | H:1 |
| 32657: | H:1 |
| 32658: | H:1 |
| 32659: | H:1 |
| 32660: | H:1 |
| 32661: | H:1 |
| 32662: | H:1 |
| 32663: | H:1 |
| 32664: | H:1 |
| 32665: | H:1 |
| 32666: | H:1 |
| 32667: | H:1 |
| 32668: | H:1 |
| 32669: | H:1 |
| 32670: | H:1 |
| 32671: | H:1 |
| 32672: | H:1 |
| 32673: | H:1 |
| 32674: | H:1 |
| 32675: | H:1 |
| 32676: | H:1 |
| 32677: | H:1 |
| 32678: | H:1 |
| 32679: | H:1 |
| 32680: | H:1 |
| 32681: | H:1 |
| 32682: | H:1 |
| 32683: | H:1 |
| 32684: | H:1 |
| 32685: | H:1 |
| 32686: | H:1 |
| 32687: | H:1 |
| 32688: | H:1 |
| 32689: | H:1 |
| 32690: | H:1 |
| 32691: | H:1 |
| 32692: | H:1 |
| 32693: | H:1 |
| 32694: | H:1 |
| 32695: | H:1 |
| 32696: | H:1 |
| 32697: | H:1 |
| 32698: | H:1 |
| 32699: | H:1 |
| 32700: | H:1 |
| 32701: | H:1 |
| 32702: | H:1 |
| 32703: | H:1 |
| 32704: | H:1 |
| 32705: | H:1 |
| 32706: | H:1 |
| 32707: | H:1 |
| 32708: | H:1 |
| 32709: | H:1 |
| 32710: | H:1 |
| 32711: | H:1 |
| 32712: | H:1 |
| 32713: | H:1 |
| 32714: | H:1 |
| 32715: | H:1 |
| 32716: | H:1 |
| 32717: | H:1 |
| 32718: | H:1 |
| 32719: | H:1 |
| 32720: | H:1 |
| 32721: | H:1 |
| 32722: | H:1 |
| 32723: | H:1 |
| 32724: | H:1 |
| 32725: | H:1 |
| 32726: | H:1 |
| 32727: | H:1 |
| 32728: | H:1 |
| 32729: | H:1 |
| 32730: | H:1 |
| 32731: | H:1 |
| 32732: | H:1 |
| 32733: | H:1 |
| 32734: | H:1 |
| 32735: | H:1 |
| 32736: | H:1 |
| 32737: | H:1 |
| 32738: | H:1 |
| 32739: | H:1 |
| 32740: | H:1 |
| 32741: | H:1 |
| 32742: | H:1 |
| 32743: | H:1 |
| 32744: | H:1 |
| 32745: | H:1 |
| 32746: | H:1 |
| 32747: | H:1 |
| 32748: | H:1 |
| 32749: | H:1 |
| 32750: | H:1 |
| 32751: | H:1 |
| 32752: | H:1 |
| 32753: | H:1 |
| 32754: | H:1 |
| 32755: | H:1 |
| 32756: | H:1 |
| 32757: | H:1 |
| 32758: | H:1 |
| 32759: | H:1 |

TABLE II-continued

| SEQ ID NO. | Spatial Distribution |
|---|---|
| 32760: | H:1 |
| 32761: | H:1 |
| 32762: | H:1 |
| 32763: | H:1 |
| 32764: | H:1 |
| 32765: | H:1 |
| 32766: | H:1 |
| 32767: | H:1 |
| 32768: | H:1 |
| 32769: | H:1 |
| 32770: | H:1 |
| 32771: | H:1 |
| 32772: | H:1 |
| 32773: | H:1 |
| 32774: | H:1 |
| 32775: | H:1 |
| 32776: | H:1 |
| 32777: | H:1 |
| 32778: | H:1 |
| 32779: | H:1 |
| 32780: | H:1 |
| 32781: | H:1 |
| 32782: | H:1 |
| 32783: | H:1 |
| 32784: | H:1 |
| 32785: | H:1 |
| 32786: | H:1 |
| 32787: | H:1 |
| 32788: | H:1 |
| 32789: | H:1 |
| 32790: | H:1 |
| 32791: | H:1 |
| 32792: | H:1 |
| 32793: | H:1 |
| 32794: | H:1 |
| 32795: | H:1 |
| 32796: | H:1 |
| 32797: | H:1 |
| 32798: | H:1 |
| 32799: | H:1 |
| 32800: | H:1 |
| 32801: | H:1 |
| 32802: | H:1 |
| 32803: | H:1 |
| 32804: | H:1 |
| 32805: | H:1 |
| 32806: | H:1 |
| 32807: | H:1 |
| 32808: | H:1 |
| 32809: | H:1 |
| 32810: | H:1 |
| 32811: | H:1 |
| 32812: | H:1 |
| 32813: | H:1 |
| 32814: | H:1 |
| 32815: | H:1 |
| 32816: | H:1 |
| 32817: | H:1 |
| 32818: | H:1 |
| 32819: | H:1 |
| 32820: | H:1 |
| 32821: | H:1 |
| 32822: | H:1 |
| 32823: | H:1 |
| 32824: | H:1 |
| 32825: | H:1 |
| 32826: | H:1 |
| 32827: | H:1 |
| 32828: | H:1 |
| 32829: | H:1 |
| 32830: | H:1 |
| 32831: | H:1 |
| 32832: | H:1 |
| 32833: | H:1 |
| 32834: | H:1 |
| 32835: | H:1 |
| 32836: | H:1 |
| 32837: | H:1 |
| 32838: | H:1 |
| 32839: | H:1 |
| 32840: | H:1 |
| 32841: | H:1 |
| 32842: | H:1 |
| 32843: | H:1 |
| 32844: | H:1 |
| 32845: | H:1 |
| 32846: | H:1 |
| 32847: | H:1 |
| 32848: | H:1 |
| 32849: | H:1 |
| 32850: | H:1 |
| 32851: | H:1 |
| 32852: | H:1 |
| 32853: | H:1 |
| 32854: | H:1 |
| 32855: | H:1 |
| 32856: | H:1 |
| 32857: | H:1 |
| 32858: | H:1 |
| 32859: | H:1 |
| 32860: | H:1 |
| 32861: | H:1 |
| 32862: | H:1 |
| 32863: | H:1 |
| 32864: | H:1 |
| 32865: | H:1 |
| 32866: | H:1 |
| 32867: | H:1 |
| 32868: | H:1 |
| 32869: | H:1 |
| 32870: | H:1 |
| 32871: | H:1 |
| 32872: | H:1 |
| 32873: | H:1 |
| 32874: | H:1 |
| 32875: | H:1 |
| 32876: | H:1 |
| 32877: | H:1 |
| 32878: | H:1 |
| 32879: | H:1 |
| 32880: | H:1 |
| 32881: | H:1 |
| 32882: | H:1 |
| 32883: | H:1 |
| 32884: | H:1 |
| 32885: | H:1 |
| 32886: | H:1 |
| 32887: | H:1 |
| 32888: | H:1 |
| 32889: | H:1 |
| 32890: | H:1 |
| 32891: | H:1 |
| 32892: | H:1 |
| 32893: | H:1 |
| 32894: | H:1 |
| 32895: | H:1 |
| 32896: | H:1 |
| 32897: | H:1 |
| 32898: | H:1 |
| 32899: | H:1 |
| 32900: | H:1 |
| 32901: | H:1 |
| 32902: | H:1 |
| 32903: | H:1 |
| 32904: | H:1 |
| 32905: | H:1 |
| 32906: | H:1 |
| 32907: | H:1 |
| 32908: | H:1 |
| 32909: | H:1 |
| 32910: | H:1 |
| 32911: | H:1 |
| 32912: | H:1 |
| 32913: | H:1 |

TABLE II-continued

| SEQ ID NO. | Spatial Distribution |
|---|---|
| 32914: | H:1 |
| 32915: | H:1 |
| 32916: | H:1 |
| 32917: | H:1 |
| 32918: | H:1 |
| 32919: | H:1 |
| 32920: | H:1 |
| 32921: | H:1 |
| 32922: | H:1 |
| 32923: | H:1 |
| 32924: | H:1 |
| 32925: | H:1 |
| 32926: | H:1 |
| 32927: | H:1 |
| 32928: | H:1 |
| 32929: | H:1 |
| 32930: | H:1 |
| 32931: | H:1 |
| 32932: | H:1 |
| 32933: | H:1 |
| 32934: | H:1 |
| 32935: | H:1 |
| 32936: | H:1 |
| 32937: | H:1 |
| 32938: | H:1 |
| 32939: | H:1 |
| 32940: | H:1 |
| 32941: | H:1 |
| 32942: | H:1 |
| 32943: | H:1 |
| 32944: | H:1 |
| 32945: | H:1 |
| 32946: | H:1 |
| 32947: | H:1 |
| 32948: | H:1 |
| 32949: | H:1 |
| 32950: | H:1 |
| 32951: | H:1 |
| 32952: | H:1 |
| 32953: | H:1 |
| 32954: | H:1 |
| 32955: | H:1 |
| 32956: | H:1 |
| 32957: | H:1 |
| 32958: | H:1 |
| 32959: | H:1 |
| 32960: | H:1 |
| 32961: | H:1 |
| 32962: | H:1 |
| 32963: | H:1 |
| 32964: | H:1 |
| 32965: | H:1 |
| 32966: | H:1 |
| 32967: | H:1 |
| 32968: | H:1 |
| 32969: | H:1 |
| 32970: | H:1 |
| 32971: | H:1 |
| 32972: | H:1 |
| 32973: | H:1 |
| 32974: | H:1 |
| 32975: | H:1 |
| 32976: | H:1 |
| 32977: | H:1 |
| 32978: | H:1 |
| 32979: | H:1 |
| 32980: | H:1 |
| 32981: | H:1 |
| 32982: | H:1 |
| 32983: | H:1 |
| 32984: | H:1 |
| 32985: | H:1 |
| 32986: | H:1 |
| 32987: | H:1 |
| 32988: | H:1 |
| 32989: | H:1 |
| 32990: | H:1 |
| 32991: | H:1 |
| 32992: | H:1 |
| 32993: | H:1 |
| 32994: | H:1 |
| 32995: | H:1 |
| 32996: | H:1 |
| 32997: | H:1 |
| 32998: | H:1 |
| 32999: | H:1 |
| 33000: | H:1 |
| 33001: | H:1 |
| 33002: | H:1 |
| 33003: | H:1 |
| 33004: | H:1 |
| 33005: | H:1 |
| 33006: | H:1 |
| 33007: | H:1 |
| 33008: | H:1 |
| 33009: | H:1 |
| 33010: | H:1 |
| 33011: | H:1 |
| 33012: | H:1 |
| 33013: | H:1 |
| 33014: | H:1 |
| 33015: | H:1 |
| 33016: | H:1 |
| 33017: | H:1 |
| 33018: | H:1 |
| 33019: | H:1 |
| 33020: | H:1 |
| 33021: | H:1 |
| 33022: | H:1 |
| 33023: | H:1 |
| 33024: | H:1 |
| 33025: | H:1 |
| 33026: | H:1 |
| 33027: | H:1 |
| 33028: | H:1 |
| 33029: | H:1 |
| 33030: | H:1 |
| 33031: | H:1 |
| 33032: | H:1 |
| 33033: | H:1 |
| 33034: | H:1 |
| 33035: | H:1 |
| 33036: | H:1 |
| 33037: | H:1 |
| 33038: | H:1 |
| 33039: | H:1 |
| 33040: | H:1 |
| 33041: | H:1 |
| 33042: | H:1 |
| 33043: | H:1 |
| 33044: | H:1 |
| 33045: | H:1 |
| 33046: | H:1 |
| 33047: | H:1 |
| 33048: | H:1 |
| 33049: | H:1 |
| 33050: | H:1 |
| 33051: | H:1 |
| 33052: | H:1 |
| 33053: | H:1 |
| 33054: | H:1 |
| 33055: | H:1 |
| 33056: | H:1 |
| 33057: | H:1 |
| 33058: | H:1 |
| 33059: | O:1 |
| 33060: | O:1 |
| 33061: | O:1 |
| 33062: | O:1 |
| 33063: | O:1 |
| 33064: | O:1 |
| 33065: | O:1 |
| 33066: | O:1 |
| 33067: | O:1 |

TABLE II-continued

| SEQ ID NO. | Spatial Distribution |
|---|---|
| 33068: | O:1 |
| 33069: | O:1 |
| 33070: | O:1 |
| 33071: | O:1 |
| 33072: | O:1 |
| 33073: | O:1 |
| 33074: | O:1 |
| 33075: | O:1 |
| 33076: | O:1 |
| 33077: | O:1 |
| 33078: | O:1 |
| 33079: | O:1 |
| 33080: | O:1 |
| 33081: | O:1 |
| 33082: | O:1 |
| 33083: | O:1 |
| 33084: | O:1 |
| 33085: | O:1 |
| 33086: | O:1 |
| 33087: | O:1 |
| 33088: | O:1 |
| 33089: | O:1 |
| 33090: | O:1 |
| 33091: | O:1 |
| 33092: | O:1 |
| 33093: | O:1 |
| 33094: | O:1 |
| 33095: | O:1 |
| 33096: | O:1 |
| 33097: | O:1 |
| 33098: | O:1 |
| 33099: | O:1 |
| 33100: | O:1 |
| 33101: | O:1 |
| 33102: | O:1 |
| 33103: | O:1 |
| 33104: | O:1 |
| 33105: | O:1 |
| 33106: | O:1 |
| 33107: | O:1 |
| 33108: | O:1 |
| 33109: | O:1 |
| 33110: | O:1 |
| 33111: | O:1 |
| 33112: | O:1 |
| 33113: | O:1 |
| 33114: | O:1 |
| 33115: | O:1 |
| 33116: | O:1 |
| 33117: | O:1 |
| 33118: | O:1 |
| 33119: | O:1 |
| 33120: | O:1 |
| 33121: | O:1 |
| 33122: | O:1 |
| 33123: | O:1 |
| 33124: | O:1 |
| 33125: | O:1 |
| 33126: | O:1 |
| 33127: | O:1 |
| 33128: | O:1 |
| 33129: | O:1 |
| 33130: | O:1 |
| 33131: | S:1 |
| 33132: | S:1 |
| 33133: | S:1 |
| 33134: | S:1 |
| 33135: | S:1 |
| 33136: | S:1 |
| 33137: | S:1 |
| 33138: | S:1 |
| 33139: | S:1 |
| 33140: | S:1 |
| 33141: | S:1 |
| 33142: | S:1 |
| 33143: | S:1 |
| 33144: | S:1 |
| 33145: | S:1 |
| 33146: | S:1 |
| 33147: | S:1 |
| 33148: | S:1 |
| 33149: | S:1 |
| 33150: | S:1 |
| 33151: | S:1 |
| 33152: | S:1 |
| 33153: | S:1 |
| 33154: | S:1 |
| 33155: | S:1 |
| 33156: | S:1 |
| 33157: | S:1 |
| 33158: | S:1 |
| 33159: | S:1 |
| 33160: | S:1 |
| 33161: | S:1 |
| 33162: | S:1 |
| 33163: | S:1 |
| 33164: | S:1 |
| 33165: | S:1 |
| 33166: | S:1 |
| 33167: | S:1 |
| 33168: | S:1 |
| 33169: | S:1 |
| 33170: | S:1 |
| 33171: | S:1 |
| 33172: | S:1 |
| 33173: | S:1 |
| 33174: | S:1 |
| 33175: | S:1 |
| 33176: | S:1 |
| 33177: | S:1 |
| 33178: | S:1 |
| 33179: | S:1 |
| 33180: | S:1 |
| 33181: | S:1 |
| 33182: | S:1 |
| 33183: | S:1 |
| 33184: | S:1 |
| 33185: | S:1 |
| 33186: | S:1 |
| 33187: | S:1 |
| 33188: | S:1 |
| 33189: | S:1 |
| 33190: | S:1 |
| 33191: | S:1 |
| 33192: | S:1 |
| 33193: | S:1 |
| 33194: | S:1 |
| 33195: | S:1 |
| 33196: | S:1 |
| 33197: | S:1 |
| 33198: | S:1 |
| 33199: | S:1 |
| 33200: | S:1 |
| 33201: | S:1 |
| 33202: | S:1 |
| 33203: | S:1 |
| 33204: | S:1 |
| 33205: | S:1 |
| 33206: | S:1 |
| 33207: | S:1 |
| 33208: | S:1 |
| 33209: | S:1 |
| 33210: | S:1 |
| 33211: | S:1 |
| 33212: | S:1 |
| 33213: | S:1 |
| 33214: | S:1 |
| 33215: | S:1 |
| 33216: | S:1 |
| 33217: | S:1 |
| 33218: | S:1 |
| 33219: | S:1 |
| 33220: | S:1 |
| 33221: | S:1 |

TABLE II-continued

| SEQ ID NO. | Spatial Distribution |
|---|---|
| 33222: | S:1 |
| 33223: | S:1 |
| 33224: | S:1 |
| 33225: | S:1 |
| 33226: | S:1 |
| 33227: | S:1 |
| 33228: | S:1 |
| 33229: | S:1 |
| 33230: | S:1 |
| 33231: | S:1 |
| 33232: | S:1 |
| 33233: | S:1 |
| 33234: | S:1 |
| 33235: | S:1 |
| 33236: | S:1 |
| 33237: | S:1 |
| 33238: | S:1 |
| 33239: | S:1 |
| 33240: | S:1 |
| 33241: | S:1 |
| 33242: | S:1 |
| 33243: | S:1 |
| 33244: | S:1 |
| 33245: | S:1 |
| 33246: | S:1 |
| 33247: | S:1 |
| 33248: | S:1 |
| 33249: | S:1 |
| 33250: | S:1 |
| 33251: | S:1 |
| 33252: | S:1 |
| 33253: | S:1 |
| 33254: | S:1 |
| 33255: | S:1 |
| 33256: | S:1 |
| 33257: | S:1 |
| 33258: | S:1 |
| 33259: | S:1 |
| 33260: | S:1 |
| 33261: | S:1 |
| 33262: | S:1 |
| 33263: | S:1 |
| 33264: | S:1 |
| 33265: | S:1 |
| 33266: | S:1 |
| 33267: | S:1 |
| 33268: | S:1 |
| 33269: | S:1 |
| 33270: | S:1 |
| 33271: | S:1 |
| 33272: | S:1 |
| 33273: | S:1 |
| 33274: | S:1 |
| 33275: | S:1 |
| 33276: | S:1 |
| 33277: | S:1 |
| 33278: | S:1 |
| 33279: | S:1 |
| 33280: | S:1 |
| 33281: | S:1 |
| 33282: | S:1 |
| 33283: | S:1 |
| 33284: | S:1 |
| 33285: | S:1 |
| 33286: | S:1 |
| 33287: | S:1 |
| 33288: | S:1 |
| 33289: | S:1 |
| 33290: | S:1 |
| 33291: | S:1 |
| 33292: | S:1 |
| 33293: | S:1 |
| 33294: | S:1 |
| 33295: | S:1 |
| 33296: | S:1 |
| 33297: | S:1 |
| 33298: | S:1 |
| 33299: | S:1 |
| 33300: | S:1 |
| 33301: | S:1 |
| 33302: | S:1 |
| 33303: | S:1 |
| 33304: | S:1 |
| 33305: | S:1 |
| 33306: | S:1 |
| 33307: | S:1 |
| 33308: | S:1 |
| 33309: | S:1 |
| 33310: | S:1 |
| 33311: | S:1 |
| 33312: | S:1 |
| 33313: | S:1 |
| 33314: | S:1 |
| 33315: | S:1 |
| 33316: | S:1 |
| 33317: | S:1 |
| 33318: | S:1 |
| 33319: | S:1 |
| 33320: | S:1 |
| 33321: | S:1 |
| 33322: | S:1 |
| 33323: | S:1 |
| 33324: | S:1 |
| 33325: | S:1 |
| 33326: | S:1 |
| 33327: | S:1 |
| 33328: | S:1 |
| 33329: | S:1 |
| 33330: | S:1 |
| 33331: | S:1 |
| 33332: | S:1 |
| 33333: | S:1 |
| 33334: | S:1 |
| 33335: | S:1 |
| 33336: | S:1 |
| 33337: | S:1 |
| 33338: | S:1 |
| 33339: | S:1 |
| 33340: | S:1 |
| 33341: | S:1 |
| 33342: | S:1 |
| 33343: | S:1 |
| 33344: | S:1 |
| 33345: | S:1 |
| 33346: | S:1 |
| 33347: | S:1 |
| 33348: | S:1 |
| 33349: | S:1 |
| 33350: | S:1 |
| 33351: | S:1 |
| 33352: | S:1 |
| 33353: | S:1 |
| 33354: | S:1 |
| 33355: | S:1 |
| 33356: | S:1 |
| 33357: | S:1 |
| 33358: | S:1 |
| 33359: | S:1 |
| 33360: | S:1 |
| 33361: | S:1 |
| 33362: | S:1 |
| 33363: | S:1 |
| 33364: | S:1 |
| 33365: | S:1 |
| 33366: | S:1 |
| 33367: | S:1 |
| 33368: | S:1 |
| 33369: | S:1 |
| 33370: | S:1 |
| 33371: | S:1 |
| 33372: | S:1 |
| 33373: | S:1 |
| 33374: | S:1 |
| 33375: | S:1 |

TABLE II-continued

| SEQ ID NO. | Spatial Distribution |
|---|---|
| 33376: | Z:1 |
| 33377: | Z:1 |
| 33378: | Z:1 |
| 33379: | Z:1 |
| 33380: | Z:1 |
| 33381: | Z:1 |
| 33382: | Z:1 |
| 33383: | Z:1 |
| 33384: | Z:1 |
| 33385: | Z:1 |
| 33386: | Z:1 |
| 33387: | Z:1 |
| 33388: | Z:1 |
| 33389: | Z:1 |
| 33390: | Z:1 |
| 33391: | Z:1 |
| 33392: | Z:1 |
| 33393: | Z:1 |
| 33394: | Z:1 |
| 33395: | Z:1 |
| 33396: | Z:1 |
| 33397: | Z:1 |
| 33398: | Z:1 |
| 33399: | Z:1 |
| 33400: | Z:1 |
| 33401: | Z:1 |
| 33402: | Z:1 |
| 33403: | Z:1 |
| 33404: | Z:1 |
| 33405: | Z:1 |
| 33406: | Z:1 |
| 33407: | Z:1 |
| 33408: | Z:1 |
| 33409: | Z:1 |
| 33410: | Z:1 |
| 33411: | Z:1 |
| 33412: | Z:1 |
| 33413: | Z:1 |
| 33414: | Z:1 |
| 33415: | Z:1 |
| 33416: | Z:1 |
| 33417: | Z:1 |
| 33418: | Z:1 |
| 33419: | Z:1 |
| 33420: | Z:1 |
| 33421: | Z:1 |
| 33422: | Z:1 |
| 33423: | Z:1 |
| 33424: | Z:1 |
| 33425: | Z:1 |
| 33426: | Z:1 |
| 33427: | Z:1 |
| 33428: | Z:1 |
| 33429: | Z:1 |
| 33430: | Z:1 |
| 33431: | Z:1 |
| 33432: | Z:1 |
| 33433: | Z:1 |
| 33434: | Z:1 |
| 33435: | Z:1 |
| 33436: | Z:1 |
| 33437: | Z:1 |
| 33438: | Z:1 |
| 33439: | Z:1 |
| 33440: | Z:1 |
| 33441: | Z:1 |
| 33442: | Z:1 |
| 33443: | Z:1 |
| 33444: | Z:1 |
| 33445: | Z:1 |
| 33446: | Z:1 |
| 33447: | Z:1 |
| 33448: | Z:1 |
| 33449: | Z:1 |
| 33450: | Z:1 |
| 33451: | Z:1 |
| 33452: | Z:1 |
| 33453: | Z:1 |
| 33454: | Z:1 |
| 33455: | Z:1 |
| 33456: | Z:1 |
| 33457: | Z:1 |
| 33458: | Z:1 |
| 33459: | Z:1 |
| 33460: | Z:1 |
| 33461: | Z:1 |
| 33462: | Z:1 |
| 33463: | Z:1 |
| 33464: | Z:1 |
| 33465: | Z:1 |
| 33466: | Z:1 |
| 33467: | Z:1 |
| 33468: | Z:1 |
| 33469: | Z:1 |
| 33470: | Z:1 |
| 33471: | Z:1 |
| 33472: | Z:1 |
| 33473: | Z:1 |
| 33474: | Z:1 |
| 33475: | Z:1 |
| 33476: | Z:1 |
| 33477: | Z:1 |
| 33478: | Z:1 |
| 33479: | Z:1 |
| 33480: | Z:1 |
| 33481: | Z:1 |
| 33482: | Z:1 |
| 33483: | Z:1 |
| 33484: | Z:1 |
| 33485: | Z:1 |
| 33486: | Z:1 |
| 33487: | Z:1 |
| 33488: | Z:1 |
| 33489: | Z:1 |
| 33490: | Z:1 |
| 33491: | Z:1 |
| 33492: | Z:1 |
| 33493: | I:1 |
| 33494: | I:1 |
| 33495: | I:1 |
| 33496: | I:1 |
| 33497: | I:1 |
| 33498: | I:1 |
| 33499: | I:1 |
| 33500: | I:1 |
| 33501: | I:1 |
| 33502: | I:1 |
| 33503: | I:1 |
| 33504: | I:1 |
| 33505: | I:1 |
| 33506: | I:1 |
| 33507: | I:1 |
| 33508: | I:1 |
| 33509: | I:1 |
| 33510: | I:1 |
| 33511: | I:1 |
| 33512: | I:1 |
| 33513: | I:1 |
| 33514: | I:1 |
| 33515: | I:1 |
| 33516: | I:1 |
| 33517: | I:1 |
| 33518: | I:1 |
| 33519: | I:1 |
| 33520: | I:1 |
| 33521: | I:1 |
| 33522: | I:1 |
| 33523: | I:1 |
| 33524: | I:1 |
| 33525: | I:1 |
| 33526: | I:1 |
| 33527: | I:1 |
| 33528: | I:1 |
| 33529: | I:1 |

TABLE II-continued

| SEQ ID NO. | Spatial Distribution |
|---|---|
| 33530: | I:1 |
| 33531: | I:1 |
| 33532: | I:1 |
| 33533: | I:1 |
| 33534: | I:1 |
| 33535: | I:1 |
| 33536: | I:1 |
| 33537: | I:1 |
| 33538: | I:1 |
| 33539: | I:1 |
| 33540: | I:1 |
| 33541: | I:1 |
| 33542: | I:1 |
| 33543: | I:1 |
| 33544: | I:1 |
| 33545: | I:1 |
| 33546: | I:1 |
| 33547: | I:1 |
| 33548: | I:1 |
| 33549: | I:1 |
| 33550: | I:1 |
| 33551: | I:1 |
| 33552: | I:1 |
| 33553: | I:1 |
| 33554: | I:1 |
| 33555: | I:1 |
| 33556: | I:1 |
| 33557: | I:1 |
| 33558: | I:1 |
| 33559: | I:1 |
| 33560: | I:1 |
| 33561: | I:1 |
| 33562: | I:1 |
| 33563: | J:1 |
| 33564: | J:1 |
| 33565: | J:1 |
| 33566: | J:1 |
| 33567: | J:1 |
| 33568: | J:1 |
| 33569: | J:1 |
| 33570: | J:1 |
| 33571: | J:1 |
| 33572: | J:1 |
| 33573: | J:1 |
| 33574: | J:1 |
| 33575: | J:1 |
| 33576: | J:1 |
| 33577: | J:1 |
| 33578: | J:1 |
| 33579: | J:1 |
| 33580: | J:1 |
| 33581: | J:1 |
| 33582: | J:1 |
| 33583: | J:1 |
| 33584: | J:1 |
| 33585: | J:1 |
| 33586: | J:1 |
| 33587: | J:1 |
| 33588: | J:1 |
| 33589: | J:1 |
| 33590: | J:1 |
| 33591: | J:1 |
| 33592: | J:1 |
| 33593: | J:1 |
| 33594: | J:1 |
| 33595: | J:1 |
| 33596: | J:1 |
| 33597: | J:1 |
| 33598: | J:1 |
| 33599: | J:1 |
| 33600: | J:1 |
| 33601: | J:1 |
| 33602: | J:1 |
| 33603: | J:1 |
| 33604: | J:1 |
| 33605: | J:1 |
| 33606: | J:1 |
| 33607: | J:1 |
| 33608: | J:1 |
| 33609: | J:1 |
| 33610: | J:1 |
| 33611: | J:1 |
| 33612: | J:1 |
| 33613: | J:1 |
| 33614: | J:1 |
| 33615: | J:1 |
| 33616: | J:1 |
| 33617: | J:1 |
| 33618: | J:1 |
| 33619: | J:1 |
| 33620: | J:1 |
| 33621: | J:1 |
| 33622: | J:1 |
| 33623: | J:1 |
| 33624: | J:1 |
| 33625: | J:1 |
| 33626: | J:1 |
| 33627: | J:1 |
| 33628: | J:1 |
| 33629: | J:1 |
| 33630: | J:1 |
| 33631: | J:1 |
| 33632: | J:1 |
| 33633: | J:1 |
| 33634: | J:1 |
| 33635: | J:1 |
| 33636: | J:1 |
| 33637: | J:1 |
| 33638: | J:1 |
| 33639: | J:1 |
| 33640: | J:1 |
| 33641: | J:1 |
| 33642: | J:1 |
| 33643: | J:1 |
| 33644: | J:1 |
| 33645: | J:1 |
| 33646: | J:1 |
| 33647: | J:1 |
| 33648: | J:1 |
| 33649: | J:1 |
| 33650: | J:1 |
| 33651: | J:1 |
| 33652: | J:1 |
| 33653: | J:1 |
| 33654: | J:1 |
| 33655: | J:1 |
| 33656: | J:1 |
| 33657: | J:1 |
| 33658: | J:1 |
| 33659: | J:1 |
| 33660: | J:1 |
| 33661: | J:1 |
| 33662: | J:1 |
| 33663: | J:1 |
| 33664: | J:1 |
| 33665: | J:1 |
| 33666: | J:1 |
| 33667: | J:1 |
| 33668: | J:1 |
| 33669: | J:1 |
| 33670: | J:1 |
| 33671: | J:1 |
| 33672: | J:1 |
| 33673: | A:1 |
| 33674: | A:1 |
| 33675: | A:1 |
| 33676: | A:1 |
| 33677: | A:1 |
| 33678: | A:1 |
| 33679: | A:1 |
| 33680: | A:1 |
| 33681: | A:1 |
| 33682: | A:1 |
| 33683: | A:1 |

TABLE II-continued

| SEQ ID NO. | Spatial Distribution |
|---|---|
| 33684: | A:1 |
| 33685: | A:1 |
| 33686: | A:1 |
| 33687: | A:1 |
| 33688: | A:1 |
| 33689: | A:1 |
| 33690: | A:1 |
| 33691: | A:1 |
| 33692: | A:1 |
| 33693: | A:1 |
| 33694: | A:1 |
| 33695: | A:1 |
| 33696: | A:1 |
| 33697: | A:1 |
| 33698: | A:1 |
| 33699: | A:1 |
| 33700: | A:1 |
| 33701: | A:1 |
| 33702: | A:1 |
| 33703: | A:1 |
| 33704: | A:1 |
| 33705: | A:1 |
| 33706: | A:1 |
| 33707: | A:1 |
| 33708: | A:1 |
| 33709: | A:1 |
| 33710: | A:1 |
| 33711: | A:1 |
| 33712: | A:1 |
| 33713: | A:1 |
| 33714: | A:1 |
| 33715: | A:1 |
| 33716: | A:1 |
| 33717: | A:1 |
| 33718: | A:1 |
| 33719: | A:1 |
| 33720: | A:1 |
| 33721: | A:1 |
| 33722: | A:1 |
| 33723: | A:1 |
| 33724: | A:1 |
| 33725: | A:1 |
| 33726: | A:1 |
| 33727: | A:1 |
| 33728: | A:1 |
| 33729: | A:1 |
| 33730: | A:1 |
| 33731: | A:1 |
| 33732: | A:1 |
| 33733: | A:1 |
| 33734: | AD:1 |
| 33735: | AD:1 |
| 33736: | AD:1 |
| 33737: | AD:1 |
| 33738: | AD:1 |
| 33739: | AD:1 |
| 33740: | AD:1 |
| 33741: | AD:1 |
| 33742: | AD:1 |
| 33743: | AD:1 |
| 33744: | AD:1 |
| 33745: | AD:1 |
| 33746: | AD:1 |
| 33747: | AD:1 |
| 33748: | AD:1 |
| 33749: | AD:1 |
| 33750: | AD:1 |
| 33751: | AD:1 |
| 33752: | AD:1 |
| 33753: | AD:1 |
| 33754: | AD:1 |
| 33755: | AD:1 |
| 33756: | AD:1 |
| 33757: | AD:1 |
| 33758: | AD:1 |
| 33759: | AD:1 |
| 33760: | AD:1 |
| 33761: | AD:1 |
| 33762: | AD:1 |
| 33763: | AD:1 |
| 33764: | AD:1 |
| 33765: | AD:1 |
| 33766: | AD:1 |
| 33767: | AD:1 |
| 33768: | AD:1 |
| 33769: | AD:1 |
| 33770: | AD:1 |
| 33771: | AD:1 |
| 33772: | AD:1 |
| 33773: | AD:1 |
| 33774: | AD:1 |
| 33775: | AD:1 |
| 33776: | AD:1 |
| 33777: | AD:1 |
| 33778: | AD:1 |
| 33779: | AD:1 |
| 33780: | AD:1 |
| 33781: | AD:1 |
| 33782: | AD:1 |
| 33783: | AD:1 |
| 33784: | AD:1 |
| 33785: | AD:1 |
| 33786: | AD:1 |
| 33787: | AD:1 |
| 33788: | AD:1 |
| 33789: | AD:1 |
| 33790: | AD:1 |
| 33791: | AD:1 |
| 33792: | AD:1 |
| 33793: | AD:1 |
| 33794: | AD:1 |
| 33795: | AD:1 |
| 33796: | AD:1 |
| 33797: | AD:1 |
| 33798: | AD:1 |
| 33799: | AD:1 |
| 33800: | AD:1 |
| 33801: | AD:1 |
| 33802: | AD:1 |
| 33803: | AD:1 |
| 33804: | AD:1 |
| 33805: | AD:1 |
| 33806: | AD:1 |
| 33807: | AD:1 |
| 33808: | AD:1 |
| 33809: | AD:1 |
| 33810: | AD:1 |
| 33811: | AD:1 |
| 33812: | AD:1 |
| 33813: | AD:1 |
| 33814: | AD:1 |
| 33815: | AD:1 |
| 33816: | AD:1 |
| 33817: | AD:1 |
| 33818: | AD:1 |
| 33819: | AD:1 |
| 33820: | AD:1 |
| 33821: | AD:1 |
| 33822: | AD:1 |
| 33823: | AD:1 |
| 33824: | AD:1 |
| 33825: | AD:1 |
| 33826: | AD:1 |
| 33827: | AD:1 |
| 33828: | AD:1 |
| 33829: | AD:1 |
| 33830: | AD:1 |
| 33831: | AD:1 |
| 33832: | AD:1 |
| 33833: | AD:1 |
| 33834: | AD:1 |
| 33835: | AD:1 |
| 33836: | AD:1 |
| 33837: | AD:1 |

TABLE II-continued

| SEQ ID NO. | Spatial Distribution |
|---|---|
| 33838: | AD:1 |
| 33839: | AD:1 |
| 33840: | AD:1 |
| 33841: | AD:1 |
| 33842: | AD:1 |
| 33843: | AD:1 |
| 33844: | AD:1 |
| 33845: | AD:1 |
| 33846: | AD:1 |
| 33847: | AD:1 |
| 33848: | AD:1 |
| 33849: | AD:1 |
| 33850: | AD:1 |
| 33851: | AD:1 |
| 33852: | AD:1 |
| 33853: | AD:1 |
| 33854: | AD:1 |
| 33855: | AD:1 |
| 33856: | AD:1 |
| 33857: | AD:1 |
| 33858: | AD:1 |
| 33859: | AD:1 |
| 33860: | AD:1 |
| 33861: | AD:1 |
| 33862: | AD:1 |
| 33863: | AD:1 |
| 33864: | AD:1 |
| 33865: | AD:1 |
| 33866: | AD:1 |
| 33867: | AD:1 |
| 33868: | AD:1 |
| 33869: | AD:1 |
| 33870: | AD:1 |
| 33871: | AD:1 |
| 33872: | AD:1 |
| 33873: | AD:1 |
| 33874: | AD:1 |
| 33875: | AD:1 |
| 33876: | AD:1 |
| 33877: | AD:1 |
| 33878: | AD:1 |
| 33879: | AD:1 |
| 33880: | AD:1 |
| 33881: | AD:1 |
| 33882: | AD:1 |
| 33883: | AD:1 |
| 33884: | AD:1 |
| 33885: | AD:1 |
| 33886: | AD:1 |
| 33887: | AD:1 |
| 33888: | AD:1 |
| 33889: | AD:1 |
| 33890: | AD:1 |
| 33891: | AD:1 |
| 33892: | AD:1 |
| 33893: | AD:1 |
| 33894: | AD:1 |
| 33895: | AD:1 |
| 33896: | AD:1 |
| 33897: | AD:1 |
| 33898: | AD:1 |
| 33899: | AD:1 |
| 33900: | AD:1 |
| 33901: | AD:1 |
| 33902: | AD:1 |
| 33903: | AD:1 |
| 33904: | AD:1 |
| 33905: | AD:1 |
| 33906: | AD:1 |
| 33907: | AD:1 |
| 33908: | AD:1 |
| 33909: | AD:1 |
| 33910: | AD:1 |
| 33911: | AD:1 |
| 33912: | AD:1 |
| 33913: | AD:1 |
| 33914: | AD:1 |
| 33915: | AD:1 |
| 33916: | AD:1 |
| 33917: | AD:1 |
| 33918: | AD:1 |
| 33919: | AD:1 |
| 33920: | AD:1 |
| 33921: | AD:1 |
| 33922: | AD:1 |
| 33923: | AD:1 |
| 33924: | AD:1 |
| 33925: | AD:1 |
| 33926: | AD:1 |
| 33927: | AD:1 |
| 33928: | AD:1 |
| 33929: | AD:1 |
| 33930: | AD:1 |
| 33931: | AD:1 |
| 33932: | AD:1 |
| 33933: | AD:1 |
| 33934: | AD:1 |
| 33935: | AD:1 |
| 33936: | AD:1 |
| 33937: | AD:1 |
| 33938: | AD:1 |
| 33939: | AD:1 |
| 33940: | AD:1 |
| 33941: | AD:1 |
| 33942: | AD:1 |
| 33943: | AD:1 |
| 33944: | AD:1 |
| 33945: | AD:1 |
| 33946: | AD:1 |
| 33947: | AD:1 |
| 33948: | AD:1 |
| 33949: | AD:1 |
| 33950: | AD:1 |
| 33951: | AD:1 |
| 33952: | AD:1 |
| 33953: | AD:1 |
| 33954: | AD:1 |
| 33955: | AD:1 |
| 33956: | AD:1 |
| 33957: | AD:1 |
| 33958: | AD:1 |
| 33959: | AD:1 |
| 33960: | AD:1 |
| 33961: | AD:1 |
| 33962: | AD:1 |
| 33963: | AD:1 |
| 33964: | AD:1 |
| 33965: | AD:1 |
| 33966: | AD:1 |
| 33967: | AD:1 |
| 33968: | AD:1 |
| 33969: | AD:1 |
| 33970: | AD:1 |
| 33971: | AD:1 |
| 33972: | AD:1 |
| 33973: | AD:1 |
| 33974: | AD:1 |
| 33975: | AD:1 |
| 33976: | AD:1 |
| 33977: | AD:1 |
| 33978: | AD:1 |
| 33979: | AD:1 |
| 33980: | AD:1 |
| 33981: | AD:1 |
| 33982: | AD:1 |
| 33983: | AD:1 |
| 33984: | AD:1 |
| 33985: | AD:1 |
| 33986: | AD:1 |
| 33987: | AD:1 |
| 33988: | AD:1 |
| 33989: | AD:1 |
| 33990: | AD:1 |
| 33991: | AD:1 |

TABLE II-continued

| SEQ ID NO. | Spatial Distribution |
|---|---|
| 33992: | AD:1 |
| 33993: | AD:1 |
| 33994: | AD:1 |
| 33995: | AD:1 |
| 33996: | AD:1 |
| 33997: | AD:1 |
| 33998: | AD:1 |
| 33999: | AD:1 |
| 34000: | AD:1 |
| 34001: | AD:1 |
| 34002: | AD:1 |
| 34003: | AD:1 |
| 34004: | AD:1 |
| 34005: | AD:1 |
| 34006: | AD:1 |
| 34007: | AD:1 |
| 34008: | AD:1 |
| 34009: | AD:1 |
| 34010: | AD:1 |
| 34011: | AD:1 |
| 34012: | AD:1 |
| 34013: | AD:1 |
| 34014: | AD:1 |
| 34015: | AD:1 |
| 34016: | AD:1 |
| 34017: | AD:1 |
| 34018: | AD:1 |
| 34019: | AD:1 |
| 34020: | AD:1 |
| 34021: | AD:1 |
| 34022: | AD:1 |
| 34023: | AD:1 |
| 34024: | AD:1 |
| 34025: | AD:1 |
| 34026: | AD:1 |
| 34027: | AD:1 |
| 34028: | AD:1 |
| 34029: | AD:1 |
| 34030: | AD:1 |
| 34031: | AD:1 |
| 34032: | AD:1 |
| 34033: | AD:1 |
| 34034: | AD:1 |
| 34035: | AD:1 |
| 34036: | AD:1 |
| 34037: | AD:1 |
| 34038: | AD:1 |
| 34039: | AD:1 |
| 34040: | AD:1 |
| 34041: | AD:1 |
| 34042: | AD:1 |
| 34043: | AD:1 |
| 34044: | AD:1 |
| 34045: | AD:1 |
| 34046: | AD:1 |
| 34047: | AD:1 |
| 34048: | AD:1 |
| 34049: | AD:1 |
| 34050: | AD:1 |
| 34051: | AD:1 |
| 34052: | AD:1 |
| 34053: | AD:1 |
| 34054: | AD:1 |
| 34055: | AD:1 |
| 34056: | AD:1 |
| 34057: | AD:1 |
| 34058: | AD:1 |
| 34059: | AD:1 |
| 34060: | AD:1 |
| 34061: | AD:1 |
| 34062: | AD:1 |
| 34063: | AD:1 |
| 34064: | AD:1 |
| 34065: | AD:1 |
| 34066: | AD:1 |
| 34067: | AD:1 |
| 34068: | AD:1 |
| 34069: | AD:1 |
| 34070: | AD:1 |
| 34071: | AD:1 |
| 34072: | AD:1 |
| 34073: | AD:1 |
| 34074: | AD:1 |
| 34075: | AD:1 |
| 34076: | AD:1 |
| 34077: | AD:1 |
| 34078: | AD:1 |
| 34079: | AD:1 |
| 34080: | AD:1 |
| 34081: | AD:1 |
| 34082: | AD:1 |
| 34083: | AD:1 |
| 34084: | AD:1 |
| 34085: | AD:1 |
| 34086: | AD:1 |
| 34087: | AD:1 |
| 34088: | AD:1 |
| 34089: | AD:1 |
| 34090: | AD:1 |
| 34091: | AD:1 |
| 34092: | AD:1 |
| 34093: | AD:1 |
| 34094: | AD:1 |
| 34095: | AD:1 |
| 34096: | AD:1 |
| 34097: | AD:1 |
| 34098: | AD:1 |
| 34099: | AD:1 |
| 34100: | AD:1 |
| 34101: | AD:1 |
| 34102: | AD:1 |
| 34103: | AD:1 |
| 34104: | AD:1 |
| 34105: | AD:1 |
| 34106: | AD:1 |
| 34107: | AD:1 |
| 34108: | AD:1 |
| 34109: | AD:1 |
| 34110: | AD:1 |
| 34111: | AD:1 |
| 34112: | AD:1 |
| 34113: | AD:1 |
| 34114: | AD:1 |
| 34115: | AD:1 |
| 34116: | AD:1 |
| 34117: | AD:1 |
| 34118: | AD:1 |
| 34119: | AD:1 |
| 34120: | AD:1 |
| 34121: | AD:1 |
| 34122: | AD:1 |
| 34123: | AD:1 |
| 34124: | AD:1 |
| 34125: | AD:1 |
| 34126: | AD:1 |
| 34127: | AD:1 |
| 34128: | AD:1 |
| 34129: | AD:1 |
| 34130: | AD:1 |
| 34131: | AD:1 |
| 34132: | AD:1 |
| 34133: | AD:1 |
| 34134: | AD:1 |
| 34135: | AD:1 |
| 34136: | AD:1 |
| 34137: | AD:1 |
| 34138: | AD:1 |
| 34139: | AD:1 |
| 34140: | AD:1 |
| 34141: | AD:1 |
| 34142: | AD:1 |
| 34143: | AD:1 |
| 34144: | AD:1 |
| 34145: | AD:1 |

TABLE II-continued

| SEQ ID NO. | Spatial Distribution |
|---|---|
| 34146: | AD:1 |
| 34147: | AD:1 |
| 34148: | AD:1 |
| 34149: | AD:1 |
| 34150: | AD:1 |
| 34151: | AD:1 |
| 34152: | AD:1 |
| 34153: | AD:1 |
| 34154: | AD:1 |
| 34155: | AD:1 |
| 34156: | AD:1 |
| 34157: | AD:1 |
| 34158: | AD:1 |
| 34159: | AD:1 |
| 34160: | AD:1 |
| 34161: | AD:1 |
| 34162: | AD:1 |
| 34163: | AD:1 |
| 34164: | AD:1 |
| 34165: | AD:1 |
| 34166: | AD:1 |
| 34167: | AD:1 |
| 34168: | AD:1 |
| 34169: | AD:1 |
| 34170: | AD:1 |
| 34171: | AD:1 |
| 34172: | AD:1 |
| 34173: | AD:1 |
| 34174: | AD:1 |
| 34175: | AD:1 |
| 34176: | AD:1 |
| 34177: | AD:1 |
| 34178: | AD:1 |
| 34179: | AD:1 |
| 34180: | AD:1 |
| 34181: | AD:1 |
| 34182: | AD:1 |
| 34183: | AD:1 |
| 34184: | AD:1 |
| 34185: | AD:1 |
| 34186: | AD:1 |
| 34187: | AD:1 |
| 34188: | AD:1 |
| 34189: | AD:1 |
| 34190: | AD:1 |
| 34191: | AD:1 |
| 34192: | AD:1 |
| 34193: | AD:1 |
| 34194: | AD:1 |
| 34195: | AD:1 |
| 34196: | AD:1 |
| 34197: | AD:1 |
| 34198: | AD:1 |
| 34199: | AD:1 |
| 34200: | AD:1 |
| 34201: | AD:1 |
| 34202: | AD:1 |
| 34203: | AD:1 |
| 34204: | AD:1 |
| 34205: | AD:1 |
| 34206: | AD:1 |
| 34207: | AD:1 |
| 34208: | AD:1 |
| 34209: | AD:1 |
| 34210: | AD:1 |
| 34211: | AD:1 |
| 34212: | AD:1 |
| 34213: | AD:1 |
| 34214: | AD:1 |
| 34215: | AD:1 |
| 34216: | AD:1 |
| 34217: | AD:1 |
| 34218: | AD:1 |
| 34219: | AD:1 |
| 34220: | AD:1 |
| 34221: | AD:1 |
| 34222: | AD:1 |
| 34223: | AD:1 |
| 34224: | AD:1 |
| 34225: | AD:1 |
| 34226: | AD:1 |
| 34227: | AD:1 |
| 34228: | AD:1 |
| 34229: | AD:1 |
| 34230: | AD:1 |
| 34231: | AD:1 |
| 34232: | AD:1 |
| 34233: | AD:1 |
| 34234: | AD:1 |
| 34235: | AD:1 |
| 34236: | AD:1 |
| 34237: | AD:1 |
| 34238: | AD:1 |
| 34239: | AD:1 |
| 34240: | AD:1 |
| 34241: | AD:1 |
| 34242: | AD:1 |
| 34243: | AD:1 |
| 34244: | AD:1 |
| 34245: | AD:1 |
| 34246: | AD:1 |
| 34247: | AD:1 |
| 34248: | AD:1 |
| 34249: | AD:1 |
| 34250: | AD:1 |
| 34251: | AD:1 |
| 34252: | C:1 |
| 34253: | C:1 |
| 34254: | C:1 |
| 34255: | C:1 |
| 34256: | C:1 |
| 34257: | C:1 |
| 34258: | C:1 |
| 34259: | C:1 |
| 34260: | C:1 |
| 34261: | C:1 |
| 34262: | C:1 |
| 34263: | C:1 |
| 34264: | C:1 |
| 34265: | C:1 |
| 34266: | C:1 |
| 34267: | C:1 |
| 34268: | C:1 |
| 34269: | C:1 |
| 34270: | C:1 |
| 34271: | C:1 |
| 34272: | C:1 |
| 34273: | C:1 |
| 34274: | C:1 |
| 34275: | C:1 |
| 34276: | C:1 |
| 34277: | C:1 |
| 34278: | C:1 |
| 34279: | C:1 |
| 34280: | C:1 |
| 34281: | C:1 |
| 34282: | C:1 |
| 34283: | C:1 |
| 34284: | C:1 |
| 34285: | C:1 |
| 34286: | C:1 |
| 34287: | C:1 |
| 34288: | C:1 |
| 34289: | C:1 |
| 34290: | C:1 |
| 34291: | C:1 |
| 34292: | C:1 |
| 34293: | C:1 |
| 34294: | C:1 |
| 34295: | C:1 |
| 34296: | C:1 |
| 34297: | C:1 |
| 34298: | C:1 |
| 34299: | C:1 |

TABLE II-continued

| SEQ ID NO. | Spatial Distribution |
|---|---|
| 34300: | C:1 |
| 34301: | C:1 |
| 34302: | C:1 |
| 34303: | C:1 |
| 34304: | C:1 |
| 34305: | C:1 |
| 34306: | C:1 |
| 34307: | C:1 |
| 34308: | C:1 |
| 34309: | C:1 |
| 34310: | C:1 |
| 34311: | C:1 |
| 34312: | C:1 |
| 34313: | C:1 |
| 34314: | C:1 |
| 34315: | C:1 |
| 34316: | C:1 |
| 34317: | C:1 |
| 34318: | C:1 |
| 34319: | C:1 |
| 34320: | C:1 |
| 34321: | C:1 |
| 34322: | C:1 |
| 34323: | C:1 |
| 34324: | C:1 |
| 34325: | C:1 |
| 34326: | C:1 |
| 34327: | C:1 |
| 34328: | C:1 |
| 34329: | C:1 |
| 34330: | C:1 |
| 34331: | C:1 |
| 34332: | C:1 |
| 34333: | C:1 |
| 34334: | C:1 |
| 34335: | C:1 |
| 34336: | C:1 |
| 34337: | C:1 |
| 34338: | C:1 |
| 34339: | C:1 |
| 34340: | C:1 |
| 34341: | C:1 |
| 34342: | C:1 |
| 34343: | C:1 |
| 34344: | C:1 |
| 34345: | C:1 |
| 34346: | C:1 |
| 34347: | C:1 |
| 34348: | C:1 |
| 34349: | C:1 |
| 34350: | C:1 |
| 34351: | C:1 |
| 34352: | C:1 |
| 34353: | C:1 |
| 34354: | C:1 |
| 34355: | C:1 |
| 34356: | C:1 |
| 34357: | C:1 |
| 34358: | C:1 |
| 34359: | C:1 |
| 34360: | C:1 |
| 34361: | C:1 |
| 34362: | C:1 |
| 34363: | C:1 |
| 34364: | C:1 |
| 34365: | C:1 |
| 34366: | C:1 |
| 34367: | C:1 |
| 34368: | C:1 |
| 34369: | C:1 |
| 34370: | C:1 |
| 34371: | C:1 |
| 34372: | C:1 |
| 34373: | C:1 |
| 34374: | C:1 |
| 34375: | C:1 |
| 34376: | C:1 |
| 34377: | C:1 |
| 34378: | C:1 |
| 34379: | C:1 |
| 34380: | C:1 |
| 34381: | C:1 |
| 34382: | C:1 |
| 34383: | C:1 |
| 34384: | C:1 |
| 34385: | C:1 |
| 34386: | C:1 |
| 34387: | C:1 |
| 34388: | C:1 |
| 34389: | C:1 |
| 34390: | C:1 |
| 34391: | C:1 |
| 34392: | C:1 |
| 34393: | C:1 |
| 34394: | C:1 |
| 34395: | C:1 |
| 34396: | C:1 |
| 34397: | C:1 |
| 34398: | C:1 |
| 34399: | C:1 |
| 34400: | C:1 |
| 34401: | C:1 |
| 34402: | C:1 |
| 34403: | C:1 |
| 34404: | C:1 |
| 34405: | C:1 |
| 34406: | C:1 |
| 34407: | C:1 |
| 34408: | C:1 |
| 34409: | C:1 |
| 34410: | C:1 |
| 34411: | C:1 |
| 34412: | C:1 |
| 34413: | C:1 |
| 34414: | C:1 |
| 34415: | C:1 |
| 34416: | C:1 |
| 34417: | C:1 |
| 34418: | C:1 |
| 34419: | C:1 |
| 34420: | C:1 |
| 34421: | C:1 |
| 34422: | C:1 |
| 34423: | C:1 |
| 34424: | C:1 |
| 34425: | C:1 |
| 34426: | C:1 |
| 34427: | C:1 |
| 34428: | C:1 |
| 34429: | C:1 |
| 34430: | C:1 |
| 34431: | C:1 |
| 34432: | C:1 |
| 34433: | C:1 |
| 34434: | C:1 |
| 34435: | C:1 |
| 34436: | C:1 |
| 34437: | C:1 |
| 34438: | C:1 |
| 34439: | C:1 |
| 34440: | C:1 |
| 34441: | C:1 |
| 34442: | C:1 |
| 34443: | C:1 |
| 34444: | C:1 |
| 34445: | C:1 |
| 34446: | C:1 |
| 34447: | C:1 |
| 34448: | C:1 |
| 34449: | C:1 |
| 34450: | C:1 |
| 34451: | C:1 |
| 34452: | C:1 |
| 34453: | C:1 |

TABLE II-continued

| SEQ ID NO. | Spatial Distribution |
|---|---|
| 34454: | C:1 |
| 34455: | C:1 |
| 34456: | C:1 |
| 34457: | C:1 |
| 34458: | C:1 |
| 34459: | C:1 |
| 34460: | C:1 |
| 34461: | C:1 |
| 34462: | C:1 |
| 34463: | C:1 |
| 34464: | C:1 |
| 34465: | C:1 |
| 34466: | C:1 |
| 34467: | C:1 |
| 34468: | C:1 |
| 34469: | C:1 |
| 34470: | C:1 |
| 34471: | C:1 |
| 34472: | C:1 |
| 34473: | C:1 |
| 34474: | C:1 |
| 34475: | C:1 |
| 34476: | C:1 |
| 34477: | C:1 |
| 34478: | C:1 |
| 34479: | C:1 |
| 34480: | C:1 |
| 34481: | C:1 |
| 34482: | C:1 |
| 34483: | C:1 |
| 34484: | C:1 |
| 34485: | C:1 |
| 34486: | C:1 |
| 34487: | C:1 |
| 34488: | C:1 |
| 34489: | C:1 |
| 34490: | C:1 |
| 34491: | C:1 |
| 34492: | C:1 |
| 34493: | C:1 |
| 34494: | C:1 |
| 34495: | C:1 |
| 34496: | C:1 |
| 34497: | C:1 |
| 34498: | C:1 |
| 34499: | C:1 |
| 34500: | C:1 |
| 34501: | C:1 |
| 34502: | C:1 |
| 34503: | C:1 |
| 34504: | C:1 |
| 34505: | C:1 |
| 34506: | C:1 |
| 34507: | C:1 |
| 34508: | C:1 |
| 34509: | C:1 |
| 34510: | C:1 |
| 34511: | C:1 |
| 34512: | C:1 |
| 34513: | C:1 |
| 34514: | C:1 |
| 34515: | C:1 |
| 34516: | C:1 |
| 34517: | C:1 |
| 34518: | C:1 |
| 34519: | C:1 |
| 34520: | C:1 |
| 34521: | C:1 |
| 34522: | C:1 |
| 34523: | C:1 |
| 34524: | C:1 |
| 34525: | C:1 |
| 34526: | C:1 |
| 34527: | C:1 |
| 34528: | C:1 |
| 34529: | C:1 |
| 34530: | C:1 |
| 34531: | C:1 |
| 34532: | C:1 |
| 34533: | C:1 |
| 34534: | C:1 |
| 34535: | C:1 |
| 34536: | C:1 |
| 34537: | C:1 |
| 34538: | C:1 |
| 34539: | C:1 |
| 34540: | C:1 |
| 34541: | C:1 |
| 34542: | C:1 |
| 34543: | C:1 |
| 34544: | C:1 |
| 34545: | C:1 |
| 34546: | C:1 |
| 34547: | C:1 |
| 34548: | C:1 |
| 34549: | C:1 |
| 34550: | C:1 |
| 34551: | C:1 |
| 34552: | C:1 |
| 34553: | C:1 |
| 34554: | C:1 |
| 34555: | C:1 |
| 34556: | C:1 |
| 34557: | C:1 |
| 34558: | C:1 |
| 34559: | C:1 |
| 34560: | C:1 |
| 34561: | C:1 |
| 34562: | C:1 |
| 34563: | C:1 |
| 34564: | C:1 |
| 34565: | C:1 |
| 34566: | C:1 |
| 34567: | C:1 |
| 34568: | C:1 |
| 34569: | C:1 |
| 34570: | C:1 |
| 34571: | C:1 |
| 34572: | C:1 |
| 34573: | C:1 |
| 34574: | C:1 |
| 34575: | C:1 |
| 34576: | C:1 |
| 34577: | C:1 |
| 34578: | C:1 |
| 34579: | C:1 |
| 34580: | C:1 |
| 34581: | C:1 |
| 34582: | C:1 |
| 34583: | C:1 |
| 34584: | C:1 |
| 34585: | C:1 |
| 34586: | C:1 |
| 34587: | C:1 |
| 34588: | C:1 |
| 34589: | C:1 |
| 34590: | C:1 |
| 34591: | C:1 |
| 34592: | C:1 |
| 34593: | C:1 |
| 34594: | C:1 |
| 34595: | C:1 |
| 34596: | C:1 |
| 34597: | C:1 |
| 34598: | C:1 |
| 34599: | C:1 |
| 34600: | C:1 |
| 34601: | C:1 |
| 34602: | C:1 |
| 34603: | C:1 |
| 34604: | C:1 |
| 34605: | C:1 |
| 34606: | C:1 |
| 34607: | C:1 |

TABLE II-continued

| SEQ ID NO. | Spatial Distribution |
|---|---|
| 34608: | C:1 |
| 34609: | C:1 |
| 34610: | C:1 |
| 34611: | C:1 |
| 34612: | C:1 |
| 34613: | C:1 |
| 34614: | C:1 |
| 34615: | C:1 |
| 34616: | C:1 |
| 34617: | C:1 |
| 34618: | C:1 |
| 34619: | C:1 |
| 34620: | C:1 |
| 34621: | C:1 |
| 34622: | C:1 |
| 34623: | C:1 |
| 34624: | C:1 |
| 34625: | C:1 |
| 34626: | C:1 |
| 34627: | C:1 |
| 34628: | C:1 |
| 34629: | C:1 |
| 34630: | C:1 |
| 34631: | C:1 |
| 34632: | C:1 |
| 34633: | C:1 |
| 34634: | C:1 |
| 34635: | C:1 |
| 34636: | C:1 |
| 34637: | C:1 |
| 34638: | C:1 |
| 34639: | C:1 |
| 34640: | C:1 |
| 34641: | C:1 |
| 34642: | C:1 |
| 34643: | C:1 |
| 34644: | C:1 |
| 34645: | C:1 |
| 34646: | C:1 |
| 34647: | C:1 |
| 34648: | C:1 |
| 34649: | C:1 |
| 34650: | C:1 |
| 34651: | C:1 |
| 34652: | C:1 |
| 34653: | C:1 |
| 34654: | C:1 |
| 34655: | C:1 |
| 34656: | C:1 |
| 34657: | C:1 |
| 34658: | C:1 |
| 34659: | C:1 |
| 34660: | C:1 |
| 34661: | C:1 |
| 34662: | C:1 |
| 34663: | C:1 |
| 34664: | C:1 |
| 34665: | C:1 |
| 34666: | C:1 |
| 34667: | C:1 |
| 34668: | C:1 |
| 34669: | C:1 |
| 34670: | C:1 |
| 34671: | C:1 |
| 34672: | C:1 |
| 34673: | C:1 |
| 34674: | C:1 |
| 34675: | C:1 |
| 34676: | C:1 |
| 34677: | C:1 |
| 34678: | C:1 |
| 34679: | C:1 |
| 34680: | C:1 |
| 34681: | C:1 |
| 34682: | C:1 |
| 34683: | C:1 |
| 34684: | C:1 |
| 34685: | C:1 |
| 34686: | C:1 |
| 34687: | C:1 |
| 34688: | C:1 |
| 34689: | C:1 |
| 34690: | C:1 |
| 34691: | C:1 |
| 34692: | C:1 |
| 34693: | C:1 |
| 34694: | C:1 |
| 34695: | C:1 |
| 34696: | C:1 |
| 34697: | C:1 |
| 34698: | C:1 |
| 34699: | C:1 |
| 34700: | C:1 |
| 34701: | C:1 |
| 34702: | C:1 |
| 34703: | C:1 |
| 34704: | C:1 |
| 34705: | C:1 |
| 34706: | C:1 |
| 34707: | C:1 |
| 34708: | C:1 |
| 34709: | C:1 |
| 34710: | C:1 |
| 34711: | C:1 |
| 34712: | C:1 |
| 34713: | C:1 |
| 34714: | C:1 |
| 34715: | C:1 |
| 34716: | C:1 |
| 34717: | C:1 |
| 34718: | C:1 |
| 34719: | C:1 |
| 34720: | C:1 |
| 34721: | C:1 |
| 34722: | C:1 |
| 34723: | C:1 |
| 34724: | C:1 |
| 34725: | C:1 |
| 34726: | C:1 |
| 34727: | C:1 |
| 34728: | C:1 |
| 34729: | C:1 |
| 34730: | C:1 |
| 34731: | C:1 |
| 34732: | C:1 |
| 34733: | C:1 |
| 34734: | C:1 |
| 34735: | C:1 |
| 34736: | C:1 |
| 34737: | C:1 |
| 34738: | C:1 |
| 34739: | C:1 |
| 34740: | C:1 |
| 34741: | C:1 |
| 34742: | C:1 |
| 34743: | C:1 |
| 34744: | C:1 |
| 34745: | C:1 |
| 34746: | C:1 |
| 34747: | C:1 |
| 34748: | C:1 |
| 34749: | C:1 |
| 34750: | C:1 |
| 34751: | C:1 |
| 34752: | C:1 |
| 34753: | C:1 |
| 34754: | C:1 |
| 34755: | C:1 |
| 34756: | C:1 |
| 34757: | C:1 |
| 34758: | C:1 |
| 34759: | C:1 |
| 34760: | C:1 |
| 34761: | C:1 |

TABLE II-continued

| SEQ ID NO. | Spatial Distribution |
|---|---|
| 34762: | C:1 |
| 34763: | C:1 |
| 34764: | C:1 |
| 34765: | C:1 |
| 34766: | C:1 |
| 34767: | C:1 |
| 34768: | C:1 |
| 34769: | C:1 |
| 34770: | C:1 |
| 34771: | C:1 |
| 34772: | C:1 |
| 34773: | C:1 |
| 34774: | C:1 |
| 34775: | C:1 |
| 34776: | C:1 |
| 34777: | C:1 |
| 34778: | C:1 |
| 34779: | C:1 |
| 34780: | C:1 |
| 34781: | C:1 |
| 34782: | C:1 |
| 34783: | C:1 |
| 34784: | C:1 |
| 34785: | C:1 |
| 34786: | C:1 |
| 34787: | C:1 |
| 34788: | C:1 |
| 34789: | C:1 |
| 34790: | C:1 |
| 34791: | C:1 |
| 34792: | C:1 |
| 34793: | C:1 |
| 34794: | C:1 |
| 34795: | C:1 |
| 34796: | C:1 |
| 34797: | C:1 |
| 34798: | C:1 |
| 34799: | C:1 |
| 34800: | C:1 |
| 34801: | C:1 |
| 34802: | C:1 |
| 34803: | C:1 |
| 34804: | C:1 |
| 34805: | C:1 |
| 34806: | C:1 |
| 34807: | C:1 |
| 34808: | C:1 |
| 34809: | C:1 |
| 34810: | C:1 |
| 34811: | C:1 |
| 34812: | K:1 |
| 34813: | K:1 |
| 34814: | K:1 |
| 34815: | K:1 |
| 34816: | K:1 |
| 34817: | K:1 |
| 34818: | K:1 |
| 34819: | K:1 |
| 34820: | K:1 |
| 34821: | K:1 |
| 34822: | K:1 |
| 34823: | K:1 |
| 34824: | K:1 |
| 34825: | K:1 |
| 34826: | K:1 |
| 34827: | K:1 |
| 34828: | K:1 |
| 34829: | K:1 |
| 34830: | K:1 |
| 34831: | K:1 |
| 34832: | K:1 |
| 34833: | K:1 |
| 34834: | K:1 |
| 34835: | K:1 |
| 34836: | K:1 |
| 34837: | K:1 |
| 34838: | K:1 |
| 34839: | K:1 |
| 34840: | K:1 |
| 34841: | K:1 |
| 34842: | K:1 |
| 34843: | K:1 |
| 34844: | K:1 |
| 34845: | K:1 |
| 34846: | K:1 |
| 34847: | K:1 |
| 34848: | K:1 |
| 34849: | K:1 |
| 34850: | K:1 |
| 34851: | K:1 |
| 34852: | K:1 |
| 34853: | K:1 |
| 34854: | K:1 |
| 34855: | K:1 |
| 34856: | K:1 |
| 34857: | K:1 |
| 34858: | K:1 |
| 34859: | K:1 |
| 34860: | K:1 |
| 34861: | K:1 |
| 34862: | K:1 |
| 34863: | K:1 |
| 34864: | K:1 |
| 34865: | K:1 |
| 34866: | K:1 |
| 34867: | K:1 |
| 34868: | K:1 |
| 34869: | K:1 |
| 34870: | K:1 |
| 34871: | K:1 |
| 34872: | K:1 |
| 34873: | K:1 |
| 34874: | K:1 |
| 34875: | K:1 |
| 34876: | K:1 |
| 34877: | K:1 |
| 34878: | K:1 |
| 34879: | K:1 |
| 34880: | K:1 |
| 34881: | K:1 |
| 34882: | K:1 |
| 34883: | K:1 |
| 34884: | K:1 |
| 34885: | K:1 |
| 34886: | K:1 |
| 34887: | K:1 |
| 34888: | K:1 |
| 34889: | K:1 |
| 34890: | K:1 |
| 34891: | K:1 |
| 34892: | K:1 |
| 34893: | K:1 |
| 34894: | K:1 |
| 34895: | K:1 |
| 34896: | K:1 |
| 34897: | K:1 |
| 34898: | K:1 |
| 34899: | K:1 |
| 34900: | K:1 |
| 34901: | K:1 |
| 34902: | K:1 |
| 34903: | K:1 |
| 34904: | K:1 |
| 34905: | K:1 |
| 34906: | K:1 |
| 34907: | K:1 |
| 34908: | K:1 |
| 34909: | K:1 |
| 34910: | K:1 |
| 34911: | K:1 |
| 34912: | K:1 |
| 34913: | K:1 |
| 34914: | K:1 |
| 34915: | K:1 |

TABLE II-continued

| SEQ ID NO. | Spatial Distribution |
|---|---|
| 34916: | K:1 |
| 34917: | K:1 |
| 34918: | K:1 |
| 34919: | K:1 |
| 34920: | K:1 |
| 34921: | K:1 |
| 34922: | K:1 |
| 34923: | K:1 |
| 34924: | K:1 |
| 34925: | K:1 |
| 34926: | K:1 |
| 34927: | K:1 |
| 34928: | K:1 |
| 34929: | K:1 |
| 34930: | K:1 |
| 34931: | K:1 |
| 34932: | K:1 |
| 34933: | K:1 |
| 34934: | K:1 |
| 34935: | K:1 |
| 34936: | K:1 |
| 34937: | K:1 |
| 34938: | K:1 |
| 34939: | K:1 |
| 34940: | K:1 |
| 34941: | K:1 |
| 34942: | K:1 |
| 34943: | K:1 |
| 34944: | K:1 |
| 34945: | K:1 |
| 34946: | K:1 |
| 34947: | K:1 |
| 34948: | K:1 |
| 34949: | K:1 |
| 34950: | K:1 |
| 34951: | K:1 |
| 34952: | K:1 |
| 34953: | K:1 |
| 34954: | K:1 |
| 34955: | K:1 |
| 34956: | K:1 |
| 34957: | K:1 |
| 34958: | K:1 |
| 34959: | K:1 |
| 34960: | K:1 |
| 34961: | K:1 |
| 34962: | K:1 |
| 34963: | K:1 |
| 34964: | K:1 |
| 34965: | K:1 |
| 34966: | K:1 |
| 34967: | K:1 |
| 34968: | K:1 |
| 34969: | K:1 |
| 34970: | K:1 |
| 34971: | K:1 |
| 34972: | K:1 |
| 34973: | K:1 |
| 34974: | K:1 |
| 34975: | K:1 |
| 34976: | K:1 |
| 34977: | K:1 |
| 34978: | K:1 |
| 34979: | K:1 |
| 34980: | K:1 |
| 34981: | K:1 |
| 34982: | K:1 |
| 34983: | K:1 |
| 34984: | K:1 |
| 34985: | K:1 |
| 34986: | K:1 |
| 34987: | K:1 |
| 34988: | K:1 |
| 34989: | K:1 |
| 34990: | K:1 |
| 34991: | K:1 |
| 34992: | K:1 |
| 34993: | K:1 |
| 34994: | K:1 |
| 34995: | K:1 |
| 34996: | K:1 |
| 34997: | K:1 |
| 34998: | K:1 |
| 34999: | K:1 |
| 35000: | K:1 |
| 35001: | K:1 |
| 35002: | K:1 |
| 35003: | K:1 |
| 35004: | K:1 |
| 35005: | K:1 |
| 35006: | K:1 |
| 35007: | K:1 |
| 35008: | K:1 |
| 35009: | K:1 |
| 35010: | K:1 |
| 35011: | K:1 |
| 35012: | K:1 |
| 35013: | K:1 |
| 35014: | K:1 |
| 35015: | K:1 |
| 35016: | K:1 |
| 35017: | K:1 |
| 35018: | K:1 |
| 35019: | K:1 |
| 35020: | K:1 |
| 35021: | K:1 |
| 35022: | K:1 |
| 35023: | K:1 |
| 35024: | K:1 |
| 35025: | K:1 |
| 35026: | K:1 |
| 35027: | K:1 |
| 35028: | K:1 |
| 35029: | K:1 |
| 35030: | K:1 |
| 35031: | K:1 |
| 35032: | K:1 |
| 35033: | K:1 |
| 35034: | K:1 |
| 35035: | K:1 |
| 35036: | K:1 |
| 35037: | K:1 |
| 35038: | K:1 |
| 35039: | K:1 |
| 35040: | K:1 |
| 35041: | K:1 |
| 35042: | K:1 |
| 35043: | K:1 |
| 35044: | K:1 |
| 35045: | K:1 |
| 35046: | K:1 |
| 35047: | K:1 |
| 35048: | K:1 |
| 35049: | K:1 |
| 35050: | K:1 |
| 35051: | K:1 |
| 35052: | K:1 |
| 35053: | K:1 |
| 35054: | K:1 |
| 35055: | K:1 |
| 35056: | K:1 |
| 35057: | K:1 |
| 35058: | K:1 |
| 35059: | K:1 |
| 35060: | K:1 |
| 35061: | K:1 |
| 35062: | K:1 |
| 35063: | K:1 |
| 35064: | K:1 |
| 35065: | K:1 |
| 35066: | K:1 |
| 35067: | K:1 |
| 35068: | K:1 |
| 35069: | K:1 |

TABLE II-continued

| SEQ ID NO. | Spatial Distribution |
|---|---|
| 35070: | K:1 |
| 35071: | K:1 |
| 35072: | K:1 |
| 35073: | K:1 |
| 35074: | K:1 |
| 35075: | K:1 |
| 35076: | K:1 |
| 35077: | K:1 |
| 35078: | K:1 |
| 35079: | K:1 |
| 35080: | K:1 |
| 35081: | K:1 |
| 35082: | K:1 |
| 35083: | K:1 |
| 35084: | K:1 |
| 35085: | K:1 |
| 35086: | K:1 |
| 35087: | K:1 |
| 35088: | K:1 |
| 35089: | K:1 |
| 35090: | K:1 |
| 35091: | K:1 |
| 35092: | K:1 |
| 35093: | K:1 |
| 35094: | K:1 |
| 35095: | K:1 |
| 35096: | K:1 |
| 35097: | K:1 |
| 35098: | K:1 |
| 35099: | K:1 |
| 35100: | K:1 |
| 35101: | K:1 |
| 35102: | K:1 |
| 35103: | K:1 |
| 35104: | K:1 |
| 35105: | K:1 |
| 35106: | K:1 |
| 35107: | K:1 |
| 35108: | K:1 |
| 35109: | K:1 |
| 35110: | K:1 |
| 35111: | K:1 |
| 35112: | K:1 |
| 35113: | K:1 |
| 35114: | K:1 |
| 35115: | K:1 |
| 35116: | K:1 |
| 35117: | K:1 |
| 35118: | K:1 |
| 35119: | K:1 |
| 35120: | K:1 |
| 35121: | K:1 |
| 35122: | K:1 |
| 35123: | K:1 |
| 35124: | K:1 |
| 35125: | K:1 |
| 35126: | K:1 |
| 35127: | K:1 |
| 35128: | K:1 |
| 35129: | K:1 |
| 35130: | K:1 |
| 35131: | K:1 |
| 35132: | K:1 |
| 35133: | K:1 |
| 35134: | K:1 |
| 35135: | K:1 |
| 35136: | K:1 |
| 35137: | K:1 |
| 35138: | K:1 |
| 35139: | K:1 |
| 35140: | K:1 |
| 35141: | K:1 |
| 35142: | K:1 |
| 35143: | K:1 |
| 35144: | K:1 |
| 35145: | S:1 |
| 35146: | S:1 |
| 35147: | S:1 |
| 35148: | S:1 |
| 35149: | S:1 |
| 35150: | S:1 |
| 35151: | S:1 |
| 35152: | S:1 |
| 35153: | S:1 |
| 35154: | S:1 |
| 35155: | S:1 |
| 35156: | S:1 |
| 35157: | S:1 |
| 35158: | S:1 |
| 35159: | S:1 |
| 35160: | S:1 |
| 35161: | S:1 |
| 35162: | S:1 |
| 35163: | S:1 |
| 35164: | S:1 |
| 35165: | S:1 |
| 35166: | S:1 |
| 35167: | S:1 |
| 35168: | S:1 |
| 35169: | S:1 |
| 35170: | S:1 |
| 35171: | S:1 |
| 35172: | S:1 |
| 35173: | S:1 |
| 35174: | S:1 |
| 35175: | S:1 |
| 35176: | S:1 |
| 35177: | S:1 |
| 35178: | S:1 |
| 35179: | S:1 |
| 35180: | S:1 |
| 35181: | S:1 |
| 35182: | S:1 |
| 35183: | S:1 |
| 35184: | S:1 |
| 35185: | S:1 |
| 35186: | S:1 |
| 35187: | S:1 |
| 35188: | S:1 |
| 35189: | S:1 |
| 35190: | S:1 |
| 35191: | S:1 |
| 35192: | S:1 |
| 35193: | S:1 |
| 35194: | S:1 |
| 35195: | S:1 |
| 35196: | S:1 |
| 35197: | S:1 |
| 35198: | S:1 |
| 35199: | S:1 |
| 35200: | S:1 |
| 35201: | S:1 |
| 35202: | S:1 |
| 35203: | S:1 |
| 35204: | S:1 |
| 35205: | S:1 |
| 35206: | S:1 |
| 35207: | S:1 |
| 35208: | S:1 |
| 35209: | S:1 |
| 35210: | S:1 |
| 35211: | S:1 |
| 35212: | S:1 |
| 35213: | S:1 |
| 35214: | S:1 |
| 35215: | S:1 |
| 35216: | S:1 |
| 35217: | S:1 |
| 35218: | S:1 |
| 35219: | S:1 |
| 35220: | S:1 |
| 35221: | S:1 |
| 35222: | S:1 |
| 35223: | S:1 |

TABLE II-continued

| SEQ ID NO. | Spatial Distribution |
|---|---|
| 35224: | S:1 |
| 35225: | S:1 |
| 35226: | S:1 |
| 35227: | S:1 |
| 35228: | S:1 |
| 35229: | S:1 |
| 35230: | S:1 |
| 35231: | S:1 |
| 35232: | S:1 |
| 35233: | S:1 |
| 35234: | S:1 |
| 35235: | S:1 |
| 35236: | S:1 |
| 35237: | S:1 |
| 35238: | S:1 |
| 35239: | S:1 |
| 35240: | S:1 |
| 35241: | S:1 |
| 35242: | S:1 |
| 35243: | S:1 |
| 35244: | S:1 |
| 35245: | S:1 |
| 35246: | S:1 |
| 35247: | S:1 |
| 35248: | S:1 |
| 35249: | S:1 |
| 35250: | S:1 |
| 35251: | S:1 |
| 35252: | S:1 |
| 35253: | S:1 |
| 35254: | S:1 |
| 35255: | S:1 |
| 35256: | S:1 |
| 35257: | S:1 |
| 35258: | S:1 |
| 35259: | S:1 |
| 35260: | S:1 |
| 35261: | S:1 |
| 35262: | S:1 |
| 35263: | S:1 |
| 35264: | S:1 |
| 35265: | S:1 |
| 35266: | S:1 |
| 35267: | S:1 |
| 35268: | S:1 |
| 35269: | S:1 |
| 35270: | S:1 |
| 35271: | S:1 |
| 35272: | S:1 |
| 35273: | S:1 |
| 35274: | S:1 |
| 35275: | S:1 |
| 35276: | S:1 |
| 35277: | S:1 |
| 35278: | S:1 |
| 35279: | S:1 |
| 35280: | S:1 |
| 35281: | S:1 |
| 35282: | S:1 |
| 35283: | S:1 |
| 35284: | S:1 |
| 35285: | S:1 |
| 35286: | S:1 |
| 35287: | S:1 |
| 35288: | S:1 |
| 35289: | S:1 |
| 35290: | S:1 |
| 35291: | S:1 |
| 35292: | S:1 |
| 35293: | S:1 |
| 35294: | S:1 |
| 35295: | S:1 |
| 35296: | S:1 |
| 35297: | S:1 |
| 35298: | S:1 |
| 35299: | S:1 |
| 35300: | S:1 |
| 35301: | S:1 |
| 35302: | S:1 |
| 35303: | S:1 |
| 35304: | S:1 |
| 35305: | S:1 |
| 35306: | S:1 |
| 35307: | S:1 |
| 35308: | S:1 |
| 35309: | S:1 |
| 35310: | S:1 |
| 35311: | S:1 |
| 35312: | S:1 |
| 35313: | S:1 |
| 35314: | S:1 |
| 35315: | S:1 |
| 35316: | S:1 |
| 35317: | S:1 |
| 35318: | S:1 |
| 35319: | S:1 |
| 35320: | S:1 |
| 35321: | S:1 |
| 35322: | S:1 |
| 35323: | S:1 |
| 35324: | S:1 |
| 35325: | S:1 |
| 35326: | S:1 |
| 35327: | S:1 |
| 35328: | S:1 |
| 35329: | S:1 |
| 35330: | S:1 |
| 35331: | S:1 |
| 35332: | S:1 |
| 35333: | S:1 |
| 35334: | S:1 |
| 35335: | S:1 |
| 35336: | S:1 |
| 35337: | S:1 |
| 35338: | S:1 |
| 35339: | S:1 |
| 35340: | S:1 |
| 35341: | S:1 |
| 35342: | S:1 |
| 35343: | S:1 |
| 35344: | S:1 |
| 35345: | S:1 |
| 35346: | S:1 |
| 35347: | S:1 |
| 35348: | S:1 |
| 35349: | S:1 |
| 35350: | S:1 |
| 35351: | S:1 |
| 35352: | S:1 |
| 35353: | S:1 |
| 35354: | S:1 |
| 35355: | S:1 |
| 35356: | S:1 |
| 35357: | S:1 |
| 35358: | S:1 |
| 35359: | S:1 |
| 35360: | S:1 |
| 35361: | S:1 |
| 35362: | S:1 |
| 35363: | S:1 |
| 35364: | S:1 |
| 35365: | S:1 |
| 35366: | S:1 |
| 35367: | S:1 |
| 35368: | S:1 |
| 35369: | S:1 |
| 35370: | S:1 |
| 35371: | S:1 |
| 35372: | S:1 |
| 35373: | S:1 |
| 35374: | S:1 |
| 35375: | S:1 |
| 35376: | S:1 |
| 35377: | S:1 |

TABLE II-continued

| SEQ ID NO. | Spatial Distribution |
|---|---|
| 35378: | S:1 |
| 35379: | S:1 |
| 35380: | S:1 |
| 35381: | S:1 |
| 35382: | S:1 |
| 35383: | S:1 |
| 35384: | S:1 |
| 35385: | S:1 |
| 35386: | S:1 |
| 35387: | S:1 |
| 35388: | S:1 |
| 35389: | S:1 |
| 35390: | S:1 |
| 35391: | S:1 |
| 35392: | S:1 |
| 35393: | S:1 |
| 35394: | S:1 |
| 35395: | S:1 |
| 35396: | S:1 |
| 35397: | S:1 |
| 35398: | S:1 |
| 35399: | S:1 |
| 35400: | S:1 |
| 35401: | S:1 |
| 35402: | S:1 |
| 35403: | S:1 |
| 35404: | S:1 |
| 35405: | S:1 |
| 35406: | S:1 |
| 35407: | S:1 |
| 35408: | S:1 |
| 35409: | S:1 |
| 35410: | S:1 |
| 35411: | S:1 |
| 35412: | S:1 |
| 35413: | S:1 |
| 35414: | S:1 |
| 35415: | S:1 |
| 35416: | S:1 |
| 35417: | S:1 |
| 35418: | S:1 |
| 35419: | S:1 |
| 35420: | S:1 |
| 35421: | S:1 |
| 35422: | S:1 |
| 35423: | S:1 |
| 35424: | S:1 |
| 35425: | S:1 |
| 35426: | S:1 |
| 35427: | S:1 |
| 35428: | S:1 |
| 35429: | S:1 |
| 35430: | S:1 |
| 35431: | S:1 |
| 35432: | S:1 |
| 35433: | S:1 |
| 35434: | S:1 |
| 35435: | S:1 |
| 35436: | S:1 |
| 35437: | S:1 |
| 35438: | S:1 |
| 35439: | S:1 |
| 35440: | S:1 |
| 35441: | S:1 |
| 35442: | S:1 |
| 35443: | S:1 |
| 35444: | S:1 |
| 35445: | S:1 |
| 35446: | S:1 |
| 35447: | S:1 |
| 35448: | S:1 |
| 35449: | S:1 |
| 35450: | S:1 |
| 35451: | S:1 |
| 35452: | S:1 |
| 35453: | S:1 |
| 35454: | S:1 |
| 35455: | S:1 |
| 35456: | S:1 |
| 35457: | S:1 |
| 35458: | S:1 |
| 35459: | S:1 |
| 35460: | S:1 |
| 35461: | S:1 |
| 35462: | S:1 |
| 35463: | S:1 |
| 35464: | S:1 |
| 35465: | S:1 |
| 35466: | S:1 |
| 35467: | S:1 |
| 35468: | S:1 |
| 35469: | S:1 |
| 35470: | S:1 |
| 35471: | S:1 |
| 35472: | S:1 |
| 35473: | S:1 |
| 35474: | S:1 |
| 35475: | S:1 |
| 35476: | S:1 |
| 35477: | S:1 |
| 35478: | S:1 |
| 35479: | S:1 |
| 35480: | S:1 |
| 35481: | S:1 |
| 35482: | S:1 |
| 35483: | S:1 |
| 35484: | S:1 |
| 35485: | S:1 |
| 35486: | S:1 |
| 35487: | S:1 |
| 35488: | S:1 |
| 35489: | S:1 |
| 35490: | S:1 |
| 35491: | S:1 |
| 35492: | S:1 |
| 35493: | S:1 |
| 35494: | S:1 |
| 35495: | S:1 |
| 35496: | S:1 |
| 35497: | S:1 |
| 35498: | S:1 |
| 35499: | S:1 |
| 35500: | S:1 |
| 35501: | S:1 |
| 35502: | S:1 |
| 35503: | S:1 |
| 35504: | S:1 |
| 35505: | S:1 |
| 35506: | S:1 |
| 35507: | S:1 |
| 35508: | S:1 |
| 35509: | S:1 |
| 35510: | S:1 |
| 35511: | S:1 |
| 35512: | S:1 |
| 35513: | S:1 |
| 35514: | S:1 |
| 35515: | S:1 |
| 35516: | S:1 |
| 35517: | S:1 |
| 35518: | S:1 |
| 35519: | S:1 |
| 35520: | S:1 |
| 35521: | S:1 |
| 35522: | S:1 |
| 35523: | S:1 |
| 35524: | S:1 |
| 35525: | S:1 |
| 35526: | S:1 |
| 35527: | S:1 |
| 35528: | S:1 |
| 35529: | S:1 |
| 35530: | S:1 |
| 35531: | S:1 |

TABLE II-continued

| SEQ ID NO. | Spatial Distribution |
|---|---|
| 35532: | S:1 |
| 35533: | S:1 |
| 35534: | S:1 |
| 35535: | S:1 |
| 35536: | S:1 |
| 35537: | S:1 |
| 35538: | S:1 |
| 35539: | S:1 |
| 35540: | S:1 |
| 35541: | S:1 |
| 35542: | S:1 |
| 35543: | S:1 |
| 35544: | S:1 |
| 35545: | S:1 |
| 35546: | S:1 |
| 35547: | S:1 |
| 35548: | S:1 |
| 35549: | S:1 |
| 35550: | S:1 |
| 35551: | S:1 |
| 35552: | S:1 |
| 35553: | S:1 |
| 35554: | S:1 |
| 35555: | S:1 |
| 35556: | S:1 |
| 35557: | S:1 |
| 35558: | S:1 |
| 35559: | S:1 |
| 35560: | S:1 |
| 35561: | S:1 |
| 35562: | S:1 |
| 35563: | S:1 |
| 35564: | S:1 |
| 35565: | S:1 |
| 35566: | S:1 |
| 35567: | S:1 |
| 35568: | S:1 |
| 35569: | S:1 |
| 35570: | S:1 |
| 35571: | S:1 |
| 35572: | S:1 |
| 35573: | S:1 |
| 35574: | S:1 |
| 35575: | S:1 |
| 35576: | S:1 |
| 35577: | S:1 |
| 35578: | S:1 |
| 35579: | S:1 |
| 35580: | S:1 |
| 35581: | S:1 |
| 35582: | S:1 |
| 35583: | S:1 |
| 35584: | S:1 |
| 35585: | S:1 |
| 35586: | S:1 |
| 35587: | S:1 |
| 35588: | S:1 |
| 35589: | S:1 |
| 35590: | S:1 |
| 35591: | S:1 |
| 35592: | S:1 |
| 35593: | S:1 |
| 35594: | S:1 |
| 35595: | S:1 |
| 35596: | S:1 |
| 35597: | S:1 |
| 35598: | S:1 |
| 35599: | S:1 |
| 35600: | S:1 |
| 35601: | S:1 |
| 35602: | S:1 |
| 35603: | S:1 |
| 35604: | S:1 |
| 35605: | S:1 |
| 35606: | S:1 |
| 35607: | S:1 |
| 35608: | S:1 |
| 35609: | S:1 |
| 35610: | S:1 |
| 35611: | S:1 |
| 35612: | S:1 |
| 35613: | S:1 |
| 35614: | S:1 |
| 35615: | S:1 |
| 35616: | S:1 |
| 35617: | S:1 |
| 35618: | S:1 |
| 35619: | S:1 |
| 35620: | S:1 |
| 35621: | S:1 |
| 35622: | S:1 |
| 35623: | S:1 |
| 35624: | S:1 |
| 35625: | S:1 |
| 35626: | S:1 |
| 35627: | S:1 |
| 35628: | S:1 |
| 35629: | S:1 |
| 35630: | S:1 |
| 35631: | S:1 |
| 35632: | S:1 |
| 35633: | S:1 |
| 35634: | S:1 |
| 35635: | S:1 |
| 35636: | S:1 |
| 35637: | S:1 |
| 35638: | S:1 |
| 35639: | S:1 |
| 35640: | S:1 |
| 35641: | S:1 |
| 35642: | S:1 |
| 35643: | S:1 |
| 35644: | S:1 |
| 35645: | S:1 |
| 35646: | S:1 |
| 35647: | S:1 |
| 35648: | S:1 |
| 35649: | S:1 |
| 35650: | S:1 |
| 35651: | S:1 |
| 35652: | S:1 |
| 35653: | S:1 |
| 35654: | S:1 |
| 35655: | S:1 |
| 35656: | S:1 |
| 35657: | S:1 |
| 35658: | S:1 |
| 35659: | S:1 |
| 35660: | S:1 |
| 35661: | S:1 |
| 35662: | S:1 |
| 35663: | S:1 |
| 35664: | S:1 |
| 35665: | S:1 |
| 35666: | S:1 |
| 35667: | S:1 |
| 35668: | S:1 |
| 35669: | S:1 |
| 35670: | S:1 |
| 35671: | S:1 |
| 35672: | S:1 |
| 35673: | S:1 |
| 35674: | S:1 |
| 35675: | S:1 |
| 35676: | S:1 |
| 35677: | S:1 |
| 35678: | S:1 |
| 35679: | S:1 |
| 35680: | S:1 |
| 35681: | S:1 |
| 35682: | S:1 |
| 35683: | S:1 |
| 35684: | S:1 |
| 35685: | S:1 |

TABLE II-continued

| SEQ ID NO. | Spatial Distribution |
|---|---|
| 35686: | S:1 |
| 35687: | S:1 |
| 35688: | S:1 |
| 35689: | S:1 |
| 35690: | S:1 |
| 35691: | S:1 |
| 35692: | S:1 |
| 35693: | S:1 |
| 35694: | S:1 |
| 35695: | S:1 |
| 35696: | S:1 |
| 35697: | S:1 |
| 35698: | S:1 |
| 35699: | S:1 |
| 35700: | S:1 |
| 35701: | S:1 |
| 35702: | S:1 |
| 35703: | S:1 |
| 35704: | S:1 |
| 35705: | S:1 |
| 35706: | S:1 |
| 35707: | S:1 |
| 35708: | S:1 |
| 35709: | S:1 |
| 35710: | S:1 |
| 35711: | S:1 |
| 35712: | S:1 |
| 35713: | S:1 |
| 35714: | S:1 |
| 35715: | S:1 |
| 35716: | S:1 |
| 35717: | S:1 |
| 35718: | S:1 |
| 35719: | S:1 |
| 35720: | S:1 |
| 35721: | S:1 |
| 35722: | S:1 |
| 35723: | S:1 |
| 35724: | S:1 |
| 35725: | S:1 |
| 35726: | S:1 |
| 35727: | S:1 |
| 35728: | S:1 |
| 35729: | S:1 |
| 35730: | S:1 |
| 35731: | S:1 |
| 35732: | S:1 |
| 35733: | S:1 |
| 35734: | S:1 |
| 35735: | S:1 |
| 35736: | S:1 |
| 35737: | S:1 |
| 35738: | S:1 |
| 35739: | S:1 |
| 35740: | S:1 |
| 35741: | S:1 |
| 35742: | S:1 |
| 35743: | S:1 |
| 35744: | S:1 |
| 35745: | S:1 |
| 35746: | S:1 |
| 35747: | S:1 |
| 35748: | S:1 |
| 35749: | S:1 |
| 35750: | S:1 |
| 35751: | S:1 |
| 35752: | S:1 |
| 35753: | S:1 |
| 35754: | S:1 |
| 35755: | S:1 |
| 35756: | S:1 |
| 35757: | S:1 |
| 35758: | S:1 |
| 35759: | S:1 |
| 35760: | S:1 |
| 35761: | S:1 |
| 35762: | S:1 |
| 35763: | S:1 |
| 35764: | S:1 |
| 35765: | S:1 |
| 35766: | S:1 |
| 35767: | S:1 |
| 35768: | S:1 |
| 35769: | S:1 |
| 35770: | S:1 |
| 35771: | S:1 |
| 35772: | S:1 |
| 35773: | S:1 |
| 35774: | S:1 |
| 35775: | S:1 |
| 35776: | S:1 |
| 35777: | S:1 |
| 35778: | S:1 |
| 35779: | S:1 |
| 35780: | S:1 |
| 35781: | S:1 |
| 35782: | S:1 |
| 35783: | S:1 |
| 35784: | S:1 |
| 35785: | S:1 |
| 35786: | S:1 |
| 35787: | S:1 |
| 35788: | S:1 |
| 35789: | S:1 |
| 35790: | S:1 |
| 35791: | S:1 |
| 35792: | S:1 |
| 35793: | S:1 |
| 35794: | S:1 |
| 35795: | S:1 |
| 35796: | S:1 |
| 35797: | S:1 |
| 35798: | S:1 |
| 35799: | S:1 |
| 35800: | S:1 |
| 35801: | S:1 |
| 35802: | S:1 |
| 35803: | S:1 |
| 35804: | S:1 |
| 35805: | S:1 |
| 35806: | S:1 |
| 35807: | S:1 |
| 35808: | S:1 |
| 35809: | S:1 |
| 35810: | S:1 |
| 35811: | S:1 |
| 35812: | S:1 |
| 35813: | S:1 |
| 35814: | S:1 |
| 35815: | S:1 |
| 35816: | S:1 |
| 35817: | S:1 |
| 35818: | S:1 |
| 35819: | S:1 |
| 35820: | S:1 |
| 35821: | S:1 |
| 35822: | S:1 |
| 35823: | S:1 |
| 35824: | S:1 |
| 35825: | S:1 |
| 35826: | S:1 |
| 35827: | S:1 |
| 35828: | S:1 |
| 35829: | S:1 |
| 35830: | S:1 |
| 35831: | S:1 |
| 35832: | S:1 |
| 35833: | S:1 |
| 35834: | S:1 |
| 35835: | S:1 |
| 35836: | S:1 |
| 35837: | S:1 |
| 35838: | S:1 |
| 35839: | S:1 |

TABLE II-continued

| SEQ ID NO. | Spatial Distribution |
|---|---|
| 35840: | S:1 |
| 35841: | S:1 |
| 35842: | S:1 |
| 35843: | S:1 |
| 35844: | S:1 |
| 35845: | S:1 |
| 35846: | S:1 |
| 35847: | S:1 |
| 35848: | S:1 |
| 35849: | S:1 |
| 35850: | S:1 |
| 35851: | S:1 |
| 35852: | S:1 |
| 35853: | S:1 |
| 35854: | S:1 |
| 35855: | S:1 |
| 35856: | S:1 |
| 35857: | S:1 |
| 35858: | S:1 |
| 35859: | S:1 |
| 35860: | S:1 |
| 35861: | S:1 |
| 35862: | S:1 |
| 35863: | S:1 |
| 35864: | S:1 |
| 35865: | S:1 |
| 35866: | S:1 |
| 35867: | S:1 |
| 35868: | S:1 |
| 35869: | S:1 |
| 35870: | S:1 |
| 35871: | S:1 |
| 35872: | S:1 |
| 35873: | S:1 |
| 35874: | S:1 |
| 35875: | S:1 |
| 35876: | S:1 |
| 35877: | S:1 |
| 35878: | S:1 |
| 35879: | S:1 |
| 35880: | S:1 |
| 35881: | S:1 |
| 35882: | S:1 |
| 35883: | S:1 |
| 35884: | S:1 |
| 35885: | S:1 |
| 35886: | S:1 |
| 35887: | S:1 |
| 35888: | S:1 |
| 35889: | S:1 |
| 35890: | S:1 |
| 35891: | S:1 |
| 35892: | S:1 |
| 35893: | S:1 |
| 35894: | S:1 |
| 35895: | S:1 |
| 35896: | S:1 |
| 35897: | S:1 |
| 35898: | S:1 |
| 35899: | S:1 |
| 35900: | S:1 |
| 35901: | S:1 |
| 35902: | S:1 |
| 35903: | S:1 |
| 35904: | S:1 |
| 35905: | S:1 |
| 35906: | S:1 |
| 35907: | S:1 |
| 35908: | S:1 |
| 35909: | S:1 |
| 35910: | S:1 |
| 35911: | S:1 |
| 35912: | S:1 |
| 35913: | S:1 |
| 35914: | S:1 |
| 35915: | S:1 |
| 35916: | S:1 |
| 35917: | S:1 |
| 35918: | AB:1 |
| 35919: | AB:1 |
| 35920: | AB:1 |
| 35921: | AB:1 |
| 35922: | AB:1 |
| 35923: | AB:1 |
| 35924: | AB:1 |
| 35925: | AB:1 |
| 35926: | W:1 |
| 35927: | W:1 |
| 35928: | W:1 |
| 35929: | W:1 |
| 35930: | W:1 |
| 35931: | W:1 |
| 35932: | W:1 |
| 35933: | W:1 |
| 35934: | W:1 |
| 35935: | W:1 |
| 35936: | W:1 |
| 35937: | W:1 |
| 35938: | W:1 |
| 35939: | W:1 |
| 35940: | W:1 |
| 35941: | W:1 |
| 35942: | W:1 |
| 35943: | W:1 |
| 35944: | W:1 |
| 35945: | W:1 |
| 35946: | W:1 |
| 35947: | W:1 |
| 35948: | W:1 |
| 35949: | W:1 |
| 35950: | W:1 |
| 35951: | W:1 |
| 35952: | W:1 |
| 35953: | W:1 |
| 35954: | W:1 |
| 35955: | W:1 |
| 35956: | W:1 |
| 35957: | W:1 |
| 35958: | W:1 |
| 35959: | W:1 |
| 35960: | W:1 |
| 35961: | W:1 |
| 35962: | W:1 |
| 35963: | W:1 |
| 35964: | W:1 |
| 35965: | W:1 |
| 35966: | W:1 |
| 35967: | W:1 |
| 35968: | W:1 |
| 35969: | W:1 |
| 35970: | W:1 |
| 35971: | W:1 |
| 35972: | W:1 |
| 35973: | W:1 |
| 35974: | W:1 |
| 35975: | W:1 |
| 35976: | W:1 |
| 35977: | W:1 |
| 35978: | W:1 |
| 35979: | W:1 |
| 35980: | W:1 |
| 35981: | W:1 |
| 35982: | W:1 |
| 35983: | W:1 |
| 35984: | W:1 |
| 35985: | W:1 |
| 35986: | W:1 |
| 35987: | W:1 |
| 35988: | W:1 |
| 35989: | W:1 |
| 35990: | W:1 |
| 35991: | W:1 |
| 35992: | W:1 |
| 35993: | W:1 |

TABLE II-continued

| SEQ ID NO. | Spatial Distribution |
|---|---|
| 35994: | W:1 |
| 35995: | W:1 |
| 35996: | W:1 |
| 35997: | W:1 |
| 35998: | W:1 |
| 35999: | W:1 |
| 36000: | W:1 |
| 36001: | W:1 |
| 36002: | W:1 |
| 36003: | W:1 |
| 36004: | W:1 |
| 36005: | W:1 |
| 36006: | W:1 |
| 36007: | W:1 |
| 36008: | W:1 |
| 36009: | W:1 |
| 36010: | W:1 |
| 36011: | W:1 |
| 36012: | W:1 |
| 36013: | W:1 |
| 36014: | W:1 |
| 36015: | W:1 |
| 36016: | W:1 |
| 36017: | W:1 |
| 36018: | W:1 |
| 36019: | W:1 |
| 36020: | W:1 |
| 36021: | W:1 |
| 36022: | W:1 |
| 36023: | W:1 |
| 36024: | W:1 |
| 36025: | W:1 |
| 36026: | W:1 |
| 36027: | W:1 |
| 36028: | W:1 |
| 36029: | W:1 |
| 36030: | W:1 |
| 36031: | W:1 |
| 36032: | W:1 |
| 36033: | W:1 |
| 36034: | W:1 |
| 36035: | W:1 |
| 36036: | W:1 |
| 36037: | W:1 |
| 36038: | W:1 |
| 36039: | W:1 |
| 36040: | W:1 |
| 36041: | W:1 |
| 36042: | W:1 |
| 36043: | W:1 |
| 36044: | W:1 |
| 36045: | W:1 |
| 36046: | W:1 |
| 36047: | W:1 |
| 36048: | W:1 |
| 36049: | W:1 |
| 36050: | W:1 |
| 36051: | W:1 |
| 36052: | W:1 |
| 36053: | W:1 |
| 36054: | W:1 |
| 36055: | W:1 |
| 36056: | W:1 |
| 36057: | W:1 |
| 36058: | W:1 |
| 36059: | W:1 |
| 36060: | W:1 |
| 36061: | W:1 |
| 36062: | W:1 |
| 36063: | W:1 |
| 36064: | W:1 |
| 36065: | W:1 |
| 36066: | W:1 |
| 36067: | W:1 |
| 36068: | W:1 |
| 36069: | W:1 |
| 36070: | W:1 |
| 36071: | W:1 |
| 36072: | W:1 |
| 36073: | W:1 |
| 36074: | W:1 |
| 36075: | W:1 |
| 36076: | W:1 |
| 36077: | W:1 |
| 36078: | W:1 |
| 36079: | W:1 |
| 36080: | W:1 |
| 36081: | W:1 |
| 36082: | W:1 |
| 36083: | W:1 |
| 36084: | W:1 |
| 36085: | W:1 |
| 36086: | W:1 |
| 36087: | W:1 |
| 36088: | W:1 |
| 36089: | W:1 |
| 36090: | W:1 |
| 36091: | W:1 |
| 36092: | W:1 |
| 36093: | W:1 |
| 36094: | W:1 |
| 36095: | W:1 |
| 36096: | W:1 |
| 36097: | W:1 |
| 36098: | W:1 |
| 36099: | W:1 |
| 36100: | W:1 |
| 36101: | W:1 |
| 36102: | W:1 |
| 36103: | W:1 |
| 36104: | W:1 |
| 36105: | W:1 |
| 36106: | W:1 |
| 36107: | W:1 |
| 36108: | W:1 |
| 36109: | W:1 |
| 36110: | W:1 |
| 36111: | W:1 |
| 36112: | W:1 |
| 36113: | W:1 |
| 36114: | W:1 |
| 36115: | W:1 |
| 36116: | W:1 |
| 36117: | W:1 |
| 36118: | W:1 |
| 36119: | W:1 |
| 36120: | W:1 |
| 36121: | W:1 |
| 36122: | W:1 |
| 36123: | W:1 |
| 36124: | W:1 |
| 36125: | W:1 |
| 36126: | W:1 |
| 36127: | W:1 |
| 36128: | W:1 |
| 36129: | W:1 |
| 36130: | W:1 |
| 36131: | W:1 |
| 36132: | W:1 |
| 36133: | W:1 |
| 36134: | W:1 |
| 36135: | W:1 |
| 36136: | W:1 |
| 36137: | W:1 |
| 36138: | W:1 |
| 36139: | W:1 |
| 36140: | W:1 |
| 36141: | W:1 |
| 36142: | W:1 |
| 36143: | W:1 |
| 36144: | W:1 |
| 36145: | W:1 |
| 36146: | W:1 |
| 36147: | W:1 |

TABLE II-continued

| SEQ ID NO. | Spatial Distribution |
|---|---|
| 36148: | W:1 |
| 36149: | W:1 |
| 36150: | W:1 |
| 36151: | W:1 |
| 36152: | W:1 |
| 36153: | W:1 |
| 36154: | W:1 |
| 36155: | W:1 |
| 36156: | W:1 |
| 36157: | W:1 |
| 36158: | W:1 |
| 36159: | W:1 |
| 36160: | W:1 |
| 36161: | W:1 |
| 36162: | W:1 |
| 36163: | W:1 |
| 36164: | W:1 |
| 36165: | W:1 |
| 36166: | W:1 |
| 36167: | W:1 |
| 36168: | W:1 |
| 36169: | W:1 |
| 36170: | W:1 |
| 36171: | W:1 |
| 36172: | W:1 |
| 36173: | W:1 |
| 36174: | W:1 |
| 36175: | W:1 |
| 36176: | W:1 |
| 36177: | W:1 |
| 36178: | W:1 |
| 36179: | W:1 |
| 36180: | W:1 |
| 36181: | W:1 |
| 36182: | W:1 |
| 36183: | W:1 |
| 36184: | W:1 |
| 36185: | W:1 |
| 36186: | W:1 |
| 36187: | W:1 |
| 36188: | W:1 |
| 36189: | W:1 |
| 36190: | W:1 |
| 36191: | W:1 |
| 36192: | W:1 |
| 36193: | W:1 |
| 36194: | W:1 |
| 36195: | W:1 |
| 36196: | W:1 |
| 36197: | W:1 |
| 36198: | W:1 |
| 36199: | W:1 |
| 36200: | W:1 |
| 36201: | W:1 |
| 36202: | W:1 |
| 36203: | W:1 |
| 36204: | W:1 |
| 36205: | W:1 |
| 36206: | W:1 |
| 36207: | W:1 |
| 36208: | W:1 |
| 36209: | W:1 |
| 36210: | W:1 |
| 36211: | W:1 |
| 36212: | W:1 |
| 36213: | W:1 |
| 36214: | W:1 |
| 36215: | W:1 |
| 36216: | W:1 |
| 36217: | W:1 |
| 36218: | W:1 |
| 36219: | W:1 |
| 36220: | W:1 |
| 36221: | W:1 |
| 36222: | W:1 |
| 36223: | W:1 |
| 36224: | W:1 |
| 36225: | W:1 |
| 36226: | W:1 |
| 36227: | W:1 |
| 36228: | W:1 |
| 36229: | W:1 |
| 36230: | W:1 |
| 36231: | W:1 |
| 36232: | W:1 |
| 36233: | W:1 |
| 36234: | W:1 |
| 36235: | W:1 |
| 36236: | W:1 |
| 36237: | W:1 |
| 36238: | W:1 |
| 36239: | W:1 |
| 36240: | W:1 |
| 36241: | W:1 |
| 36242: | W:1 |
| 36243: | W:1 |
| 36244: | W:1 |
| 36245: | W:1 |
| 36246: | W:1 |
| 36247: | W:1 |
| 36248: | W:1 |
| 36249: | W:1 |
| 36250: | W:1 |
| 36251: | W:1 |
| 36252: | W:1 |
| 36253: | W:1 |
| 36254: | W:1 |
| 36255: | W:1 |
| 36256: | W:1 |
| 36257: | W:1 |
| 36258: | W:1 |
| 36259: | W:1 |
| 36260: | W:1 |
| 36261: | W:1 |
| 36262: | W:1 |
| 36263: | W:1 |
| 36264: | W:1 |
| 36265: | W:1 |
| 36266: | W:1 |
| 36267: | W:1 |
| 36268: | W:1 |
| 36269: | W:1 |
| 36270: | W:1 |
| 36271: | W:1 |
| 36272: | W:1 |
| 36273: | W:1 |
| 36274: | W:1 |
| 36275: | W:1 |
| 36276: | W:1 |
| 36277: | W:1 |
| 36278: | W:1 |
| 36279: | W:1 |
| 36280: | W:1 |
| 36281: | W:1 |
| 36282: | W:1 |
| 36283: | W:1 |
| 36284: | W:1 |
| 36285: | W:1 |
| 36286: | W:1 |
| 36287: | W:1 |
| 36288: | W:1 |
| 36289: | W:1 |
| 36290: | W:1 |
| 36291: | W:1 |
| 36292: | W:1 |
| 36293: | W:1 |
| 36294: | W:1 |
| 36295: | W:1 |
| 36296: | W:1 |
| 36297: | W:1 |
| 36298: | W:1 |
| 36299: | W:1 |
| 36300: | W:1 |
| 36301: | W:1 |

TABLE II-continued

| SEQ ID NO. | Spatial Distribution |
|---|---|
| 36302: | W:1 |
| 36303: | W:1 |
| 36304: | W:1 |
| 36305: | W:1 |
| 36306: | W:1 |
| 36307: | W:1 |
| 36308: | W:1 |
| 36309: | W:1 |
| 36310: | W:1 |
| 36311: | W:1 |
| 36312: | W:1 |
| 36313: | W:1 |
| 36314: | W:1 |
| 36315: | W:1 |
| 36316: | W:1 |
| 36317: | W:1 |
| 36318: | W:1 |
| 36319: | W:1 |
| 36320: | W:1 |
| 36321: | W:1 |
| 36322: | W:1 |
| 36323: | W:1 |
| 36324: | W:1 |
| 36325: | W:1 |
| 36326: | W:1 |
| 36327: | W:1 |
| 36328: | W:1 |
| 36329: | W:1 |
| 36330: | W:1 |
| 36331: | W:1 |
| 36332: | W:1 |
| 36333: | W:1 |
| 36334: | W:1 |
| 36335: | W:1 |
| 36336: | W:1 |
| 36337: | W:1 |
| 36338: | W:1 |
| 36339: | W:1 |
| 36340: | W:1 |
| 36341: | W:1 |
| 36342: | W:1 |
| 36343: | W:1 |
| 36344: | W:1 |
| 36345: | W:1 |
| 36346: | W:1 |
| 36347: | W:1 |
| 36348: | W:1 |
| 36349: | W:1 |
| 36350: | W:1 |
| 36351: | W:1 |
| 36352: | W:1 |
| 36353: | W:1 |
| 36354: | W:1 |
| 36355: | W:1 |
| 36356: | W:1 |
| 36357: | W:1 |
| 36358: | W:1 |
| 36359: | W:1 |
| 36360: | W:1 |
| 36361: | W:1 |
| 36362: | W:1 |
| 36363: | W:1 |
| 36364: | W:1 |
| 36365: | W:1 |
| 36366: | W:1 |
| 36367: | W:1 |
| 36368: | W:1 |
| 36369: | W:1 |
| 36370: | W:1 |
| 36371: | W:1 |
| 36372: | W:1 |
| 36373: | W:1 |
| 36374: | W:1 |
| 36375: | W:1 |
| 36376: | W:1 |
| 36377: | W:1 |
| 36378: | W:1 |
| 36379: | W:1 |
| 36380: | W:1 |
| 36381: | W:1 |
| 36382: | W:1 |
| 36383: | W:1 |
| 36384: | W:1 |
| 36385: | W:1 |
| 36386: | W:1 |
| 36387: | W:1 |
| 36388: | W:1 |
| 36389: | W:1 |
| 36390: | W:1 |
| 36391: | W:1 |
| 36392: | W:1 |
| 36393: | W:1 |
| 36394: | W:1 |
| 36395: | W:1 |
| 36396: | W:1 |
| 36397: | W:1 |
| 36398: | W:1 |
| 36399: | W:1 |
| 36400: | W:1 |
| 36401: | W:1 |
| 36402: | W:1 |
| 36403: | W:1 |
| 36404: | W:1 |
| 36405: | W:1 |
| 36406: | W:1 |
| 36407: | W:1 |
| 36408: | W:1 |
| 36409: | W:1 |
| 36410: | W:1 |
| 36411: | W:1 |
| 36412: | W:1 |
| 36413: | W:1 |
| 36414: | W:1 |
| 36415: | W:1 |
| 36416: | W:1 |
| 36417: | W:1 |
| 36418: | W:1 |
| 36419: | W:1 |
| 36420: | W:1 |
| 36421: | W:1 |
| 36422: | W:1 |
| 36423: | W:1 |
| 36424: | W:1 |
| 36425: | W:1 |
| 36426: | W:1 |
| 36427: | W:1 |
| 36428: | W:1 |
| 36429: | W:1 |
| 36430: | W:1 |
| 36431: | W:1 |
| 36432: | W:1 |
| 36433: | W:1 |
| 36434: | W:1 |
| 36435: | W:1 |
| 36436: | W:1 |
| 36437: | W:1 |
| 36438: | W:1 |
| 36439: | W:1 |
| 36440: | W:1 |
| 36441: | W:1 |
| 36442: | W:1 |
| 36443: | W:1 |
| 36444: | W:1 |
| 36445: | W:1 |
| 36446: | W:1 |
| 36447: | W:1 |
| 36448: | W:1 |
| 36449: | W:1 |
| 36450: | W:1 |
| 36451: | W:1 |
| 36452: | W:1 |
| 36453: | W:1 |
| 36454: | W:1 |
| 36455: | W:1 |

TABLE II-continued

| SEQ ID NO. | Spatial Distribution |
|---|---|
| 36456: | W:1 |
| 36457: | W:1 |
| 36458: | W:1 |
| 36459: | W:1 |
| 36460: | W:1 |
| 36461: | W:1 |
| 36462: | W:1 |
| 36463: | W:1 |
| 36464: | W:1 |
| 36465: | W:1 |
| 36466: | W:1 |
| 36467: | W:1 |
| 36468: | W:1 |
| 36469: | W:1 |
| 36470: | W:1 |
| 36471: | W:1 |
| 36472: | W:1 |
| 36473: | W:1 |
| 36474: | W:1 |
| 36475: | W:1 |
| 36476: | W:1 |
| 36477: | W:1 |
| 36478: | W:1 |
| 36479: | W:1 |
| 36480: | W:1 |
| 36481: | W:1 |
| 36482: | W:1 |
| 36483: | W:1 |
| 36484: | W:1 |
| 36485: | W:1 |
| 36486: | W:1 |
| 36487: | W:1 |
| 36488: | W:1 |
| 36489: | W:1 |
| 36490: | W:1 |
| 36491: | W:1 |
| 36492: | W:1 |
| 36493: | W:1 |
| 36494: | W:1 |
| 36495: | W:1 |
| 36496: | W:1 |
| 36497: | W:1 |
| 36498: | W:1 |
| 36499: | W:1 |
| 36500: | W:1 |
| 36501: | W:1 |
| 36502: | W:1 |
| 36503: | W:1 |
| 36504: | W:1 |
| 36505: | W:1 |
| 36506: | W:1 |
| 36507: | W:1 |
| 36508: | W:1 |
| 36509: | W:1 |
| 36510: | W:1 |
| 36511: | W:1 |
| 36512: | W:1 |
| 36513: | W:1 |
| 36514: | W:1 |
| 36515: | W:1 |
| 36516: | W:1 |
| 36517: | W:1 |
| 36518: | W:1 |
| 36519: | W:1 |
| 36520: | W:1 |
| 36521: | W:1 |
| 36522: | W:1 |
| 36523: | W:1 |
| 36524: | W:1 |
| 36525: | W:1 |
| 36526: | W:1 |
| 36527: | W:1 |
| 36528: | W:1 |
| 36529: | W:1 |
| 36530: | W:1 |
| 36531: | W:1 |
| 36532: | W:1 |
| 36533: | W:1 |
| 36534: | W:1 |
| 36535: | W:1 |
| 36536: | W:1 |
| 36537: | W:1 |
| 36538: | W:1 |
| 36539: | W:1 |
| 36540: | W:1 |
| 36541: | W:1 |
| 36542: | W:1 |
| 36543: | W:1 |
| 36544: | W:1 |
| 36545: | W:1 |
| 36546: | W:1 |
| 36547: | W:1 |
| 36548: | W:1 |
| 36549: | W:1 |
| 36550: | W:1 |
| 36551: | W:1 |
| 36552: | W:1 |
| 36553: | W:1 |
| 36554: | W:1 |
| 36555: | W:1 |
| 36556: | W:1 |
| 36557: | W:1 |
| 36558: | W:1 |
| 36559: | W:1 |
| 36560: | W:1 |
| 36561: | W:1 |
| 36562: | W:1 |
| 36563: | W:1 |
| 36564: | W:1 |
| 36565: | W:1 |
| 36566: | W:1 |
| 36567: | W:1 |
| 36568: | W:1 |
| 36569: | W:1 |
| 36570: | W:1 |
| 36571: | W:1 |
| 36572: | W:1 |
| 36573: | W:1 |
| 36574: | W:1 |
| 36575: | W:1 |
| 36576: | W:1 |
| 36577: | W:1 |
| 36578: | W:1 |
| 36579: | W:1 |
| 36580: | W:1 |
| 36581: | W:1 |
| 36582: | W:1 |
| 36583: | W:1 |
| 36584: | W:1 |
| 36585: | W:1 |
| 36586: | W:1 |
| 36587: | W:1 |
| 36588: | W:1 |
| 36589: | W:1 |
| 36590: | W:1 |
| 36591: | W:1 |
| 36592: | W:1 |
| 36593: | W:1 |
| 36594: | W:1 |
| 36595: | W:1 |

TABLE II-continued

| SEQ ID NO. | Spatial Distribution |
|---|---|
| 36596: | W:1 |
| 36597: | W:1 |
| 36598: | W:1 |
| 36599: | W:1 |
| 36600: | W:1 |
| 36601: | W:1 |
| 36602: | W:1 |
| 36603: | W:1 |
| 36604: | W:1 |
| 36605: | W:1 |
| 36606: | W:1 |
| 36607: | W:1 |
| 36608: | W:1 |
| 36609: | W:1 |
| 36610: | W:1 |
| 36611: | W:1 |
| 36612: | N:1 |
| 36613: | N:1 |
| 36614: | N:1 |
| 36615: | N:1 |
| 36616: | N:1 |
| 36617: | N:1 |
| 36618: | N:1 |
| 36619: | N:1 |
| 36620: | N:1 |
| 36621: | N:1 |
| 36622: | N:1 |
| 36623: | N:1 |
| 36624: | N:1 |
| 36625: | N:1 |
| 36626: | N:1 |
| 36627: | N:1 |
| 36628: | N:1 |
| 36629: | N:1 |
| 36630: | N:1 |
| 36631: | N:1 |
| 36632: | N:1 |
| 36633: | N:1 |
| 36634: | N:1 |
| 36635: | N:1 |
| 36636: | N:1 |
| 36637: | N:1 |
| 36638: | N:1 |
| 36639: | N:1 |
| 36640: | N:1 |
| 36641: | N:1 |
| 36642: | N:1 |
| 36643: | N:1 |
| 36644: | N:1 |
| 36645: | N:1 |
| 36646: | N:1 |
| 36647: | N:1 |
| 36648: | N:1 |
| 36649: | N:1 |
| 36650: | N:1 |
| 36651: | N:1 |
| 36652: | N:1 |
| 36653: | N:1 |
| 36654: | N:1 |
| 36655: | N:1 |
| 36656: | N:1 |
| 36657: | N:1 |
| 36658: | N:1 |
| 36659: | N:1 |
| 36660: | N:1 |
| 36661: | N:1 |
| 36662: | N:1 |
| 36663: | N:1 |
| 36664: | N:1 |
| 36665: | N:1 |
| 36666: | N:1 |
| 36667: | N:1 |
| 36668: | N:1 |
| 36669: | N:1 |
| 36670: | N:1 |
| 36671: | N:1 |
| 36672: | N:1 |
| 36673: | N:1 |
| 36674: | N:1 |
| 36675: | N:1 |
| 36676: | N:1 |
| 36677: | N:1 |
| 36678: | N:1 |
| 36679: | N:1 |
| 36680: | N:1 |
| 36681: | N:1 |

TABLE III

| Letter Code | Tissue Type |
|---|---|
| A | Bone Marrow |
| B | Brain |
| C | Cancerous prostate |
| D | Cerebellum |
| E | Colon |
| F | Dystrophic muscle |
| G | Fetal brain |
| H | Fetal kidney |
| I | Fetal liver |
| J | Heart |
| K | Hypertrophic prostate |
| L | Kidney |
| M | Large intestine |
| N | Liver |
| O | Lung |
| P | Lymph ganglia |
| Q | Lymphocytes |
| R | Muscle |
| S | Prostate |
| T | Ovary |
| U | Pancreas |
| V | Placenta |
| W | Spinal cord |
| X | Spleen |
| Y | Substantia nigra |
| Z | Surrenals |
| AA | Testis |
| AB | Thyroid |
| AC | Umbilical cord |
| AD | Uterus |

SEQUENCE LISTING (36681 sequences)

SEQ ID NO: 1 - DNA, 822 bp, Homo Sapiens
  CDS 346..552
  sig_peptide 346..408: Von Heijne matrix
  misc_feature 113: s=g or c
  misc_feature 115: n=a, g, c or t
  misc_feature 499: r=a or g
  misc_feature 566: r=a or g
  misc_feature 585: k=g or t
  misc_feature 610: r=a or g
  misc_feature 699: r=a or g
  misc_feature 700: m=a or c
  misc_feature 782: w=a or t
  UNSURE 31: Xaa=Glu or Lys
actccttttagcataggggcttcggcgccagcggccagcgctagtcggtctggtaagtgcctgatgccgagttccgtctctcgcgtcttttcctggtcccaggcaaagcggasgnagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccaraaaaatgcttatttggggcaatgctaaatattgcggcagttttatgtcaaaaatagaaatcaggaarataattcaacttaaagaakttcatttcatgaccaaactcttcaraaacatgtctttacaagcatatctcttgtattgctttctacactgttgaattgtctggcaatatttctgcagtggaaaatttgatttarmtagttcttgactgataaatatggtaaggtgggcttttccccctgtgtaattggctactatgtcttactgagccaagttgtawtttgaaataaaatgatatgagagtgacacaaaaaaaaaaa

SEQ ID NO: 2 - protein, 21 aa, Homo Sapiens
  SIGNAL 1..21: Von Heijne matrix score 5.5 seq SFLPSALVIWTSA/AF
MWWFQQGLSFLPSALVIWTSA

SEQ ID NO: 3 - DNA, 526 bp, Homo Sapiens
  CDS 90..344
  sig_peptide 90..140: Von Heijne matrix
  misc_feature 6: r=a or g
  misc_feature 8: r=a or g
  misc_feature 32: r=a or g
  misc_feature 80: r=a or g
  misc_feature 137: w=a or t
  misc_feature 209: r=a or g
  misc_feature 210: w=a or t
  misc_feature 290: n=a, g, c or t
  misc_feature 352: r=a or g
  misc_feature 366: r=a or g
  misc_feature 411: r=a or g
  misc_feature 435: r=a or g
  UNSURE 24: Xaa=Phe or Ile
  UNSURE 50: Xaa=Lys or Asn
aatatraracagctacaatattccagggccartcacttgccatttctcataacagcgtcagagagaaagaactgactgaracgtttgagatgaagaaagttctcctcctgatcacagccatcttggcagtggctgtwggtttcccagtctctcaagaccaggaacgagaaaaaagaagtatcagtgacagcgatgaattagcttcaggrwtttttgtgttcccttacccatatccatttcgcccacttccaccaattccatttccaagatttccatggtttagacgtaantttcctattccaatacctgaatctgcccctacaactccccttcctagcgaaaagtaaacaaraaggaaaagtcacrataaacctggtcacctgaaattgaaattgagccacttccttgaaraatcaaaattcctgttaataaaaraaaaacaaatgtaattgaaatagcacacagcattctctagtcaatatctttagtgatcttctttaataaacatgaaagcaaaaaaaaaaaa

SEQ ID NO: 4 - protein, 17 aa, Homo Sapiens
  SIGNAL 1..17: Von Heijne matrix score 8.2 seq LLLITAILAVAVG/FP
MKKVLLLITAILAVAVG

SEQ ID NO: 5 - DNA, 848 bp, Homo Sapiens
  CDS 32..697
  sig_peptide 32..73: Von Heijne matrix
  misc_feature 540: d=a or g or t
  misc_feature 543: r=a or g
  misc_feature 581: r=a or g
  misc_feature 586: k=g or t
  misc_feature 725: r=a or g
  misc_feature 788: w=a or t
  UNSURE 156: Xaa=Ile or Lys or Arg
  UNSURE 157: Xaa=Lys or Arg
  UNSURE 170: Xaa=Asp or Asn
  UNSURE 171: Xaa=Lys or Asn
aactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtadaaraaagaacaaagaaccatctgaagtggatgacgctgaarataaktgtgaaaacatgatcacaattgaaaatggcatcccctctgatcccctggacatgaagggagggcatattaatgatgccttcatgacagaggatgagaggctcacccctctctgaagggctgttgttctgcttcctcaaraaattaaacatttgtttctgtgtgactgctgagcatcctgaaataccaagagcagatcatatwttttgtttcaccattcttcttttgtaataaattttgaatgtgcttgaaaaaaaaaaaaac

SEQ ID NO: 6 - protein, 14 aa, Homo Sapiens
  SIGNAL 1..14: Von Heijne matrix score 10.7 seq LWLLFFLVTAIHA/EL
MLWLLFFLVTAIHA

SEQ ID NO: 7 - DNA, 826 bp, Homo sapiens
  CDS 15..695
  sig_peptide 15..80: score 8.5 seq AALLLGLMMVVTG/DE
aaccagaggtgcccatgggttggacaatgaggctggtcacagcagcactgttactgggtctcatgatggtggtcactggagacgaggatgagaacagcccgtgtgcccatgaggccctcctggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaggtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaatcatccaaaaaaaaaaaaa

SEQ ID NO: 8 - protein, 227 aa, Homo sapiens
  SIGNAL -22..-1: score 8.5 seq AALLLGLMMVVTG/DE
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 9 - DNA, 852 bp, Homo sapiens
  CDS 229..735
  sig_peptide 229..492: score 6.7 seq VFALSSFLNKASA/VY
aatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggtttttaaatcaagatttaacattccaacacataaaaattatttatccaacagctcctcccagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggaggattctctatgggaggatgcatggcaatgcatttagcatatagaaatcatcaagatgtggcaggagtatttgctctttctagttttctgaataaagcatctgctgtttaccaggctcttcagaagagtaatggtgtacttcctgaattatttcagtgtcatggtactgcagatgagttagttcttcattcttgggcagaagagacaaactcaatgttaaaatctctaggagtgaccacgaagtttcatagttttccaaatgtttaccatgagctaagcaaaactgagttagacatattgaagttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaatagcaaaaaaaaaaaaaaaa

SEQ ID NO: 10 - protein, 169 aa, Homo sapiens [sequence omitted]

SEQ ID NO: 11 - DNA, 1602 bp, Homo sapiens
  CDS 24..1004
  sig_peptide 24..170: score 5.6 seq ACLSLGFFSLLWL/QL
atgcgccgccgcctctccgcacgatgttcccctcgcggaggaaagcggcgcagctgccctgggaggacggcaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggttcaaccgggcagcgctcatcaacgtgggcttcctggagagcagcaacagcacggactacattgccatgcacgacgttgacctgctccctctcaacgaggagctggactatggctttcctgaggctgggcccttccacgtggcctccccggagctccaccctctctaccactacaagacctatgtcggcggcatcctgctgctctccaagcagcactaccggctgtgcaatgggatgtccaaccgcttctggggctggggccgcgaggacgacgagttctaccggcgcattaagggagctgggctccagcttttccgcccctcgggaatcacaactgggtacaagacatttcgccacctgcatgacccagcctggcggaagagggaccagaagcgcatcgcagctcaaaaacaggagcagttcaaggtggacagggagggaggcctgaacactgtgaagtaccatgtggcttcccgcactgccctgtctgtgggcggggccccctgcactgtcctcaacatcatgttggactgtgacaagaccgccacaccctggtgcacattcagctgagctggatggacagtgaggaagcctgtacctacaggccatattgctcaggctcaggacaaggcctcaggtcgtgggcccagctctgacaggatgtggagtggccaggaccaagacagcaagctacgcaattgcagccacccggccgccaaggcaggcttgggctgggccaggacacgtggggtgcctgggacgctgcttgccatgcacagtgatcagagagaggctggggtgtgtcctgtccgggaccccccctgccttcctgctcaccctactctgacctccttcacgtgcccaggcctgtgggtagtggggagggctgaacaggacaacctctcatcacccccacttttgttccttcctgctgggctgcctcgtgcagagacacagtgtaggggccatgcagctggcgtaggtggcagttgggcctggtgagggttaggacttcagaaaccagagcacaagccccacagagggggaacagccagcaccgctctagctggttgttgccatgccggaatgtgggcctagtgttgccagatcttctgatttttcgaaagaaactagaatgctggattctcaaaaaaaaaaaaaaaaa

SEQ ID NO: 12 - protein, 327 aa, Homo sapiens
  SIGNAL -49..-1: score 5.6 seq ACLSLGFFSLLWL/QL
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRLAVLVPFRERFEELLVFVPHMRRFLSRKKIRHHIYVLNQVDHFRFNRAALINVGFLESSNSTDYIAMHDVDLLPLNEELDYGFPEAGPFHVASPELHPLYHYKTYVGGILLLSKQHYRLCNGMSNRFWGWGREDDEFYRRIKGAGLQLFRPSGITTGYKTFRHLHDPAWRKRDQKRIAAQKQEQFKVDREGGLNTVKYHVASRTALSVGGAPCTVLNIMLDCDKTATPWCTFS

SEQ ID NO: 13 - DNA, 1568 bp, Homo sapiens
  CDS 75..1259
  sig_peptide 75..1004: score 4.4 seq VLILLFSLALIIL/PS
agaaaaggtgtagtgtttggggcggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggactcctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaaaaaaaaaaaaaaa

SEQ ID NO: 14 - protein, 395 aa, Homo sapiens [sequence omitted]

SEQ ID NO: 15 - DNA, 25 bp, Artificial Sequence
  Sequence source:/note="synthetic construct"
gggaagatggagatagtattgcctg

SEQ ID NO: 16 - DNA, 26 bp, Artificial Sequence
  Sequence source:/note="synthetic construct"
  Sequence source:/note="synthetic construct"
ctgccatgtacatgatagagagattc

SEQ ID NO: 17 - DNA, 546 bp, Homo Sapiens
  promoter 1..517
  transcription start site 518
  protein_bind 17..25: matinspector prediction name CMYB_01 score 0.983 sequence tgtcagttg
  protein_bind complement(18..27): matinspector prediction name MYOD_Q6 score 0.961 sequence cccaactgac
  protein_bind complement(75..85): matinspector prediction name S8_01 score 0.960 sequence aatagaattag
  protein_bind 94..104: matinspector prediction name S8_01 score 0.966 sequence aactaaattag
  protein_bind complement(129..139): matinspector prediction name DELTAEF1_01 score 0.960 sequence gcacacctcag
  protein_bind complement(155..165): matinspector prediction name GATA_C score 0.964 sequence agataaatcca
  protein_bind 170..178: matinspector prediction name CMYB_01 score 0.958 sequence cttcagttg
  protein_bind 176..189: matinspector prediction name GATA1_02 score 0.959 sequence ttgtagataggaca
  protein_bind 180..190: matinspector prediction name GATA_C score 0.953 sequence agataggacat
  protein_bind 284..299: matinspector prediction name TAL1ALPHAE47_01 score 0.973 sequence cataacagatggtaag
  protein_bind 284..299: matinspector prediction name TAL1BETAE47_01 score 0.983 sequence cataacagatggtaag
  protein_bind 284..299: matinspector prediction name TAL1BETAITF2_01 score 0.978 sequence cataacagatggtaag
  protein_bind complement(287..296): matinspector prediction name MYOD_Q6 score 0.954 sequence accatctgtt
  protein_bind complement(302..314): matinspector prediction name GATA1_04 score 0.953 sequence tcaagataaagta
  protein_bind 393..405: matinspector prediction name IK1_01 score 0.963 sequence agttgggaattcc
  protein_bind 393..404: matinspector prediction name IK2_01 score 0.985 sequence agttgggaattc
  protein_bind 396..405: matinspector prediction name CREL_01 score 0.962 sequence tgggaattcc
  protein_bind 423..436: matinspector prediction name GATA1_02 score 0.950 sequence tcagtgatatggca
  protein_bind complement(478..489): matinspector prediction name SRY_02 score 0.951 sequence taaaacaaaaca
  protein_bind 486..493: matinspector prediction name E2F_02 score 0.957 sequence tttagcgc
  protein_bind complement(514..521): matinspector prediction name MZF1_01 score 0.975 sequence tgagggga
tgagtgcagtgttacatgtcagttgggttaagtttgttaatgtcattcaaatcttctatgtcttgatttgcctgctaattctattatttctggaactaaattagtttgatggttctattagttattgactgaggtgtgctaatctcccattatgtggatttatctatttcttcagttgtagataggacattgatagatacataagtaccaggacaaaagcagggagatcttttttccaaaatcaggagaaaaaaatgacatctggaaaacctatagggaaaggcataacagatggtaaggatactttatcttgagtaggagagccttcctgtggcaacgtggagaagggaagaggtcgtagaattgaggagtcagctcagttagaagcagggagttgggaattccgttcatgtgatttagcatcagtgatatggcaaatgtgggactaagggtagtgatcagagggttaaaattgtgtgttttgttttagcgctgctggggcatcgccttgggtcccctcaaacagattcccatgaatctcttcat

SEQ ID NO: 18 - DNA, 23 bp, Artificial Sequence
  Sequence source:/note="synthetic construct"
gtaccagggactgtgaccattgc

SEQ ID NO: 19 - DNA, 24 bp, Artificial Sequence
  Sequence source:/note="synthetic construct"
ctgtgaccattgctcccaagagag

SEQ ID NO: 20 - DNA, 861 bp, Homo Sapiens
  promoter 1..806
  transcription start site 807
  protein_bind complement(60..70): matinspector prediction name NFY_Q6 score 0.956 sequence ggaccaatcat
  protein_bind 70..77: matinspector prediction name MZF1_01 score 0.962 sequence cctgggga
  protein_bind 124..132: matinspector prediction name CMYB_01 score 0.994 sequence tgaccgttg
  protein_bind complement(126..134): matinspector prediction name VMYB_02 score 0.985 sequence tccaacggt
  protein_bind 135..143: matinspector prediction name STAT_01 score 0.968 sequence ttcctggaa
  protein_bind complement(135..143): matinspector prediction name STAT_01 score 0.951 sequence ttccaggaa
  protein_bind complement(252..259): matinspector prediction name MZF1_01 score 0.956 sequence ttggggga
  protein_bind 357..368: matinspector prediction name IK2_01 score 0.965 sequence gaatgggatttc
  protein_bind 384..391: matinspector prediction name MZF1_01 score 0.986 sequence agagggga
  protein_bind complement(410..421): matinspector prediction name SRY_02 score 0.955 sequence gaaaacaaaaca
  protein_bind 592..599: matinspector prediction name MZF1_01 score 0.960 sequence gaagggga
  protein_bind 618..627: matinspector prediction name MYOD_Q6 score 0.981 sequence agcatctgcc
  protein_bind 632..642: matinspector prediction name DELTAEF1_01 score 0.958 sequence tcccaccttcc
  protein_bind complement(813..823): matinspector prediction name S8_01 score 0.992 sequence gaggcaattat
  protein_bind complement(824..831): matinspector prediction name MZF1_01 score 0.986 sequence agagggga
  misc_feature 220: s=g or c
  misc_feature 224: s=g or c
  misc_feature 226: r=a or g
  misc_feature 239: r=a or g
  misc_feature 269: s=g or c
  misc_feature 271: y=c or t
  misc_feature 277: y=c or t
  misc_feature 278: m=a or c
  misc_feature 280: m=a or c
  misc_feature 287: k=g or t
  misc_feature 290: y=c or t
  misc_feature 295: m=a or c
  misc_feature 300: r=a or g
  misc_feature 303: y=c or t
  misc_feature 315: s=g or c
  misc_feature 321: s=g or c
  misc_feature 332: k=g or t
  misc_feature 335: n=a, g, c or t
  misc_feature 341: s=g or c
  misc_feature 342: m=a or c
  misc_feature 376: n=a, g, c or t
tactatagggcacgcgtggtcgacggccgggctgttctggagcagagggcatgtcagtaatgattggtccctggggaaggtctggctggctccagcacagtgaggcatttaggtatctctcggtgaccgttggattcctggaagcagtagctgttctgtttggatctggtagggacagggctcagagggctaggcacgagggaaggtcagaggagaaggsaggsarggcccagtgagargggagcatgccttcccccaaccctggcttscycttggymamagggcgkttytgggmacttraaytcagggcccaascagaascacaggcccaktcntggctsmaagcacaatagcctgaatgggatttcaggttagncagggtgagaggggaggctctctggcttagttttgttttgttttccaaatcaaggtaacttgctcccttctgctacgggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcac

SEQ ID NO: 21 - DNA, 20 bp, Artificial Sequence
  Sequence source:/note="synthetic construct"
ctgggatggaaggcacggta

SEQ ID NO: 22 - DNA, 20 bp, Artificial Sequence
  Sequence source:/note="synthetic construct"
gagaccacacagctagacaa

SEQ ID NO: 23 - DNA, 555 bp, Homo Sapiens
  promoter 1..500
  transcription start site 501
  protein_bind 191..206: matinspector prediction name ARNT_01 score 0.964 sequence ggactcacgtgctgct
  protein_bind 193..204: matinspector prediction name NMYC_01 score 0.965 sequence actcacgtgctg
  protein_bind 193..204: matinspector prediction name USF_01 score 0.985 sequence actcacgtgctg
  protein_bind complement(193..204): matinspector prediction name USF_01 score 0.985 sequence cagcacgtgagt
  protein_bind complement(193..204): matinspector prediction name NMYC_01 score 0.956 sequence cagcacgtgagt
  protein_bind complement(193..204): matinspector prediction name MYCMAX_02 score 0.972 sequence cagcacgtgagt
  protein_bind 195..202: matinspector prediction name USF_C score 0.997 sequence tcacgtgc
  protein_bind complement(195..202): matinspector prediction name USF_C score 0.991 sequence gcacgtga
  protein_bind complement(210..217): matinspector prediction name MZF1_01 score 0.968 sequence catgggga
  protein_bind 397..410: matinspector prediction name ELK1_02 score 0.963 sequence ctctccggaagcct
  protein_bind 400..409: matinspector prediction name CETS1P54_01 score 0.974 sequence tccggaagcc
  protein_bind complement(460..470): matinspector prediction name AP1_Q4 score 0.963 sequence agtgactgaac
  protein_bind complement(460..470): matinspector prediction name AP1FJ_Q2 score 0.961 sequence agtgactgaac
  protein_bind 547..555: matinspector prediction name PADS_C score 1.000 sequence tgtggtctc
  misc_feature 14: k=g or t
  misc_feature 45: k=g or t
  misc_feature 75: k=g or t
  misc_feature 121: k=g or t
  misc_feature 123: w=a or t
ctatagggcacgcktggtcgacggcccgggctggtctggtctgtkgtggagtcgggttgaaggacagcatttgtkacatctggtctactgcaccttccctctgccgtgcacttggcctttkawaagctcagcaccggtgcccatcacagggccggcagcacacacatcccattactcagaaggaactgacggactcacgtgctgctccgtccccatgagctcagtggacctgtctatgtagagcagtcagacagtgcctgggatagagtgagagttcagccagtaaatccaagtgattgtcattcctgtctgcattagtaactcccaacctagatgtgaaaacttagttctttctcataggttgctctgcccatggtcccactgcagacccaggcactctccggaagcctggaaatcacccgtgtcttctgcctgctcccgctcacatcccacacttgtgttcagtcactgagttacagattttgcctcctcaatttctcttgtcttagtcccatcctctgttcccctggccagtttgtctagctgtgtggtctc

SEQ ID NO: 24 - DNA, 391 bp, Homo sapiens
  CDS 108..389
  sig_peptide 108..167: score 5 seq LQRFAVLSRGVHS/SV
  misc_feature 274: r=a or g
  UNSURE 36: Xaa=His or Arg
aagttgcagtgacgctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccrtcctttacctgtagccctggagagaggaaaaggtatttacttatgggatgtagaaggcagaaaatattttgacttcctgagttcttacagtgctgtcaaccaagggcattgtcaccc

SEQ ID NO: 25 - DNA, 295 bp, Homo sapiens
  CDS 82..294
  sig_peptide 82..141: score 3.5 seq WQLVLNVWGKVEA/DI
agagagaaagtgaaggagggcaggggagggggacagcgagccattgagcgatctttgtcaagcatcccagaagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccactgtgctcaccg

SEQ ID NO: 26 - DNA, 449 bp, Homo sapiens
  CDS 110..448
  sig_peptide 110..169: score 3.5 seq WQLVLNVWGKVEA/DI
  misc_feature 313: y=c or t
  misc_feature 419: n=a, g, c or t
  misc_feature 421: n=a, g, c or t
  misc_feature 422: m=a or c
  UNSURE 84: Xaa=Phe or Ile or Leu or Met or Val
  UNSURE 85: Xaa=Pro or Thr
agaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcatctgaggacttaaagaagcatggtgccacygtgctcaccgccctgggtggcatccttaagaagaaggggcatcatgaggcagagattaagcccctggcacagtcgcatgccaccaagcacaagatccccgtgaaantnmctggagttcatctcggaatgcatcatc

SEQ ID NO: 27 - DNA, 382 bp, Homo sapiens
  CDS 58..381
  sig_peptide 58..159: score 3.8 seq TLFVFISXGSALG/FK
  misc_feature 143: n=a, g, c or t
  misc_feature 178: m=a or c
  misc_feature 336: n=a, g, c or t
  misc_feature 337: n=a, g, c or t
  misc_feature 338: n=a, g, c or t
  misc_feature 339: n=a, g, c or t
  UNSURE -6: Xaa=Ile or Asn or Ser or Thr
  UNSURE 7: Xaa=His or Asn
  UNSURE 60: Xaa=any one of the twenty amino acids
agctctcagagggaattgagcacccggcagcggtctcaggccaagccccctgccagcatggccagcgagttcaagaagaagctcttctggagggcagtggtggccgagttcctggccacgaccctctttgtcttcatcagcancggttctgccctgggcttcaaatacccggtggggmacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgnnnntcatgtacatcatcgcccagtgcgtgggggccatcgtcgccac

SEQ ID NO: 28 - DNA, 495 bp, Homo sapiens
  CDS 147..494
  sig_peptide 147..278: score 5.5 seq ILFFTGWWIMIDA/AV
  misc_feature 51: s=g or c
  misc_feature 106: r=a or g
  misc_feature 109: w=a or t
  misc_feature 439: k=g or t
  UNSURE 54: Xaa=Leu or Trp
gctcccggggctgaggtggagccgcgggacgccggcagggttgtggcgcasagtctccttcctgcgcgcgcgcctgaagtcggcgtgggcgtttgaggaagctggratwcagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttkgcttttcattggtttcatgttgatgtttgggtcacttattgcttccatgtggattc

SEQ ID NO: 29 - DNA, 379 bp, Homo sapiens
  CDS 80..379
  sig_peptide 80..136: score 6.2 seq WXFLVAIIKGVQC/XX
  misc_feature 59: w=a or t
  misc_feature 96: s=g or c
  misc_feature 101: s=g or c
  misc_feature 139: k=g or t
  misc_feature 141: y=c or t
  misc_feature 145: n=a, g, c or t
  misc_feature 164: r=a or g
  misc_feature 175: r=a or g
  misc_feature 176: y=c or t
  misc_feature 231: w=a or t
  misc_feature 240: r=a or g
  misc_feature 274: r=a or g
  misc_feature 301: w=a or t
  misc_feature 304: w=a or t
  misc_feature 328: n=a, g, c or t
  misc_feature 329: r=a or g
  misc_feature 334: n=a, g, c or t
  misc_feature 337: m=a or c
  misc_feature 338: w=a or t
  misc_feature 342: m=a or c
  misc_feature 355: y=c or t
  UNSURE -14: Xaa=Ser or Thr
  UNSURE -12: Xaa=Leu or Val
  UNSURE 1: Xaa=His or Gln
  UNSURE 2: Xaa=Ala or Val
  UNSURE 3: Xaa=His or Gln
  UNSURE 10: Xaa=Gly or Ser
  UNSURE 14: Xaa=Pro or Ser
  UNSURE 32: Xaa=Phe or Tyr
  UNSURE 35: Xaa=Asn or Ser
  UNSURE 56: Xaa= *  or Tyr
  UNSURE 64: Xaa=Asp or Glu
  UNSURE 65: Xaa=Glu or Lys
  UNSURE 68: Xaa=Phe or Ile
  UNSURE 69: Xaa=Asn or Thr
agtctgggagaagagccccagccccagaattcccaggagtttccattcggtgatcagcwctgaacacagaggactcaccatggagtttgggctgasctggsttttccttgttgctattataaaaggtgtccagtgtcakgygcanctggtggagtctgggggargcttggtcaaryctggagggtccctgagactctcctgtgcagcctctggattcaccttcagtgactwctacatgarctggatccgccaggctccagggaaggggctggartgggtttcatacattagtagcggtggwtawtacacaaactacgcagactctganragggncgmwtcamcatctccagagayaacgccaagaactcactgtatctg

SEQ ID NO: 30 - DNA, 442 bp, Homo sapiens
  CDS 65..442
  sig_peptide 65..121: score 11.7 seq VFCLLAVAPGAHS/QV
  misc_feature 215: y=c or t
  misc_feature 254: y=c or t
  misc_feature 285: r=a or g
  misc_feature 289: y=c or t
  misc_feature 295: n=a, g, c or t
  misc_feature 298: s=g or c
  misc_feature 334: y=c or t
  misc_feature 365: s=g or c
  misc_feature 381: s=g or c
  misc_feature 388: s=g or c
  misc_feature 404: y=c or t
  misc_feature 406: y=c or t
  misc_feature 412: k=g or t
  misc_feature 418: k=g or t
  misc_feature 427: y=c or t
  UNSURE 32: Xaa=His or Tyr
  UNSURE 45: Xaa=Phe or Leu
  UNSURE 55: Xaa=Asp or Gly
  UNSURE 59: Xaa=Lys or Asn
  UNSURE 82: Xaa=Glu or Gln
  UNSURE 87: Xaa=Arg or Thr
  UNSURE 89: Xaa=Asp or Glu
  UNSURE 95: Xaa=His or Tyr
  UNSURE 99: Xaa=Asp or Glu
aaaagcatcatccaacaaccacatcccttctctacagaagcctctgagaggaaagttcttcaccatggactggacctggagggtcttctgcttgctggctgtagctccaggtgctcactcccaggtgcagctggtgcagtctggggctgaggtgaagaagcctggggcctcagtgaaggtttcctgcaaggcatctggatacaccttcaccagcyactatatgcactgggtgcgacaggcccctggacaagggyttgagtggatgggaataatcaaccctagtgrtggyagcacnaastacgcacagaagttccagggcagagtcaccatgacyagggacacgtccacgagcacagtctacatgsagctgagcagcctgasatctgasgacacggccgtgtatyaytgtgckagagakgcgtatagyagctaccgctttgac

SEQ ID NO: 31 - DNA, 400 bp, Homo sapiens
  CDS 20..400
  sig_peptide 20..76: score 11 seq TLLLLTVPSWVLS/QV
  misc_feature 160: r=a or g
  misc_feature 165: s=g or c
  misc_feature 180: s=g or c
  misc_feature 187: y=c or t
  misc_feature 200: s=g or c
  misc_feature 213: s=g or c
  misc_feature 230: y=c or t
  misc_feature 242: s=g or c
  misc_feature 244: r=a or g
  misc_feature 253: r=a or g
  misc_feature 254: w=a or t
  misc_feature 256: s=g or c
  UNSURE 30: Xaa=Ser or Thr
  UNSURE 35: Xaa=Cys or Ser
  UNSURE 42: Xaa=Ala or Pro
  UNSURE 46: Xaa=Ala or Gly
  UNSURE 52: Xaa=Phe or Leu
  UNSURE 56: Xaa=Glu or Gln
  UNSURE 60: Xaa= *  or Lys or Asn or Tyr
gtgaatcctgctctccaccatggacatactttgttccacgctcctgctactgactgtcccgtcctgggtcttatcccaggtcaccttgagggagtctggtcctgcgctggtgaaacccacacagaccctcacactgacctgcaccttctctgggttctcrctcascactagtggaatgtstgtgagytggatccgtcagsccccagggaaggscctggagtggcttgcaytcattgattggsargatgataarwastacagcacatctctgaagaacagactcaccatctccaaggacacctccaaaaaccaggtggtccttacactgtccaagatggaccctgtggacacagccacatattactgtgcacggagtagattagtccctcacgaccactgg

SEQ ID NO: 32 - DNA, 283 bp, Homo sapiens
  CDS 20..283
  sig_peptide 20..76: score 11 seq TLLLLTVPSWVLS/QV
  misc_feature 90: r=a or g
  UNSURE 5: Xaa=Lys or Arg
gtgaatcctgctctccaccatggacatactttgttccacgctcctgctactgactgtcccgtcctgggtcttatcccaggtcaccttgarggagtctggtcctgcgctggtgaaacccacagagaccctcacactgacctgcaccctctctgggttctcactcaacgttagtggaatgcgtatgatctgggtccgtcagttcccagggcaggccctggagtggcttgcacgcattgattgggatgatgagaagtacttcacttcatctctgaggaccaggctc

SEQ ID NO: 33 - DNA, 388 bp, Homo sapiens
  CDS 58..387
  sig_peptide 58..114: score 10.6 seq ILFLVAAXTGAXS/QV
  misc_feature 97: n=a, g, c or t
  misc_feature 110: w=a or t
  misc_feature 123: k=g or t
  misc_feature 128: w=a or t
  misc_feature 139: r=a or g
  misc_feature 152: m=a or c
  misc_feature 171: r=a or g
  misc_feature 186: y=c or t
  misc_feature 197: y=c or t
  misc_feature 201: y=c or t
  misc_feature 203: m=a or c
  misc_feature 210: y=c or t
  misc_feature 212: r=a or g
  misc_feature 225: k=g or t
  misc_feature 228: w=a or t
  misc_feature 246: s=g or c
  UNSURE -6: Xaa=Ala or Pro or Ser or Thr
  UNSURE -2: Xaa=His or Leu
  UNSURE 3: Xaa=His or Gln
  UNSURE 5: Xaa=Glu or Val
  UNSURE 9: Xaa=Gly or Ser
  UNSURE 13: Xaa=Lys or Thr
  UNSURE 28: Xaa=Ile or Thr
  UNSURE 30: Xaa=Asn or Thr
  UNSURE 33: Xaa=Asp or Gly
atcacccaaaaaccacacccctccttgggagaatcccctagatcacagctcctcaccatggactggacctggagcatccttttcttggtggcagcancaacaggtgcccwctcccaggttcakctggwgcagtctggargtgaggtgaagamgcctggggcctcagtgaargtctcctgcaaggcytctggttacaycttyamcagataygrtatcaactgggtkcgwcaggcccctggacaaggscttgagtggatgggatggatcagcccttacaatggaaatacaaattatgcacagcaattccaggacagagtcaccttgaccacagacacatcgacgagtacagcatttctggagttgaggagtctgaaatctgacgacacgg

SEQ ID NO: 34 - DNA, 419 bp, Homo sapiens
  CDS 58..417
  sig_peptide 58..114: score 10.7 seq ILFLVAAATGXHS/QV
  misc_feature 107: y=c or t
  misc_feature 123: r=a or g
  misc_feature 139: s=g or c
  misc_feature 272: s=g or c
  misc_feature 301: r=a or g
  misc_feature 304: y=c or t
  misc_feature 329: s=g or c
  misc_feature 330: r=a or g
  misc_feature 360: m=a or c
  misc_feature 361: y=c or t
  misc_feature 368: r=a or g
  misc_feature 372: r=a or g
  misc_feature 407: r=a or g
  UNSURE -3: Xaa=Ala or Val
  UNSURE 9: Xaa=Ala or Pro
  UNSURE 53: Xaa=Ala or Gly
  UNSURE 63: Xaa=Glu or Lys
  UNSURE 64: Xaa=Phe or Leu
  UNSURE 72: Xaa=Arg or Thr
  UNSURE 82: Xaa=Asp or Glu
  UNSURE 85: Xaa=Asn or Ser
  UNSURE 98: Xaa=Lys or Arg
atcacccaaaaaccacacccctccttgggagaatcccctagatcacagctcctcaccatggactggacctggagcatccttttcttggtggcagcagcaacaggtgyccactcccaggttcarctggtgcagtctggasctgaggtgaagaagcctggggcctcagtgaaggtctcctgcaaggcttctggttacacctttaccagctatggtatcagctgggtgcgacaggcccctggacaagggcttgagtggatgggatggatcagcgsttacaatggtaacacaaactatgcacagragytccagggcagagtcaccatgaccasrgacacatccacgaacacagcctacatggamytgaggarcctragatctgacgacacggccgtgtattactgtgcgargaggggactcaa

SEQ ID NO: 35 - DNA, 455 bp, Homo sapiens
  CDS 58..453
  sig_peptide 58..114: score 10.8 seq ILFLVAAATGAHS/QV
  misc_feature 123: r=a or g
  misc_feature 139: s=g or c
  misc_feature 206: r=a or g
  misc_feature 212: r=a or g
  misc_feature 218: r=a or g
  misc_feature 301: r=a or g
  misc_feature 303: n=a, g, c or t
  misc_feature 329: s=g or c
  misc_feature 330: r=a or g
  misc_feature 344: r=a or g
  misc_feature 345: m=a or c
  misc_feature 373: m=a or c
  misc_feature 391: r=a or g
  misc_feature 393: k=g or t
  misc_feature 414: m=a or c
  misc_feature 415: n=a, g, c or t
  misc_feature 422: n=a, g, c or t
  misc_feature 424: s=g or c
  UNSURE 9: Xaa=Ala or Pro
  UNSURE 31: Xaa=Asn or Ser
  UNSURE 33: Xaa=Asp or Gly
  UNSURE 35: Xaa=Asn or Ser
  UNSURE 63: Xaa=Asp or Glu or Lys or Asn
  UNSURE 72: Xaa=Arg or Thr
  UNSURE 77: Xaa=Lys or Asn or Arg or Ser
  UNSURE 93: Xaa=Ile or Met or Val
  UNSURE 101: Xaa=Ile or Leu or Val
  UNSURE 103: Xaa=Ala or Glu or Gly or Val
  UNSURE 104: Xaa=Leu or Val
atcacccaaaaaccacacccctccttgggagaatcccctagatcacagctcctcaccatggactggacctggagcatccttttcttggtggcagcagcaacaggtgcccactcccaggttcarctggtgcagtctggasctgaggtgaagaagcctggggcctcagtgaaggtctcctgcaaggcttctggttacacctttaccarctatgrtatcarctgggtgcgacaggcccctggacaagggcttgagtggatgggatggatcagcgcttacaatggtaacacaaactatgcacagranctccagggcagagtcaccatgaccasrgacacatccacgarmacagcctacatggaactgaggagcctgmgatctgacgacacggccrtktattactgtgcgcgagagatmntagtggnastatgtgatggacagttggggccagggaacct

SEQ ID NO: 36 - DNA, 373 bp, Homo sapiens
  CDS 58..372
  sig_peptide 58..114: score 9.5 seq ILXLVAAXTGAHS/QG
  misc_feature 74: s=g or c
  misc_feature 82: w=a or t
  misc_feature 84: w=a or t
  misc_feature 96: w=a or t
  misc_feature 97: r=a or g
  misc_feature 124: y=c or t
  misc_feature 125: w=a or t
  misc_feature 185: m=a or c
  misc_feature 220: w=a or t
  misc_feature 252: r=a or g
  misc_feature 333: n=a, g, c or t
  misc_feature 344: n=a, g, c or t
  misc_feature 354: n=a, g, c or t
  misc_feature 365: n=a, g, c or t
  UNSURE -14: Xaa=Ser or Thr
  UNSURE -11: Xaa=Phe or Ile or Leu
  UNSURE -6: Xaa=Ala or Thr
  UNSURE 4: Xaa= *  or Leu or Gln
  UNSURE 24: Xaa=Ala or Asp
  UNSURE 36: Xaa=Arg or Trp
  UNSURE 73: Xaa=Arg or Ser
  UNSURE 77: Xaa=Ala or Glu or Gly or Val
  UNSURE 84: Xaa=Ala or Glu or Gly or Val
atcacccaaaaaccacacccctccttgggagaatcccctagatcacagctcctcaccatggactggacctggascatccttwtwttggtggcagcwrcaacaggtgcccactcccagggtcagywggtgcagtctggagctgaagtgaagaagcctggggcctcagtgaaggtctcctgcaaggmttctggttacacctttacatactttggtgtcagtwggtttcggcaggcccctggacaagggcttgartggatggcatggatcagcggtcataatggtgacacaaactatgcgacggaggatccagggcagagtcaccctgaccacagncacatccacgngcacagcctncatggagctgnggagccgg

SEQ ID NO: 37 - DNA, 382 bp, Homo sapiens
  CDS 58..381
  sig_peptide 58..114: score 9.2 seq ILFLVAAATGAHS/QL
  misc_feature 333: y=c or t
  misc_feature 344: y=c or t
  misc_feature 348: s=g or c
  misc_feature 351: y=c or t
  UNSURE 77: Xaa=Ile or Thr
atcacccaaaaaccacacccctccttgggagaatcccctagatcacagctcctcaccatggactggacctggagcatccttttcttggtggcagcagcaacaggtgcccactcccaacttcagctggtgcagtctggagctgaggtgaagaagcctggggcctcaatgaaagtctcctgccaggcttctgattacacctttttgaactttggtatcacgtgggtgcgacaggcccctggacaagggcttgagtggatgggatggatcagctttcacagtggtaatacaaactatgcagagaacttccagggcagaggcgccattagcgcagayacatccacgaytacsgcytacatcgaggtgaggagcctcagatctgacg

SEQ ID NO: 38 - DNA, 420 bp, Homo sapiens
  CDS 58..420
  sig_peptide 58..114: score 10.8 seq ILFLVAAATGAHS/QV
  misc_feature 139: r=a or g
  misc_feature 140: s=g or c
  misc_feature 184: r=a or g
  misc_feature 210: y=c or t
  misc_feature 212: n=a, g, c or t
  misc_feature 213: y=c or t
  misc_feature 246: w=a or t
  misc_feature 271: r=a or g
  misc_feature 272: s=g or c
  misc_feature 279: w=a or t
  misc_feature 285: s=g or c
  misc_feature 291: y=c or t
  misc_feature 303: r=a or g
  misc_feature 316: s=g or c
  misc_feature 322: w=a or t
  misc_feature 345: y=c or t
  misc_feature 360: s=g or c
  misc_feature 361: y=c or t
  UNSURE 9: Xaa=Ala or Gly or Ser or Thr
  UNSURE 24: Xaa=Ala or Thr
  UNSURE 33: Xaa=Ala or Asp or Gly or Val
  UNSURE 53: Xaa=Ala or Gly or Ser or Thr
  UNSURE 55: Xaa=Lys or Asn
  UNSURE 57: Xaa=Lys or Asn
  UNSURE 68: Xaa=Leu or Val
  UNSURE 70: Xaa=Leu or Met
  UNSURE 82: Xaa=Asp or Glu
atcacccaaaaaccacacccctccttgggagaatcccctagatcacagctcctcaccatggactggacctggagcatccttttcttggtggcagcagcaacaggtgcccactcccaggttcagctggtgcagtctggarstgaggtgaagaagcctggggcctcagtgaaggtctcctgcaagrcctctggttacacctttaccagttaygnyatcagctgggtgcgacaggcccctggacaaggwcttgagtggatgggatggatcagcrsttacaawggtaasacagaytatgcacagaarttccagggcagastcaccwtgaccacagacacatccacgaayattgcctacatggasytgaggaacctgagatctgacgacacggccttctattactgtgtgagaggccatcttgga

SEQ ID NO: 39 - DNA, 471 bp, Homo sapiens
  CDS 52..471
  sig_peptide 52..108: score 10.8 seq ILFLVAAATGAHS/QV
  misc_feature 26: m=a or c
  misc_feature 44: k=g or t
  misc_feature 48: y=c or t
  misc_feature 191: y=c or t
  misc_feature 200: r=a or g
  misc_feature 201: y=c or t
  misc_feature 203: m=a or c
  misc_feature 210: n=a, g, c or t
  misc_feature 237: r=a or g
  misc_feature 240: r=a or g
  misc_feature 255: r=a or g
  misc_feature 272: m=a or c
  misc_feature 277: w=a or t
  misc_feature 279: m=a or c
  misc_feature 284: w=a or t
  misc_feature 297: s=g or c
  misc_feature 305: r=a or g
  misc_feature 316: w=a or t
  UNSURE 28: Xaa=Ile or Thr
  UNSURE 31: Xaa=Asn or Ser
  UNSURE 32: Xaa=Ser or Tyr
  UNSURE 34: Xaa=Ile or Met
  UNSURE 55: Xaa=Asn or Thr
  UNSURE 57: Xaa= *  or Lys or Asn or Tyr
  UNSURE 59: Xaa=Ile or Lys
  UNSURE 63: Xaa=Lys or Asn
  UNSURE 66: Xaa=Asp or Gly
  UNSURE 70: Xaa=Phe or Ile
acccaacaaccacatccctcctcagmagcccccagagcacaackcctyaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaycttcactarytmtgctatncattgggtgcgccaggcccccggacaragrcttgagtggatgggrtggatcaacgctgccamtggtwamacaawatattcacagaasttccaggrcagagtcaccwttaccagggacacatccgcgagcacagtctccatggagctgagcagcctgagatctgaagacacggctgtgtatttctgtgcgagagattgggaaattgcagtagtaccaactgctataaactcttacgggttcgaccctggggccagggaacct

SEQ ID NO: 40 - DNA, 429 bp, Homo sapiens
  CDS 83..427
  sig_peptide 83..139: score 13.3 seq LALLLAVLQGVCA/EV
  misc_feature 40: s=g or c
aaacccagggctcccctccacagtgagtctccctcactgsccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggtgttggatacaattttgccggctggtggatcggctgggtgcgccagatgcccggggaaggcctggagttgatggggctcgtctatcctcttgactctaataccgcatatagtccgtccttcaaagaccacgtcaccatctcagccgacaggtccctcagcaccgcctacctgcagtggatcagcctgaagcctcggacaccgccatatattactgtgtg

SEQ ID NO: 41 - DNA, 326 bp, Homo sapiens
  CDS 83..325
  sig_peptide 83..139: score 13.3 seq LALLLAVLQGVCA/EV
  misc_feature 73: y=c or t
  misc_feature 92: r=a or g
  UNSURE -16: Xaa=Ala or Thr
aaacccagggctcccctccacagtgagtctccctcactgcccagctgggatctcagggcttcattttctgtcytccaccatcatggggtcarccgccatcctcgccctcctcctggctgttctccaaggagtctgtgccgaggtgcacctggtgcagtctggcgcagagctgaaaaagccgggggagtctctgacgatctcctgtaagggctctggatacgagttcggcactcactggatcggctgggtgcgccagatgcccgggaaaggtctggagtggatggggatcatctaccctgatgactctgataccagatacaacccgt

SEQ ID NO: 42 - DNA, 369 bp, Homo sapiens
  CDS 83..367
  sig_peptide 83..139: score 12.7 seq LALLLAVLQGVCG/EE
  misc_feature 63: w=a or t
  misc_feature 319: s=g or c
  UNSURE 60: Xaa= *  or Tyr
aaacccagggctcccctccacagtgagtctccctcactgcccagctgggatctcagggcttcwttttctgtcctccaccatcatggggtcaaccgccatcctcgccctcctcctggcagttctccaaggagtctgtggcgaggagcagctggtgcagtctggagcagaggtgaaaaagcccggggagtctctgaggatatcctgtacggggtctggatactcctttaccagtcattggatcggctgggtgcgccagatgcccggtactggcctggagtggacggcgatcatctatcctgatgactctgataccaagtasagtccgtcgttccaaggccaagtcactatctcagccgacaagtccaccaa

SEQ ID NO: 43 - DNA, 372 bp, Homo sapiens
  CDS 83..370
  sig_peptide 83..139: score 13.3 seq LALLLAVLQGVCA/EV
  misc_feature 64: k=g or t
  misc_feature 73: y=c or t
  misc_feature 92: r=a or g
  misc_feature 329: n=a, g, c or t
  UNSURE -16: Xaa=Ala or Thr
  UNSURE 64: Xaa= *  or Gly or Arg
aaacccagggctcccctccacagtgagtctccctcactgcccagctgggatctcagggcttcaktttctgtcytccaccatcatggggtcarccgccatcctcgccctcctcctggctgttctccaaggcgtctgtgccgaggtgcagctggtgcagtctggagcagaggtgaaaaagcccggggagtctctgaagatctcttgtaaggcctctggattaagccttatcgactgggttggctgggtgcgccagaagcccgggaagggcctggagtggatggggatcatctatattggtgattctgataccagatacagcccgtccttcngaaggccaggtcaccatctcagccgacaagtccatcagcaccg

SEQ ID NO: 44 - DNA, 323 bp, Homo sapiens
  CDS 83..322
  sig_peptide 83..139: score 13.3 seq LALLLXVLQGVCA/EV
  misc_feature 73: y=c or t
  misc_feature 116: r=a or g
  UNSURE -8: Xaa=Ala or Thr
aaacccagggctcccctccacagtgagtctccctcactgcccagctgggatctcagggcttcattttctgtcytccaccatcatggggtcagccgccatcctcgccctcctcctgrctgttctgcaaggagtctgtgccgaagtgcagctggtgcagtctgggccagaggtgaaaaagcccggagagtctctgaagatctcttgtgaggtttctggatacacctttaatttttactggctcgcctgggtccgccagaggcccggaaaaggcttggagtggatgggagccatccgtcctggttactttggttccgcatacagcc

SEQ ID NO: 45 - DNA, 441 bp, Homo sapiens
  CDS 59..439
  sig_peptide 59..115: score 9.7 seq ILFLVAAATSAHS/QV
  misc_feature 11: r=a or g
  misc_feature 17: w=a or t
atcactcaacraccacwtctgtcctctagagaaaaccctgtgagcacagctcctcaccatggactggacctggaggatcctcttcttggtggcagcagctacaagtgcccactcccaggtgcagctggtgcagtctgggactgaagtgagggggcctggggcctcagtgaaggtctcctgtaaggcttctggatacaccttcgtcagttatgatatcaactgggtacgacaggccgctggacaagggcttgagtggatgggatggatgaatcctttcagtggtgactcaggctttgcacagaacttccagggcagagtcaccttgaccaggaactcctccataggcacagcctacatggaactgaccagcctcagatctgacgacacggccgtctattactgtgcgcgaggccggggctacactcactactacttcttcga

SEQ ID NO: 46 - DNA, 327 bp, Homo sapiens
  CDS 18..326
  sig_peptide 18..74: score 10.6 seq TLLLLTXPSWVLS/QX
  misc_feature 34: m=a or c
  misc_feature 38: r=a or g
  misc_feature 54: r=a or g
  misc_feature 55: y=c or t
  misc_feature 62: m=a or c
  misc_feature 78: r=a or g
  misc_feature 84: y=c or t
  misc_feature 93: w=a or t
  misc_feature 103: y=c or t
  misc_feature 104: s=g or c
  misc_feature 111: r=a or g
  UNSURE -14: Xaa=Ser or Tyr
  UNSURE -7: Xaa=Ala or Ile or Thr or Val
  UNSURE 2: Xaa=Ile or Val
  UNSURE 7: Xaa=Ser or Thr
  UNSURE 10: Xaa=Ala or Val
  UNSURE 13: Xaa=Glu or Lys
gactcctgtgccccaccatggacacactttgctmcacrctcctgctgctgaccrycccttcmtgggtcttgtcccagrtcaccytgaaggagwctggtcctgysctggtgraacccacacagaccctcacgctgacctgcaccttctctgggttctcactcaggactagtggagagggtgtgggctggatccgtcagcccccaggcaaggccctggaatggcttgcactcatttattgggatgatgataagcgctatagaccatctctgaaaaccaggctcaccatcaccaaggacacctccaaaaaccaggtggtcctaacaatga

SEQ ID NO: 47 - DNA, 276 bp, Homo sapiens
  CDS 18..275
  sig_peptide 18..74: score 10.7 seq TLLLLTTPSWVLS/QV
gactcctgtgccccaccatggacacactttgctacacactcctgctgctgaccaccccttcctgggtcttgtcccaggtcaccttgaaggagtctggtcctgtgctggtgaaacccacagagaccctcacgctgacctgcaccgtctctgggttctcactcaacaatgctggaatgggtgtgagctgggtccgtcagcccccagggaaggccctggagtggcttgcacacgagtatccgcatgaccaaagatcctacaacacatctctgagcggcc

SEQ ID NO: 48 - DNA, 361 bp, Homo sapiens
  CDS 63..359
  sig_peptide 63..119: score 10.8 seq ILFLVAAATGAHS/QV
  misc_feature 27: n=a, g, c or t
  misc_feature 46: s=g or c
  misc_feature 107: m=a or c
  misc_feature 127: r=a or g
  misc_feature 128: r=a or g
  misc_feature 132: s=g or c
  misc_feature 157: r=a or g
  misc_feature 170: w=a or t
  misc_feature 185: y=c or t
  misc_feature 189: r=a or g
  misc_feature 201: r=a or g
  misc_feature 208: s=g or c
  misc_feature 211: k=g or t
  misc_feature 228: s=g or c
  misc_feature 230: s=g or c
  misc_feature 233: m=a or c
  misc_feature 266: w=a or t
  misc_feature 272: s=g or c
  UNSURE 3: Xaa=Gln or Arg
  UNSURE 5: Xaa=Leu or Val
  UNSURE 13: Xaa=Lys or Arg
  UNSURE 24: Xaa=Ala or Thr
  UNSURE 28: Xaa=Ala or Thr
  UNSURE 30: Xaa=Ser or Thr
  UNSURE 31: Xaa=Gly or Val
  UNSURE 37: Xaa=Leu or Val
  UNSURE 51: Xaa=Ile or Met
gagcatcacccagcaaccacatctgtnctctagagaatcccctgasagctccgttcctcaccatggactggacctggaggatcctcttcttggtggcagcagccacmggagcccactcccaggtgcrrctgstgcaatctggggctgaggtgaagargcctggggcctcwgtgaaggtctcctgyaagrcttctggatacrccttcascgkctactatatacactggstscgmcaggcccctggacaagggcttgagtggatgggwcggatsaatcctaaggatggtgcccccaactatgcaccgaactttgaaggcagggtcaccatgaccagggacacgtccatcaccacagcgtacat

SEQ ID NO: 49 - DNA, 419 bp, Homo sapiens
  CDS 63..419
  sig_peptide 63..119: score 10.8 seq ILFLXAAATGAHS/QV
  misc_feature 31: k=g or t
  misc_feature 46: s=g or c
  misc_feature 94: y=c or t
  misc_feature 137: r=a or g
  misc_feature 158: r=a or g
  misc_feature 189: r=a or g
  misc_feature 194: k=g or t
  misc_feature 201: r=a or g
  misc_feature 204: y=c or t
  misc_feature 213: y=c or t
  misc_feature 215: y=c or t
  misc_feature 217: w=a or t
  misc_feature 219: m=a or c
  misc_feature 221: r=a or g
  misc_feature 233: m=a or c
  misc_feature 251: s=g or c
  misc_feature 267: y=c or t
  misc_feature 310: w=a or t
  misc_feature 347: n=a, g, c or t
  misc_feature 359: s=g or c
  misc_feature 377: w=a or t
  misc_feature 381: k=g or t
  misc_feature 386: s=g or c
  misc_feature 416: k=g or t
  UNSURE -9: Xaa=Ala or Val
  UNSURE 24: Xaa=Ala or Thr
  UNSURE 28: Xaa=Ala or Thr
  UNSURE 29: Xaa=Phe or Leu
  UNSURE 32: Xaa=His or Tyr
  UNSURE 33: Xaa=Phe or Tyr
  UNSURE 34: Xaa=Ile or Leu or Met
  UNSURE 50: Xaa=Arg or Trp
  UNSURE 64: Xaa=Phe or Tyr
  UNSURE 76: Xaa=Ile or Met
  UNSURE 80: Xaa= *  or Tyr
  UNSURE 88: Xaa=Ala or Ser
  UNSURE 89: Xaa=Asp or Glu
  UNSURE 99: Xaa=Asp or Glu
gagcatcacccagcaaccacatctgtcctckagagaatcccctgasagctccgttcctcaccatggactggacctggaggatcctcttcttggyggcagcagccacaggagcccactcccaggtgcggctggtgcartctggggctgaggtgaagaarcctggggcctcagtgaaggtctcctgcaagrcttckggatacrccytcaccggcyaytwtmtrcactggctgcgmcaggcccctggacaaggscttgagtggatgggayggatcaatccgaggactggtggcactaagtccgcacagaagtwtagggacttcctcaccatgaccagggatgcgcccatnaacacggcctasatggaattgactggactwagakctgasgaaacggccacttatttctgtgcgagagakcaa

SEQ ID NO: 50 - DNA, 359 bp, Homo sapiens
  CDS 62..358
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgagtccacgaccacagtctacatgcagctgagcagcctaacatctgaagacacggccgtctattactgtgcgagagaggcgcgggaatggcagtggctggtgt

SEQ ID NO: 51 - DNA, 367 bp, Homo sapiens
  CDS 62..367
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgagtccacgaccacagtctacatgcagctgagcagcctaacatctgaagacacggccgtctattactgtgcgagagattccgcttcggtggtgatggccaatggactgggc

SEQ ID NO: 52 - DNA, 492 bp, Homo sapiens
  CDS 62..490
  sig_peptide 62..118: score 9.9 seq FLFVVAAATGVQS/QV
  misc_feature 174: m=a or c
  misc_feature 175: r=a or g
  misc_feature 179: k=g or t
  misc_feature 184: y=c or t
  misc_feature 201: s=g or c
  misc_feature 203: y=c or t
  misc_feature 208: m=a or c
  misc_feature 211: y=c or t
  misc_feature 273: y=c or t
  misc_feature 277: n=a, g, c or t
  misc_feature 278: n=a, g, c or t
  misc_feature 283: w=a or t
  misc_feature 286: n=a, g, c or t
  misc_feature 290: k=g or t
  misc_feature 296: w=a or t
  misc_feature 378: r=a or g
  misc_feature 385: m=a or c
  misc_feature 388: m=a or c
  misc_feature 403: s=g or c
  misc_feature 404: w=a or t
  misc_feature 405: y=c or t
  misc_feature 448: r=a or g
  misc_feature 453: w=a or t
  misc_feature 463: r=a or g
  UNSURE 19: Xaa=Lys or Thr
  UNSURE 21: Xaa=Ala or Ser
  UNSURE 28: Xaa=Ser or Thr
  UNSURE 29: Xaa=Phe or Leu
  UNSURE 30: Xaa=Arg or Ser
  UNSURE 52: Xaa=Ile or Thr
  UNSURE 54: Xaa=Phe or Ile or Leu or Val
  UNSURE 55: Xaa=Phe or Leu
  UNSURE 58: Xaa=Ala or Ser
  UNSURE 60: Xaa=Asn or Tyr
  UNSURE 87: Xaa=Lys or Arg
  UNSURE 89: Xaa=Asp or Glu
  UNSURE 90: Xaa=Asp or Glu
  UNSURE 95: Xaa= *  or Tyr
  UNSURE 96: Xaa=Phe or Ile or Ser or Thr
  UNSURE 110: Xaa=Ile or Met
  UNSURE 112: Xaa=Asp or Val
agcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgamrgtckcctgyaaggcttctggaggcascytcagmagytatggtatcagctgggtgcgacaggcccctggacaagggcttgagtggatgggagggatcaycccnntcttwggnacakcaaacwacgcacagaagttccagggcagagtcacgattaccgcggacgaatccacgaacacagtctatatggagctcaacagcctgaratctgamgamacggccgtctattaswytgcgagtcgtgtcgtggctggaggactggtcttctacgctatrgacgwctggggccarggaccacggtcaccgtctcctcagcttcc

SEQ ID NO: 53 - DNA, 425 bp, Homo sapiens
  CDS 62..424
  sig_peptide 62..118: score 9.9 seq FLFVVAAATGVQS/QV
  misc_feature 124: s=g or c
  misc_feature 207: n=a, g, c or t
  misc_feature 210: s=g or c
  misc_feature 215: r=a or g
  misc_feature 218: w=a or t
  misc_feature 250: m=a or c
  misc_feature 288: m=a or c
  misc_feature 316: s=g or c
  UNSURE 30: Xaa=Ile or Asn or Ser or Thr
  UNSURE 31: Xaa=Ser or Thr
  UNSURE 33: Xaa=Ala or Thr
  UNSURE 34: Xaa=Phe or Ile
  UNSURE 57: Xaa=Lys or Thr
agcatcacataacaaccacattcctcctctaaagaagcccctgggagcacagctcatcaccatggactggacctggaggttcctctttgtggtggcagcagctacaggtgtccagtcccaggtscagctggtgcagtctggggctgaggtgaagaagcctgggtcctcggtgaaggtctcctgcaaggcttctggaggcaccttcancasctatrctwtcagctgggtgcgacaggcccctggacaaggmcttgagtggatgggagggatcatccctatctttggtamaacaaactacgcacagaagttccagggsagagtcacgatgaccgcggacgaatccacaaccacagtctacatggaactgagccgcctgacatctgaggacacggccgtgtattactgtgcgagagacattaacagag

SEQ ID NO: 54 - DNA, 411 bp, Homo sapiens
  CDS 62..409
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  misc_feature 297: r=a or g
  misc_feature 304: m=a or c
  misc_feature 307: m=a or c
  misc_feature 322: s=g or c
  misc_feature 323: w=a or t
  misc_feature 324: y=c or t
  misc_feature 367: r=a or g
  misc_feature 372: w=a or t
  misc_feature 382: r=a or g
  UNSURE 2: Xaa=Ile or Met or Val
  UNSURE 5: Xaa=Leu or Val
  UNSURE 60: Xaa=Lys or Arg
  UNSURE 62: Xaa=Asp or Glu
  UNSURE 63: Xaa=Asp or Glu
  UNSURE 68: Xaa= *  or Tyr
  UNSURE 69: Xaa=Phe or Ile or Ser or Thr
  UNSURE 83: Xaa=Ile or Met
  UNSURE 85: Xaa=Asp or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgaatccacgaacacagtctatatggagctcaacagcctgaratctgamgamacggccgtctattaswytgcgagtcgtgtcgtggctggaggactggtcttctacgctatrgacgwctggggccarggaccacggtcaccgtctcctcagcttcc

SEQ ID NO: 55 - DNA, 407 bp, Homo sapiens
  CDS 62..406
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  misc_feature 258: r=a or g
  misc_feature 267: s=g or c
  misc_feature 272: r=a or g
  misc_feature 314: s=g or c
  UNSURE 2: Xaa=Ile or Met or Val
  UNSURE 5: Xaa=Leu or Val
  UNSURE 47: Xaa=Glu or Gly
  UNSURE 50: Xaa=Ser or Thr
  UNSURE 52: Xaa=Ala or Thr
  UNSURE 66: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgratccacgascacarcctacatggagctgagcagcctgagatctgaggacacggccstgtattactgtgcgagaggtcaagcccccggtagggtagtagtaccacttttcctctggggccagggaacctggtcaccgtctcctcagcctc

SEQ ID NO: 56 - DNA, 448 bp, Homo sapiens
  CDS 62..448
  sig_peptide 62..118: score 9.9 seq FLFVVAAATGVQS/QV
  misc_feature 218: r=a or g
  misc_feature 222: n=a, g, c or t
  misc_feature 266: r=a or g
  misc_feature 268: r=a or g
  misc_feature 277: n=a, g, c or t
  misc_feature 281: y=c or t
  misc_feature 286: n=a, g, c or t
  misc_feature 289: r=a or g
  misc_feature 295: s=g or c
  misc_feature 299: s=g or c
  misc_feature 307: r=a or g
  UNSURE 34: Xaa=Ile or Val
  UNSURE 35: Xaa=Ile or Asn or Ser or Thr
  UNSURE 50: Xaa=Gly or Arg
  UNSURE 55: Xaa=Phe or Leu
  UNSURE 59: Xaa=Lys or Asn
  UNSURE 61: Xaa=Ala or Pro
agcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttctggaggcaccttcagcaactatgctrtcanctgggtgcgacaggcccctggacaagggcttgagtggatgggargratcaccccnatcyttggnacrgcaaastacscacagaarttccagggcagaatcaccattaccgcggacgaatccaccagtacagcgtacatggaactgactggtctgaaatctgacgacacggccgtctattactgtgcgagagattccgcttcggtggtgatggccaatggactgggc

SEQ ID NO: 57 - DNA, 441 bp, Homo sapiens
  CDS 62..439
  sig_peptide 62..118: score 9.9 seq FLFVVAAATGVQS/QV
  misc_feature 127: r=a or g
  misc_feature 210: s=g or c
  misc_feature 211: y=c or t
  misc_feature 242: r=a or g
  misc_feature 243: s=g or c
  misc_feature 269: r=a or g
  misc_feature 290: s=g or c
  misc_feature 293: m=a or c
  misc_feature 307: s=g or c
  misc_feature 320: n=a, g, c or t
  misc_feature 322: s=g or c
  misc_feature 324: s=g or c
  UNSURE 31: Xaa=Ser or Thr
  UNSURE 42: Xaa=Ala or Gly or Arg or Thr
  UNSURE 51: Xaa=Ile or Val
  UNSURE 58: Xaa=Ala or Pro
  UNSURE 59: Xaa=His or Asn
  UNSURE 63: Xaa=Lys or Asn
  UNSURE 68: Xaa=Phe or Ile or Leu or Met or Val
  UNSURE 69: Xaa=Arg or Thr
agcatcacataacaaccacattcctcctctaaagaagcccctgggagcacagctcatcaccatggactggacctggaggttcctctttgtggtggcagcagctacaggtgtccagtcccaggtgcarctggtgcagtctggggctgaggtgaagaagcctgggtcctcggtgaaggtctcctgcaaggcttctggaggcaccttcaacasytatgctatcagctgggtgcgacaggcccctrsacaagggcttgagtggatgggagggrtcaccccaatctttgggacascamactacgcacagaasttccagggcagantsasgattaccgcggacgaatccacgagcagagtctacatggagttgagcagcccgagatctgaggacacggccgtctattactgtgtgagctcctccacagagtgtggtcgtgattgcta

SEQ ID NO: 58 - DNA, 344 bp, Homo sapiens
  CDS 62..343
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgaatccacaaccacagtctacatggaactgagccgcctgacatctgaggacacggccgtgtattactgtgcgagagacattaacagag

SEQ ID NO: 59 - DNA, 360 bp, Homo sapiens
  CDS 62..358
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgaatccacgagcagagtctacatggagttgagcagcccgagatctgaggacacggccgtctattactgtgtgagctcctccacagagtgtggtcgtgattgcta

SEQ ID NO: 60 - DNA, 374 bp, Homo sapiens
  CDS 62..373
  sig_peptide 62..118: score 8.3 seq FLFVVAAATXVQS/QX
  misc_feature 7: w=a or t
  misc_feature 19: s=g or c
  misc_feature 108: r=a or g
  misc_feature 123: k=g or t
  misc_feature 143: k=g or t
  misc_feature 156: r=a or g
  misc_feature 184: y=c or t
  misc_feature 188: r=a or g
  misc_feature 196: r=a or g
  misc_feature 201: y=c or t
  misc_feature 203: y=c or t
  misc_feature 208: y=c or t
  misc_feature 210: s=g or c
  misc_feature 211: y=c or t
  misc_feature 216: s=g or c
  misc_feature 222: s=g or c
  misc_feature 223: s=g or c
  misc_feature 265: r=a or g
  misc_feature 335: n=a, g, c or t
  misc_feature 336: k=g or t
  misc_feature 337: n=a, g, c or t
  misc_feature 351: s=g or c
  misc_feature 354: s=g or c
  UNSURE -4: Xaa=Asp or Gly
  UNSURE 2: Xaa=Gly or Val
  UNSURE 9: Xaa=Ala or Ser
  UNSURE 13: Xaa=Lys or Arg
  UNSURE 24: Xaa=Ala or Thr
  UNSURE 28: Xaa=Ile or Thr
  UNSURE 29: Xaa=Phe or Leu
  UNSURE 31: Xaa=Ser or Thr
  UNSURE 33: Xaa=Ala or Gly
  UNSURE 35: Xaa=Arg or Ser or Thr
  UNSURE 73: Xaa= *  or Cys or Phe or Gly or Ile or Leu or Met or Arg or Ser or Val or Trp
  UNSURE 78: Xaa=Arg or Thr
  UNSURE 79: Xaa=Ala or Gly
agcatcwcacaacaaccasattcctcctctaaagaagcccctgggagcacagctcatcaccatggactggacctggaggttcctctttgtggtggcagcagctacagrtgtccagtcccaggkccagctggtgcagtctgggkctgaggtgaagargcctgggtcctcggtgaaggtctcctgyaagrcttctggrggcaycytcagyasyaatgscatcasstgggtgcgacaggcccctggacaagggcttgagtggatgggraggatcatccccatggttgaaaaagcggacaccgcacagaagttccagggcagactcactattagtacanknctatcgacgagcasagscttcatggaactgagcagtc

SEQ ID NO: 61 - DNA, 440 bp, Homo sapiens
  CDS 62..439
  sig_peptide 62..118: score 9.4 seq FLFVVAAATGVQS/QX
  misc_feature 10: k=g or t
  misc_feature 123: k=g or t
  misc_feature 124: s=g or c
  misc_feature 125: s=g or c
  misc_feature 127: s=g or c
  misc_feature 163: s=g or c
  misc_feature 175: r=a or g
  misc_feature 176: r=a or g
  misc_feature 193: y=c or t
  misc_feature 196: r=a or g
  misc_feature 201: y=c or t
  misc_feature 203: y=c or t
  misc_feature 206: m=a or c
  misc_feature 209: r=a or g
  misc_feature 212: s=g or c
  misc_feature 217: s=g or c
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
agcatcacakaacaaccacattcctcctctaaagaagcccctgggagcacagctcatcaccatggactggacctggaggttcctctttgtggtggcagcagctacaggtgtccagtcccaggkssasctggtgcagtctggggctgaggtgaagaagcctggstcctcggtgaarrtctcctgcaaggcttcyggrggcaycytcmgcracsatggsatcagctgggtgcgacaggcccctggacagggcctggagtggatgggagacatcatccctatttatgatctggtaaactatgcacagaaattccagggcagagtcacgattaccgcgcacaaatccacaaccacagcctacatggaggtgattagcctgacctctgaagacacggccgtgtattactgtgcgagagaggcgcgggaatggcagtggctggtgt

SEQ ID NO: 62 - DNA, 448 bp, Homo sapiens
  CDS 62..448
  sig_peptide 62..118: score 9.4 seq FLFVVAAATGVQS/QX
  misc_feature 10: k=g or t
  misc_feature 123: k=g or t
  misc_feature 124: s=g or c
  misc_feature 125: s=g or c
  misc_feature 127: s=g or c
  misc_feature 163: s=g or c
  misc_feature 175: r=a or g
  misc_feature 176: r=a or g
  misc_feature 193: y=c or t
  misc_feature 196: r=a or g
  misc_feature 201: y=c or t
  misc_feature 203: y=c or t
  misc_feature 206: m=a or c
  misc_feature 209: r=a or g
  misc_feature 212: s=g or c
  misc_feature 217: s=g or c
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
agcatcacakaacaaccacattcctcctctaaagaagcccctgggagcacagctcatcaccatggactggacctggaggttcctctttgtggtggcagcagctacaggtgtccagtcccaggkssasctggtgcagtctggggctgaggtgaagaagcctggstcctcggtgaarrtctcctgcaaggcttcyggrggcaycytcmgcracsatggsatcagctgggtgcgacaggcccctggacagggcctggagtggatgggagacatcatccctatttatgatctggtaaactatgcacagaaattccagggcagagtcacgattaccgcgcacaaatccacaaccacagcctacatggaggtgattagcctgacctctgaagacacggccgtgtattactgtgcgagagattccgcttcggtggtgatggccaatggactgggc

SEQ ID NO: 63 - DNA, 425 bp, Homo sapiens
  CDS 62..424
  sig_peptide 62..118: score 9.4 seq FLFVVAAATGVQS/QX
  misc_feature 10: k=g or t
  misc_feature 123: k=g or t
  misc_feature 124: s=g or c
  misc_feature 125: s=g or c
  misc_feature 127: s=g or c
  misc_feature 163: s=g or c
  misc_feature 175: r=a or g
  misc_feature 176: r=a or g
  misc_feature 193: y=c or t
  misc_feature 196: r=a or g
  misc_feature 201: y=c or t
  misc_feature 203: y=c or t
  misc_feature 206: m=a or c
  misc_feature 209: r=a or g
  misc_feature 212: s=g or c
  misc_feature 217: s=g or c
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
agcatcacakaacaaccacattcctcctctaaagaagcccctgggagcacagctcatcaccatggactggacctggaggttcctctttgtggtggcagcagctacaggtgtccagtcccaggkssasctggtgcagtctggggctgaggtgaagaagcctggstcctcggtgaarrtctcctgcaaggcttcyggrggcaycytcmgcracsatggsatcagctgggtgcgacaggcccctggacagggcctggagtggatgggagacatcatccctatttatgatctggtaaactatgcacagaaattccagggcagagtcacgattaccgcgcacaaatccacaaccacagcctacatggaggtgattagcctgacctctgaagacacggccgtgtattactgtgcgagagacattaacagag

SEQ ID NO: 64 - DNA, 488 bp, Homo sapiens
  CDS 62..487
  sig_peptide 62..118: score 9.4 seq FLFVVAAATGVQS/QX
  misc_feature 10: k=g or t
  misc_feature 123: k=g or t
  misc_feature 124: s=g or c
  misc_feature 125: s=g or c
  misc_feature 127: s=g or c
  misc_feature 163: s=g or c
  misc_feature 175: r=a or g
  misc_feature 176: r=a or g
  misc_feature 193: y=c or t
  misc_feature 196: r=a or g
  misc_feature 201: y=c or t
  misc_feature 203: y=c or t
  misc_feature 206: m=a or c
  misc_feature 209: r=a or g
  misc_feature 212: s=g or c
  misc_feature 217: s=g or c
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
agcatcacakaacaaccacattcctcctctaaagaagcccctgggagcacagctcatcaccatggactggacctggaggttcctctttgtggtggcagcagctacaggtgtccagtcccaggkssasctggtgcagtctggggctgaggtgaagaagcctggstcctcggtgaarrtctcctgcaaggcttcyggrggcaycytcmgcracsatggsatcagctgggtgcgacaggcccctggacagggcctggagtggatgggagacatcatccctatttatgatctggtaaactatgcacagaaattccagggcagagtcacgattaccgcgcacaaatccacaaccacagcctacatggaggtgattagcctgacctctgaagacacggccgtgtattactgtgcgagaggtcaagcccccggtagggtagtagtaccacttttcctctggggccagggaacctggtcaccgtctcctcagcctc

SEQ ID NO: 65 - DNA, 370 bp, Homo sapiens
  CDS 62..370
  sig_peptide 62..118: score 9.9 seq FLFVVAAATGVQS/QV
  misc_feature 124: s=g or c
  misc_feature 133: k=g or t
  misc_feature 143: k=g or t
  misc_feature 148: r=a or g
  misc_feature 196: r=a or g
  misc_feature 201: y=c or t
  misc_feature 203: y=c or t
  misc_feature 207: r=a or g
  misc_feature 210: y=c or t
  misc_feature 212: w=a or t
  misc_feature 217: w=a or t
  misc_feature 222: s=g or c
  misc_feature 275: n=a, g, c or t
  misc_feature 276: n=a, g, c or t
  misc_feature 309: n=a, g, c or t
  misc_feature 310: r=a or g
  misc_feature 348: n=a, g, c or t
  UNSURE 9: Xaa=Ala or Ser
  UNSURE 28: Xaa=Ile or Thr
  UNSURE 29: Xaa=Phe or Leu
  UNSURE 30: Xaa=Asn or Ser
  UNSURE 31: Xaa=Ile or Thr
  UNSURE 32: Xaa=Ser or Thr
  UNSURE 35: Xaa=Ser or Thr
  UNSURE 53: Xaa=Ala or Cys or Asp or Phe or Gly or His or Ile or Leu or Asn or Pro or Arg or Ser or Thr or Val or Tyr
  UNSURE 64: Xaa= *  or Leu or Ser or Trp
  UNSURE 77: Xaa=Ile or Asn or Ser or Thr
agcatcacataacaaccacattcctcctctaaagaagcccctgggagcacagctcatcaccatggactggacctggaggttcctctttgtggtggcagcagctacaggtgtccagtcccaggtscagctggtkcagtctgggkctgargtgaagaagcctgggtcctcggtgagggtctcctgcaaggcttctggrggcaycytcarcaycwctgcwgtcasctgggtgcgacaggcccctggacaaggacttgagtgggtggggaggctcatcnntgttcttaatgtggcacactatgcacagaaatnrcaggacagagtcaccattacggcggacaagtccacgancacagcctacatggaattgcgc

SEQ ID NO: 66 - DNA, 235 bp, Homo sapiens
  CDS 62..235
  sig_peptide 62..118: score 10.2 seq FLFVVAAAXGVQS/QV
  misc_feature 104: w=a or t
  misc_feature 175: r=a or g
  misc_feature 176: r=a or g
  UNSURE -5: Xaa=Ser or Thr
  UNSURE 20: Xaa=Ile or Val
agcatcacataacaaccacattcctcctctaaagaagcccctgggagcacagctcatcaccatggactggacctggaggttcctctttgtggtggcagcagctwcaggtgtccagtcccaggtgcagctggtgcagtctggggctgaggtgaagaagcctgggtcctcggtgaarrtctcctgcgaggctactggagtcgatgtgaaaaaatatggttttagttgggtgagacag

SEQ ID NO: 67 - DNA, 425 bp, Homo sapiens
  CDS 62..424
  sig_peptide 62..118: score 9.3 seq FLFVVAAATGVQX/QX
  misc_feature 100: w=a or t
  misc_feature 103: k=g or t
  misc_feature 117: s=g or c
  misc_feature 118: y=c or t
  misc_feature 123: y=c or t
  misc_feature 127: s=g or c
  misc_feature 140: r=a or g
  misc_feature 149: k=g or t
  misc_feature 161: s=g or c
  UNSURE -1: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
agcatcacataacaaccagattcctcctctaaagaagcccctgggagcacagctcatcaccatggactggacctggaggttcctctttgtggtggcagcwgckacaggtgtccagtsycaggyccasctggtgcagtctrgggctgagktgaagaagcctsggtcctcagtgagcgtctcctgcaagacttctggagacaccttcaggaggtttactatgagttgggtgcgacaggcccctggacaaggacttgagtggatgggaagggtcatccctatccttggttctccaacctacgcccagaagttccagggcagagtcaccattaccgcggacgagtccacgaccacagtctacatgcagctgagcagcctaacatctgaagacacggccgtctattactgtgcgagagacattaacagag

SEQ ID NO: 68 - DNA, 488 bp, Homo sapiens
  CDS 62..487
  sig_peptide 62..118: score 9.3 seq FLFVVAAATGVQX/QX
  misc_feature 100: w=a or t
  misc_feature 103: k=g or t
  misc_feature 117: s=g or c
  misc_feature 118: y=c or t
  misc_feature 123: y=c or t
  misc_feature 127: s=g or c
  misc_feature 140: r=a or g
  misc_feature 149: k=g or t
  misc_feature 161: s=g or c
  UNSURE -1: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
agcatcacataacaaccagattcctcctctaaagaagcccctgggagcacagctcatcaccatggactggacctggaggttcctctttgtggtggcagcwgckacaggtgtccagtsycaggyccasctggtgcagtctrgggctgagktgaagaagcctsggtcctcagtgagcgtctcctgcaagacttctggagacaccttcaggaggtttactatgagttgggtgcgacaggcccctggacaaggacttgagtggatgggaagggtcatccctatccttggttctccaacctacgcccagaagttccagggcagagtcaccattaccgcggacgagtccacgaccacagtctacatgcagctgagcagcctaacatctgaagacacggccgtctattactgtgcgagaggtcaagcccccggtagggtagtagtaccacttttcctctggggccagggaacctggtcaccgtctcctcagcctc

SEQ ID NO: 69 - DNA, 344 bp, Homo sapiens
  CDS 62..343
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcgcacaaatccacaaccacagcctacatggaggtgattagcctgacctctgaagacacggccgtgtattactgtgcgagagacattaacagag

SEQ ID NO: 70 - DNA, 359 bp, Homo sapiens
  CDS 62..358
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcgcacaaatccacaaccacagcctacatggaggtgattagcctgacctctgaagacacggccgtgtattactgtgcgagagaggcgcgggaatggcagtggctggtgt

SEQ ID NO: 71 - DNA, 301 bp, Homo sapiens
  CDS 62..301
  sig_peptide 62..118: score 9.9 seq FLFVVAAATGVQS/QV
  misc_feature 190: k=g or t
  misc_feature 198: n=a, g, c or t
  misc_feature 206: r=a or g
  misc_feature 210: m=a or c
  misc_feature 215: s=g or c
  misc_feature 218: n=a, g, c or t
  misc_feature 250: s=g or c
  misc_feature 254: s=g or c
  misc_feature 272: r=a or g
  misc_feature 273: w=a or t
  misc_feature 274: m=a or c
  UNSURE 27: Xaa=Ala or Asp or Gly or Val
  UNSURE 30: Xaa=Gly or Ser
  UNSURE 31: Xaa=Asn or Thr
  UNSURE 33: Xaa=Ala or Pro
  UNSURE 34: Xaa=Phe or Ile or Leu or Val
  UNSURE 46: Xaa=Glu or Gln
  UNSURE 52: Xaa=Asp or Glu or Ile or Lys or Asn or Val
agcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcktctggagncaccttcrgcamctatsctntcagctgggtgcgacaggcccctggacaaggscttsagtggatgggaaggatcrwmcctttggatggaatagtcaagtacgca

SEQ ID NO: 72 - DNA, 352 bp, Homo sapiens
  CDS 62..352
  sig_peptide 62..118: score 9.4 seq FLFVVAAATGVQS/QX
  misc_feature 12: r=a or g
  misc_feature 31: r=a or g
  misc_feature 103: w=a or t
  misc_feature 123: k=g or t
  misc_feature 124: m=a or c
  misc_feature 132: w=a or t
  misc_feature 133: r=a or g
  misc_feature 145: y=c or t
  misc_feature 196: r=a or g
  misc_feature 200: m=a or c
  misc_feature 203: y=c or t
  misc_feature 210: s=g or c
  misc_feature 221: r=a or g
  UNSURE 2: Xaa=Gly or Val
  UNSURE 5: Xaa=Glu or Val
  UNSURE 28: Xaa=Ile or Leu
  UNSURE 29: Xaa=Phe or Leu
  UNSURE 31: Xaa=Ser or Thr
  UNSURE 35: Xaa=Ala or Thr
agcatcacatarcaaccagattcctcctctraagaagcccctgggagcacagctcatcaccatggactggacctggaggttcctctttgtggtggcagcagcwacaggtgtccagtcccaggkmcagctggwrcagtctggggcygaggtgaagaagcctgggtcctcggtgaaggtctcctgcaaggcttctggrggcmtcytcacgascatgctatcarctgggtgcgacaggcccctggacaaggacttgagtggctgggaggctacatccctatttttgatacaccaaattacccaccggagttccaggacagagtcgcggtttcggtggacaaatccactaacacag

SEQ ID NO: 73 - DNA, 440 bp, Homo sapiens
  CDS 62..439
  sig_peptide 62..118: score 9.3 seq FLFVVAAATGVQX/QX
  misc_feature 100: w=a or t
  misc_feature 103: k=g or t
  misc_feature 117: s=g or c
  misc_feature 118: y=c or t
  misc_feature 123: y=c or t
  misc_feature 127: s=g or c
  misc_feature 140: r=a or g
  misc_feature 149: k=g or t
  misc_feature 161: s=g or c
  UNSURE -1: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
agcatcacataacaaccagattcctcctctaaagaagcccctgggagcacagctcatcaccatggactggacctggaggttcctctttgtggtggcagcwgckacaggtgtccagtsycaggyccasctggtgcagtctrgggctgagktgaagaagcctsggtcctcagtgagcgtctcctgcaagacttctggagacaccttcaggaggtttactatgagttgggtgcgacaggcccctggacaaggacttgagtggatgggaagggtcatccctatccttggttctccaacctacgcccagaagttccagggcagagtcaccattaccgcggacgagtccacgaccacagtctacatgcagctgagcagcctaacatctgaagacacggccgtctattactgtgcgagagaggcgcgggaatggcagtggctggtgt

SEQ ID NO: 74 - DNA, 448 bp, Homo sapiens
  CDS 62..448
  sig_peptide 62..118: score 9.3 seq FLFVVAAATGVQX/QX
  misc_feature 100: w=a or t
  misc_feature 103: k=g or t
  misc_feature 117: s=g or c
  misc_feature 118: y=c or t
  misc_feature 123: y=c or t
  misc_feature 127: s=g or c
  misc_feature 140: r=a or g
  misc_feature 149: k=g or t
  misc_feature 161: s=g or c
  UNSURE -1: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
agcatcacataacaaccagattcctcctctaaagaagcccctgggagcacagctcatcaccatggactggacctggaggttcctctttgtggtggcagcwgckacaggtgtccagtsycaggyccasctggtgcagtctrgggctgagktgaagaagcctsggtcctcagtgagcgtctcctgcaagacttctggagacaccttcaggaggtttactatgagttgggtgcgacaggcccctggacaaggacttgagtggatgggaagggtcatccctatccttggttctccaacctacgcccagaagttccagggcagagtcaccattaccgcggacgagtccacgaccacagtctacatgcagctgagcagcctaacatctgaagacacggccgtctattactgtgcgagagattccgcttcggtggtgatggccaatggactgggc

SEQ ID NO: 75 - DNA, 367 bp, Homo sapiens
  CDS 62..367
  sig_peptide 62..118: score 9.6 seq FLFVVAAATGVQS/QX
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  UNSURE 2: Xaa=Ile or Met or Val
  UNSURE 5: Xaa=Leu or Val
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcgcacaaatccacaaccacagcctacatggaggtgattagcctgacctctgaagacacggccgtgtattactgtgcgagagattccgcttcggtggtgatggccaatggactgggc

SEQ ID NO: 76 - DNA, 476 bp, Homo sapiens
  CDS 73..474
  sig_peptide 73..138: score 15.3 seq LLLLLTHLPLALG/SP
  misc_feature 377: n=a, g, c or t
  misc_feature 459: m=a or c
  UNSURE 80: Xaa=His or Leu or Pro or Arg
  UNSURE 107: Xaa= *  or Tyr
aggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcncaacaagttcgtgaccgtgcaggccaccttcgggacccaagtggtggagaaggtggtgctggtcagcctgcagagcgggtamctcttcatccagacaga

SEQ ID NO: 77 - DNA, 476 bp, Homo sapiens
  CDS 310..474
  sig_peptide 310..381: score 5.4 seq VYLTIFLLLSSLS/SY
  misc_feature 149: r=a or g
  misc_feature 150: r=a or g
aaaacgtcctgtagacacctggaccgcgagggcgcggttccctgcttctctaggggcccagacacggcgacggatcttgacgctttttcctccccacagacaaaaaacttggactttcgccgaaagtgggacaaagatgaatatgagarrctcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatctt

SEQ ID NO: 78 - DNA, 390 bp, Homo sapiens
  CDS 151..390
  sig_peptide 151..273: score 4 seq GLPFLPLLSTTLC/PF
tttttttttttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacatagggccctgggacttccctttctccctctcctctccaccaccctctgcccctttggcagccccggtctttggcggccccagctcagctgcacgagggttccctgcatgctctgggcactgtcggctaatcagagagtagcatcccttcaatcacagcccttcccc

SEQ ID NO: 79 - DNA, 1206 bp, Homo sapiens
  CDS 30..1205
  sig_peptide 30..77: score 10.1 seq LWTLSLLLGAVAG/KE
  misc_feature 512: y=c or t
  misc_feature 990: m=a or c
  misc_feature 1203: k=g or t
  UNSURE 305: Xaa=Pro or Thr
  UNSURE 376: Xaa= *  or Gly
ggcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcgattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaaygtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcmcacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcaatkgat

SEQ ID NO: 80 - DNA, 570 bp, Homo sapiens
  CDS 37..570
  sig_peptide 37..90: score 11.4 seq WTLGLLLLATVRG/KE
  misc_feature 427: s=g or c
  misc_feature 530: r=a or g
  misc_feature 569: n=a, g, c or t
  UNSURE 113: Xaa=Gly or Arg
  UNSURE 147: Xaa=Asp or Gly
  UNSURE 160: Xaa=Ala or Asp or Gly or Val
aacctgctgggctgtgagtggaagctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtccsgggcaatgtacacccaagccgtgcaaaacattcgggttgttggggcggagacagctttcttaatacaagcactgtcgacgcagctggggtacagccttgaggrcgtgcatgtcatcggccacagcctgggcgcgcacacggnc

SEQ ID NO: 81 - DNA, 400 bp, Homo sapiens
  CDS 37..399
  sig_peptide 37..90: score 11.4 seq WTLGLLLLATVRG/KE
aacctgctgggctgtgagtggaagctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccg

SEQ ID NO: 82 - DNA, 612 bp, Homo sapiens
  CDS 277..612
  sig_peptide 277..354: score 4.8 seq LIVLLGQFVSIKA/QE
  misc_feature 40: m=a or c
  misc_feature 61: m=a or c
  misc_feature 492: y=c or t
agaccgttgcttggcagacactggatggttatgagcctgmacaagctgaaaaggggcaggmaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgayaagatagaatgccaggatgtgctggactgtgccgaccctgtaacgccccctggggaatgctgtcctgtctgttcacaaacacctggaggtggcaatacaaattttggtagaggaagaaag

SEQ ID NO: 83 - DNA, 612 bp, Homo sapiens
  CDS 340..612
  sig_peptide 340..396: score 7.2 seq LIWTLFFLGTAVS/LQ
  misc_feature 36: m=a or c
  misc_feature 78: n=a, g, c or t
actatttgtggccggcgtggtggaaggacacagtgmggttctcacccccgccccccgctcctcgctcccatcccagtnccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcagggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgcc

SEQ ID NO: 84 - DNA, 478 bp, Homo sapiens
  CDS 57..476
  sig_peptide 57..101: score 4.9 seq ELVALLLLTLAYL/FW
  misc_feature 23: y=c or t
  misc_feature 194: y=c or t
  misc_feature 414: n=a, g, c or t
  UNSURE 105: Xaa=Asp or His or Asn or Tyr
acacacagctcttctactccacygctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacayggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcanactggcagctgcatcgaaggctggcgatggccacctttgcctgttcaaggatggcgatcagaag

SEQ ID NO: 85 - DNA, 395 bp, Homo sapiens
  CDS 96..395
  sig_peptide 96..143: score 8.5 seq AVLFSGALLGLLA/AQ
  misc_feature 7: n=a, g, c or t
atttttnttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccacc

SEQ ID NO: 86 - DNA, 459 bp, Homo sapiens
  CDS 54..458
  sig_peptide 54..104: score 13 seq VLCAVCLLPGSLA/LP
  misc_feature 283: r=a or g
  UNSURE 60: Xaa=His or Arg
aaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccrcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgt

SEQ ID NO: 87 - DNA, 452 bp, Homo sapiens
  CDS 89..451
  sig_peptide 89..193: score 4.1 seq ILSKMMLMSTATA/FY
agtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatt

SEQ ID NO: 88 - DNA, 276 bp, Homo sapiens
  CDS 110..274
  sig_peptide 110..184: score 6.3 seq AFSLSVMAALTFG/CF
  misc_feature 244: r=a or g
tcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcgratcatgctaaaaaatgtagaagatttcactgg

SEQ ID NO: 89 - DNA, 633 bp, Homo sapiens
  CDS 394..633
  sig_peptide 394..441: score 11.5 seq TIILLLLAQVSWA/GP
aaaaatttcaaatcaagttgctccactatactgcataagcagtttagaatcttaagcagatgcaaaaagaataaagcaaatgggaggaaaaaaaaggccgataaagtttctggctacaatacaagagacaatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccc

SEQ ID NO: 90 - DNA, 526 bp, Homo sapiens
  CDS 257..526
  sig_peptide 257..304: score 11.5 seq TIILLLLAQVSWA/GP
aaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaac

SEQ ID NO: 91 - DNA, 685 bp, Homo sapiens
  CDS 69..683
  sig_peptide 69..143: score 10.1 seq LLYVLLLAFCACA/VG
  misc_feature 39: s=g or c
tagagagccccggagccgcggcgggagaggaacgcgcascagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggt

SEQ ID NO: 92 - DNA, 343 bp, Homo sapiens
  CDS 69..341
  sig_peptide 69..143: score 10.1 seq LLYVLLLAFCACA/VG
tagagagccccggagccgcggcgggagaggaacgcgcaccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcgggccctttcagactgccaaatcattaacttcaatccttactctctgccaagcttc

SEQ ID NO: 93 - DNA, 492 bp, Homo sapiens
  CDS 317..490
  sig_peptide 317..412: score 4.7 seq RVLXLCNSRVSFT/RX
  misc_feature 115: k=g or t
  misc_feature 383: m=a or c
  misc_feature 415: n=a, g, c or t
  misc_feature 416: n=a, g, c or t
  misc_feature 437: w=a or t
  UNSURE -10: Xaa=Ile or Leu
  UNSURE 2: Xaa=Phe or Ile or Leu or Val
  UNSURE 9: Xaa=Asn or Tyr
taaggatattacaaaacattttataaacacgtgggtctcttatgaagtacaatccaaagtttgcatacaatttaaaacaaaagcaagaaatgtcacgctttgggaacactgtttktctcacactaaaatgttctatctgaagcaaggggaagtgtccaaattatagttcacaaaatacctttattttctcacaacaaaatcatccctagtcagcggcccaacattactcatttctgtcatcaaaaacaccctttctgtgggttggtatgaaatatccgcaggcatcacaagtactataagaaagggctttttcaaaatgtcctgtactcactcctcttctaacctgggtaagttttctgtacacagagagtaccgtgtcctcmtactgtgtaacagtagggtctctttcactcgnntccatgtgaagagaccaccawacaggctatgtgtgagcagcaaaggctgtttatttcacctgggtgcaggcaggct

SEQ ID NO: 94 - DNA, 539 bp, Homo sapiens
  CDS 41..538
  sig_peptide 41..139: score 9.9 seq SVFFLLLPGPSAA/DE
  misc_feature 485: n=a, g, c or t
  misc_feature 502: y=c or t
  misc_feature 516: m=a or c
  UNSURE 116: Xaa=Ala or Pro or Ser or Thr
  UNSURE 126: Xaa= *  or Ser
cggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaaagacacccanccggctccccaagttcytcatcacgacagtmaaagacagcctggctagatggca

SEQ ID NO: 95 - DNA, 621 bp, Homo sapiens
  CDS 224..619
  sig_peptide 224..316: score 9.1 seq LLLLTMALAGGSG/TA
  misc_feature 91: s=g or c
  misc_feature 101: r=a or g
gatggttgaattcccctcctcacgccagcctaggagaagaagttcgtagtcccagaggtgaggcaggaggcggcagtttctggcgggtgasggcggactgragtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtc

SEQ ID NO: 96 - DNA, 509 bp, Homo sapiens
  CDS 175..507
  sig_peptide 175..225: score 6.4 seq AILAAILPGXAPA/GP
  misc_feature 214: w=a or t
  misc_feature 247: r=a or g
  misc_feature 488: m=a or c
  misc_feature 506: n=a, g, c or t
  misc_feature 507: n=a, g, c or t
  UNSURE -4: Xaa=Arg or Trp
  UNSURE 8: Xaa=Gly or Arg
  UNSURE 88: Xaa=Ala or Glu
  UNSURE 94: Xaa=Ala or Asp or Glu or Gly or Val
ggaaattaggacacctcatcccaaaagacctttaaataggggaagtccacttgtgcacggctgctccttgctatagaagacctgggacagaggactgctgtctgccctctctggtcaccctgcctagctagaggatctctgctcctgctctccctcctccaggtgaccccagccatgaggaccctcgccatccttgctgccattctccctgggwgggcccctgcaggcccaaggctgagccactccrggcaagagctgattgaggttgctgcagccccggagcagattgcagcggacatcccagaagtggtttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgmgctcaaaatttgctttgnnag

SEQ ID NO: 97 - DNA, 351 bp, Homo sapiens
  CDS 58..351
  sig_peptide 58..120: score 7.9 seq MMLLLGLLAYGSG/XD
  misc_feature 122: k=g or t
  misc_feature 123: r=a or g
  misc_feature 174: r=a or g
  misc_feature 176: r=a or g
  misc_feature 203: r=a or g
  misc_feature 223: w=a or t
  misc_feature 224: r=a or g
  misc_feature 227: n=a, g, c or t
  misc_feature 228: y=c or t
  misc_feature 230: r=a or g
  misc_feature 231: n=a, g, c or t
  misc_feature 262: m=a or c
  UNSURE 1: Xaa=Gly or Val
  UNSURE 19: Xaa=Glu or Gly
  UNSURE 28: Xaa=Asn or Ser
  UNSURE 35: Xaa=Cys or Asn or Ser or Tyr
  UNSURE 36: Xaa=Cys or Phe or Ser or Tyr
  UNSURE 37: Xaa= *  or Cys or Trp or Tyr
  UNSURE 48: Xaa=Pro or Thr
aaaaaggccctgaggaaaacaaaccccagctgggaagcctgagaacacttagccttcatgagtgtccccaccatggcctggatgatgcttctcctcggactccttgcttatggatcaggagkrgattctcagactgtggtgacccaggagccatcgttctcagtgtcccctggrgrgacagtcacactcacttgtggcttgarctctggctcagtctctactwrttnytrncccagctggtaccagcagaccccaggccagmctccacgcacactcatctacaacacaaacactcgctcttctggggtccctgatcgcttctctggctccatccttgggaacaaagctgcc

SEQ ID NO: 98 - DNA, 399 bp, Homo sapiens
  CDS 45..398
  sig_peptide 45..104: score 7.8 seq LTLLTLCIGSVVS/SE
  misc_feature 119: n=a, g, c or t
  misc_feature 170: r=a or g
  misc_feature 179: m=a or c
  misc_feature 184: s=g or c
  misc_feature 186: n=a, g, c or t
  misc_feature 193: m=a or c
  misc_feature 205: w=a or t
  misc_feature 231: r=a or g
  misc_feature 233: n=a, g, c or t
  misc_feature 240: w=a or t
  misc_feature 246: r=a or g
  misc_feature 247: r=a or g
  misc_feature 250: r=a or g
  misc_feature 251: r=a or g
  misc_feature 252: r=a or g
  misc_feature 255: n=a, g, c or t
  misc_feature 256: n=a, g, c or t
  misc_feature 257: s=g or c
  misc_feature 265: y=c or t
  misc_feature 357: y=c or t
  UNSURE 5: Xaa=His or Gln
  UNSURE 25: Xaa=Arg or Ser
  UNSURE 27: Xaa=Arg or Thr
  UNSURE 28: Xaa=Asp or His or Asn or Tyr
  UNSURE 30: Xaa=Ser or Tyr
  UNSURE 34: Xaa=Phe or Tyr
  UNSURE 43: Xaa=Ile or Met or Val
  UNSURE 46: Xaa=Phe or Ile
  UNSURE 48: Xaa=Asp or Gly or Asn or Ser
  UNSURE 49: Xaa=Lys or Arg
  UNSURE 50: Xaa=Asp or Asn
  UNSURE 51: Xaa=any one of the twenty amino acids
  UNSURE 54: Xaa=Leu or Ser
  UNSURE 85: Xaa=His or Tyr
aaaaagctgtgggctcagaagcagagttctggggtgtctccaccatggcctggacccctctctggctcactctcctcactctttgcataggttctgtggtttcttctgagctgactcangaccctgctgtgtctgtggccttgggacagacagtcaggatcacatgccarggagacagmctcasanactattmtgcaagctggtwccagcagaagccaggacaggcccctrtncttgtcwtctatrrtarrracnnscggccctyagggatcccagaccgattctctggctccagctcaggaaacacagcttccttgaccatcactggggctcaggcggaagatgaggctgactatyactgcaactcccgggacagcagtggtcaccatttggtgttcg

SEQ ID NO: 99 - DNA, 336 bp, Homo sapiens
  CDS 155..334
  sig_peptide 155..205: score 5.8 seq LWLKLLAFGFAFL/DT
  misc_feature 258: m=a or c
  UNSURE 18: Xaa=Ala or Asp
aaaaaccgaatctgacatcatcacctagcagttcatgcagctagcaagtggtttgttcttagggtaacagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgmctaccttaatgcctctgaaacaaccactctgagcccttctggaagcgctgtcatttcaaccacaacaatagctactac

SEQ ID NO: 100 - DNA, 489 bp, Homo sapiens
  CDS 102..488
  sig_peptide 102..179: score 14.3 seq PLLLLLLLRAVLA/VP
ataagtgggcgtggtctaggggggaagtcaccaagaacgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatgacgccgagcaggatccaatgtacaggtggat

SEQ ID NO: 101 - DNA, 722 bp, Homo sapiens
  CDS 337..720
  sig_peptide 337..408: score 4.2 seq IWSFPLIIAAVCA/QS
  misc_feature 18: n=a, g, c or t
  misc_feature 46: y=c or t
  misc_feature 55: m=a or c
  misc_feature 56: m=a or c
  misc_feature 60: s=g or c
  misc_feature 61: s=g or c
  misc_feature 84: s=g or c
  misc_feature 356: r=a or g
  misc_feature 629: w=a or t
  UNSURE -18: Xaa=Lys or Arg
  UNSURE 74: Xaa=Ile or Lys
agaatcagaccgaaaccnagagagacagcattgcctttctgcgtcycctcgcccmmctcssctcctgctataaataacccggastagcgggtcaggaacgtcacacggcgagaaaacaggaccccgaggttttcttctctgggaatagggggcaaagggtgaggagaggagaaagaaatcgctcgaaatctgctcggtccccggcagccgccgcttcccctttgacgttttggtacgccgtgcgcatgcgcctcacattagaattactgcactgggcagactaagttggatctcctctcttcagtgaaaccctcaattccatcaaaaactaaagggatgtggagagtgcggaaaargggctactttgggatttggtccttccccttaataatcgccgctgtctgtgcgcagagtgtcaatgaccctagtaatatgtcgctggttaaagagacggtggatagactcctgaaaggctatgacattcgtctgagaccagattttggaggtccccccgtggctgtggggatgaacattgacattgccagcatcgatatggtttctgaagtcaatatggattataccttgacaatgtactttcaacaagcctggagagataagaggctgtctawaaatgtaatacctttaaacttgactctggacaacagagtggcagaccagctctgggtgcctgatacctatttcctgaacgataagaagtcatt

SEQ ID NO: 102 - DNA, 529 bp, Homo sapiens
  CDS 354..527
  sig_peptide 354..395: score 8.6 seq LLAFSQALLVVFS/ER
  misc_feature 281: n=a, g, c or t
  misc_feature 517: m=a or c
  UNSURE 41: Xaa=Ala or Glu
aaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggctatgtttagcttgttctagtctgtggagcattctccttcatagaaaagatgggaaatactggagatgaaaattctccattctctgtcattttgtgtgtnagagtctctgtccccatcccagggccacttcctccctggttcttcttatggctttggatgtagcttgaagacatgctcctagcattttcacaagctctgcttgttgtgtttagtgagcgcagactactcccttcgggcctgtcctggctcatgggcagttgctcgtgtctttgcacacatcctttgctgtcctgccagctctgcccatgcctgaggtggtcctacctctcacgggmacctagctgctg

SEQ ID NO: 103 - DNA, 426 bp, Homo sapiens
  CDS 195..425
  sig_peptide 195..290: score 3.7 seq EALILQLFSQIGP/CK
gccatcttgtattggggtttcattgttcccgctggccgggcggtttagtgtaattgccgccggaggaggaggcggagtaacctctggtcagccgagaaaccccactatcctgtagccataaccgcttaaacgatttgggaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaag

SEQ ID NO: 104 - DNA, 459 bp, Homo sapiens
  CDS 241..459
  sig_peptide 241..351: score 4.8 seq GIGLLAAATQSLS/MP
  misc_feature 307: n=a, g, c or t
  misc_feature 321: s=g or c
  UNSURE -15: Xaa=Ala or Pro or Ser or Thr
gatcggcggccgccatgttaggagcgcagtggcggcgcaaccagccttctagggcggcggagagttgtctgctggttctcagcttgaagaagattctgcagtccttattgatcctttttcttggcgttaccattttttgaagcaaagttaacctagctttctagtttgagctttctttttggccgtctttaaaaaaaattttttttttaatctataaaatagacaagagctagttctacaatgtccaagtcattccagcagtcatctctcagtagggactcacagggtcatgggcgtgacctgtctncggcaggaataggscttcttgctgctgctacccagtctttaagtatgccagcatctcttggaaggatgaaccagggtactgcacgccttgctagtttaatgaatcttggaatgagttcttcattgaatcaacaaggagctcatagtgcactg

SEQ ID NO: 105 - DNA, 444 bp, Homo sapiens
  CDS 87..443
  sig_peptide 87..167: score 11.7 seq LLLLLGLIDISQA/QL
aagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggcctaaaggtggcccaggggccctggagcccaggccccaaaggtgaatcgggagactacaaggccacccaga

SEQ ID NO: 106 - DNA, 543 bp, Homo sapiens
  CDS 129..542
  sig_peptide 129..194: score 5.2 seq AGLLILSPLTVIS/DS
agaggcagttgagcatgggagccgtctgtatgttgaattagggctcgcactcttgcgcaacacgtcaccagtcggaaactgggggtttgcttctgtgatttatttcattattgtgctggtaaagcctgatgaagagactagcagctcgctgctttgctggcttgttaattttatccccactaactgtgatttctgatagccggcctgctgatagtggtaaggccatcgaaggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaagg

SEQ ID NO: 107 - DNA, 486 bp, Homo sapiens
  CDS 105..485
  sig_peptide 105..161: score 10.1 seq TLLLLLLVPLIKP/AP
  misc_feature 362: m=a or c
  UNSURE 67: Xaa=Arg or Ser
gcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagagmgaaaatgatgaaatgcccacgtgtctgctgtgtgtttgtttaagtggctctgtatactgtgaagaagttgacattgatgctgtaccacccttaccaaggaatcagcctatctttacgcacgatt

SEQ ID NO: 108 - DNA, 571 bp, Homo sapiens
  CDS 190..570
  sig_peptide 190..246: score 10.1 seq TLLLLLLVPLIKP/AP
  misc_feature 268: y=c or t
  misc_feature 447: m=a or c
  UNSURE 8: Xaa=Pro or Ser
  UNSURE 67: Xaa=Arg or Ser
agcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggacycacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagagmgaaaatgatgaaatgcccacgtgtctgctgtgtgtttgtttaagtggctctgtatactgtgaagaagttgacattgatgctgtaccacccttaccaaggaatcagcctatctttacgcacgatt

SEQ ID NO: 109 - DNA, 444 bp, Homo sapiens
  CDS 101..442
  sig_peptide 101..172: score 9.2 seq LVTLSVFLHVLHS/AP
aagttactgagaactcataagacgaagctaaaatccctcttcggatccacagtcaaccgccctgaacacatcctgcaaaaagcccagagaaaggagcgccatggattactacagaaaatatgcagctatctttctggtcacattgtcggtgtttctgcatgttctccattccgctcctgatgtgcaggattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtcacagtaatggggggtttcaaagtggagaaccacacggcgtgccactgcagtacttgttattatcacaa

SEQ ID NO: 110 - DNA, 295 bp, Homo sapiens
  CDS 79..294
  sig_peptide 79..144: score 8.4 seq SILLLFLTEAALG/DA
  misc_feature 202: y=c or t
  UNSURE 20: Xaa=His or Tyr
agcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagacyacggaccctgccgggccctacttctccgttactactacgacaggtacacgcagagctgccgccagttcctgtacgggggctgcgagggcaacg

SEQ ID NO: 111 - DNA, 423 bp, Homo sapiens
  CDS 173..421
  sig_peptide 173..295: score 6.6 seq LFIFRMLVLGTAA/ES
  misc_feature 392: r=a or g
  misc_feature 403: m=a or c
  UNSURE 33: Xaa=Asp or Asn
  UNSURE 36: Xaa= *  or Tyr
gacagatacgattaaaaagagggtggaagaggaacaactgacaggctcaagagcaaaaagcgtgggcagttggagaagaagcagccagagtgtgaagaagcccacggaaggaaagtccagggaggaggaaaagaagcagaagttttggcatctgttccctggctgtgccaagatgggcgattggagcttcctgggaaatttcctggaggaagtacacaagcactcgaccgtggtaggcaaggtctggctcactgtcctcttcatattccgtatgctcgtgctgggcacagctgctgagtcttcctggggggatgagcaggctgatttccggtgtgatacgattcagcctggctgccagaatgtctgctacgaccaggctttccccatcgggracattcgctamtgggtgctgcagatcatctt

SEQ ID NO: 112 - DNA, 501 bp, Homo sapiens
  CDS 206..499
  sig_peptide 206..343: score 9.2 seq ILLLGTAVESAWG/DE
aaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgt

SEQ ID NO: 113 - DNA, 468 bp, Homo sapiens
  CDS 73..468
  sig_peptide 73..132: score 11.2 seq AFLLLVALSYTLA/RD
actcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtcccaggattatgtttgttgacc

SEQ ID NO: 114 - DNA, 576 bp, Homo sapiens
  CDS 195..575
  sig_peptide 195..287: score 10.1 seq SLAFLLSLRGAGA/IK
  misc_feature 73: s=g or c
gtcgaagcgcgcgaactcctcccggttgtagatgtatctctccaggaagcgctgtgtcccattaaacgcgtasattcctgccgtccctggaaaagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctg

SEQ ID NO: 115 - DNA, 476 bp, Homo sapiens
  CDS 95..475
  sig_peptide 95..187: score 10.1 seq SLAFLLSLRGAGA/IK
ggatgtgagggcgatagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaaggcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacgatccccctgaggtgaccgtgtttcccaaggagcctg

SEQ ID NO: 116 - DNA, 458 bp, Homo sapiens
  CDS 139..456
  sig_peptide 139..192: score 10.5 seq VLTVLSLLPLLEA/QI
  misc_feature 12: s=g or c
  misc_feature 251: r=a or g
  misc_feature 358: m=a or c
  misc_feature 361: s=g or c
  misc_feature 393: y=c or t
  misc_feature 431: s=g or c
  UNSURE 20: Xaa=Gln or Arg
  UNSURE 56: Xaa=Pro or Thr
  UNSURE 57: Xaa=Glu or Gln
  UNSURE 80: Xaa=Ala or Gly
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagmcasaggacacgatctttctcagagagtaccagacycgacaggaccagtgcatctataacaccacctacccggsatcctcgttaaccctaacaaaaaaaac

SEQ ID NO: 117 - DNA, 435 bp, Homo sapiens
  CDS 201..434
  sig_peptide 201..332: score 6.3 seq WLIFAFFVDTGFC/RV
  misc_feature 49: s=g or c
  misc_feature 161: w=a or t
  misc_feature 197: r=a or g
  misc_feature 402: s=g or c
  misc_feature 403: n=a, g, c or t
  UNSURE 24: Xaa=Ala or Glu or Gly or Leu or Pro or Gln or Arg or Val
agtagtactttccggcgttgttgaccctatttcccgtgctgcaccgcasccctttctcttccggttctaggcgcttcgggagccgcggcttatggtgcagacatggccaagtccaagaaccacaccacacacatactttttatgttatttttggggagagwcttgctctgctgcccaggctggggtgcagtggcatratcatggctcactgcagccttgaccacccccagggttcgagtgatcgtgccacctcggcctgctgggtagctgggactgcagacaggcaccctgcctggctaatttttgcattttttgtggacacggggttttgccgtgttgcccaggctggtctcaatctcctcggctcaagtcaacagcctgcctctgcctcccgatgtgttsngattacaggaataaactactatgcccaactca

SEQ ID NO: 118 - DNA, 514 bp, Homo sapiens
  CDS 41..514
  sig_peptide 41..163: score 4.3 seq VALFCGCGHEALS/GT
gctctcctctggggactgcagagaagcaggacctcgggccatggggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggag

SEQ ID NO: 119 - DNA, 326 bp, Homo sapiens
  CDS 74..325
  sig_peptide 74..133: score 4.4 seq LRYVASAVFGVIG/SQ
  misc_feature 41: s=g or c
  misc_feature 221: w=a or t
  UNSURE 30: Xaa=Arg or Trp
gtgggcgggtccaatcggctgggagcctcgtggaggctgasattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatcwgggacttaaggaaaggagagaagattcttatccttcaggggcttaaacaagaagttacttgcttatgcccctccccagatgggctacacttagctgttgggtatg

SEQ ID NO: 120 - DNA, 212 bp, Homo sapiens
  CDS 36..212
  sig_peptide 36..83: score 8.9 seq FLLSLPTPPSASG/HE
gttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacc

SEQ ID NO: 121 - DNA, 464 bp, Homo sapiens
  CDS 150..464
  sig_peptide 150..230: score 5.2 seq WMSALFLGVGVRA/EE
  misc_feature 2: w=a or t
gwattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccagg

SEQ ID NO: 122 - DNA, 329 bp, Homo sapiens
  CDS 144..329
  sig_peptide 144..203: score 9.3 seq LFLCYLLLFTCSG/VE
  misc_feature 292: n=a, g, c or t
  UNSURE 30: Xaa=Ala or Glu or Gly or Val
acacaagtgatgataaaaagccagccttcagccggagaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggagnactcgcagtcgccgggctgcccgcgctgggcttcacc

SEQ ID NO: 123 - DNA, 467 bp, Homo sapiens
  CDS 57..467
  sig_peptide 57..110: score 7.1 seq IFVLLLSAIVSIS/AX
  misc_feature 115: y=c or t
  UNSURE 2: Xaa=Leu or Ser
agttgtctttggtagtttttttgcactaacttcaggaaccagctcatgatctcaggatgtatggaaaaataatctttgtattactattgtcagcaattgtgagcatatcagcatyaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagagacaagtgatcaatgagaatctgttcaccaaaccaaatgtggaaagaacacaa

SEQ ID NO: 124 - DNA, 426 bp, Homo sapiens
  CDS 182..424
  sig_peptide 182..253: score 10.9 seq LAGLCCLVPVSLA/ED
  misc_feature 121: s=g or c
agatcccagccactggacttagcccctgtttgctcctccgataactggggtgaccttggttaatattcaccagcagcctcccccgttgcccctctggatccactgcttaaatacggacgasgacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctatacagcacacacagcacacagatgagcacacagcacacacacaaacgcacagcacacatacg

SEQ ID NO: 125 - DNA, 613 bp, Homo sapiens
  CDS 182..613
  sig_peptide 182..253: score 10.9 seq LAGLCCLVPVSLA/ED
  misc_feature 121: s=g or c
  misc_feature 553: n=a, g, c or t
agatcccagccactggacttagcccctgtttgctcctccgataactggggtgaccttggttaatattcaccagcagcctcccccgttgcccctctggatccactgcttaaatacggacgasgacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctncgtaccctcaaccagccagacagccagctccagctgaccaccggcaatggcctgttcctc

SEQ ID NO: 126 - DNA, 480 bp, Homo sapiens
  CDS 146..478
  sig_peptide 146..211: score 8.6 seq PLPLLLVLALSQG/IL
  misc_feature 474: r=a or g
  UNSURE 88: Xaa=Lys or Arg
acttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaraaccaa

SEQ ID NO: 127 - DNA, 575 bp, Homo sapiens
  CDS 23..574
  sig_peptide 23..64: score 5.9 seq AMRLILFFGALFG/HI
  misc_feature 519: n=a, g, c or t
  UNSURE 152: Xaa=Ala or Glu or Gly or Val
attctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccgnaggagacaagccagctatctggctggatgctgggatccatgctcgagagtgggtta

SEQ ID NO: 128 - DNA, 462 bp, Homo sapiens
  CDS 137..460
  sig_peptide 137..262: score 5.8 seq GLIVGLAVGLTRS/CD
  misc_feature 302: s=g or c
  misc_feature 303: n=a, g, c or t
  UNSURE 14: Xaa=Ala or Asp or Gly or His or Leu or Pro or Arg or Val
agagagaggggtgtgggaaagcgaaaacaggctgccaaatcaggggattccttccaatttaaaaaggaagtctgctgacgttagttagttaaatttaacatctttttatgtgtaacacttgactttggaagcaaaaatgaactttgcggagagagagggctctaagagatactgcattcaaacgaaacatgtggccattctctgtgcggtggtggtgggtgtaggattaatagtgggacttgccgtgggcttgaccagatcgtgtgactccagcggggacggcgggccgggcactgcgccasntccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagccctg

SEQ ID NO: 129 - DNA, 438 bp, Homo sapiens
  CDS 151..438
  sig_peptide 151..234: score 12.5 seq LLLLLLLPLRGQA/NT
acgagaaggggagggggcccagccctgctttgggcaatccttgctctgaccactcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgcca

SEQ ID NO: 130 - DNA, 439 bp, Homo sapiens
  CDS 45..437
  sig_peptide 45..98: score 8.2 seq LLLLLLSFLAPWA/TI
  misc_feature 118: m=a or c
  misc_feature 339: n=a, g, c or t
  misc_feature 340: n=a, g, c or t
  UNSURE 7: Xaa=Ala or Asp
  UNSURE 81: Xaa=Ala or Cys or Asp or Phe or Gly or His or Ile or Leu or Asn or Pro or Arg or Ser or Thr or Val or Tyr
tttttttcgccctcccacccgcactgcagtctccagcctgagccatgggccgccgagccctcctgctcctgcttctgtcttttctggcgccctgggccaccatagccctccggccggmcttaagggccctcggcagcctacacttgccaaccaaccccacatccctcccggctgtagccaagaactattcggttctctacttccaacagaaggttgatcattttggatttaatactgtgaaaacttttaatcagcggtacctagtagctgataaatactggaagaaaaatggtggatcaatacttttctacactggtaatgaaggggacattatctggnnttgtaataacacggggttcatgtgggatgtggctgaggaactgaaagctatgttggtgtttgctgaacatcgaatactatggaagagtctctccccttt

SEQ ID NO: 131 - DNA, 190 bp, Homo sapiens
  CDS 7..189
  sig_peptide 7..66: score 4.8 seq PLTVSLVLEGSEA/RH
ccccttatgtcgggtataaagcccctcccgctcacagtttccctagtcctcgaaggctcggaagcccgtcaccatgtcgtgcgagtcgtctatggttctcgggtactgggatattcgtggggtgagtgccgtctcaacggtagagccgctcggtcaaagagactgacgcggagagggcactcacctagaa

SEQ ID NO: 132 - DNA, 408 bp, Homo sapiens
  CDS 222..407
  sig_peptide 222..284: score 8.4 seq CAVLALVLAPAGA/FR
  misc_feature 281: y=c or t
agctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggygcttttcgcaacgataaatgtggcgatactataaaaattgaaagccccgggtaccttacatctcctggttatcctcattcttatcacccaagtgaaaaatgcgaatggctgattcaggctccggacc

SEQ ID NO: 133 - DNA, 379 bp, Homo sapiens
  CDS 54..377
  sig_peptide 54..131: score 7.4 seq GVVVLLLLQGGSA/YK
aagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtactgtttggttccaaa

SEQ ID NO: 134 - DNA, 463 bp, Homo sapiens
  CDS 220..462
  sig_peptide 220..288: score 4.2 seq YLHLAFLMTTVFS/LS
gacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctc

SEQ ID NO: 135 - DNA, 555 bp, Homo sapiens
  CDS 101..553
  sig_peptide 101..238: score 3.9 seq PTLFTSSMSQVLA/NS
  misc_feature 354: k=g or t
  misc_feature 443: m=a or c
  UNSURE 39: Xaa=Gly or Val
  UNSURE 69: Xaa=His or Asn
ctttctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgkctatacctcttctgaaaaaccagaagcacatacttctgctggacaaccacttgcctacaacaccaaacaaccaaacaccaatagccaamacctcctcccagcaagccgtgttcacctctgccagacaactaccatctgcccgtacttctaccacacaaccaccaaagtcatttgtctatacttttactcaacaatcatcat

SEQ ID NO: 136 - DNA, 293 bp, Homo sapiens
  CDS 55..291
  sig_peptide 55..123: score 5.5 seq ALALXTVMSXCGG/EX
  misc_feature 8: n=a, g, c or t
  misc_feature 9: s=g or c
  misc_feature 14: y=c or t
  misc_feature 37: d=a or g or t
  misc_feature 51: r=a or g
  misc_feature 79: m=a or c
  misc_feature 84: r=a or g
  misc_feature 98: m=a or c
  misc_feature 99: m=a or c
  misc_feature 102: m=a or c
  misc_feature 112: y=c or t
  misc_feature 127: s=g or c
  misc_feature 133: r=a or g
  misc_feature 135: s=g or c
  misc_feature 137: m=a or c
  misc_feature 147: w=a or t
  misc_feature 150: h=a or c or t
  misc_feature 157: r=a or g
  misc_feature 174: k=g or t
  misc_feature 175: y=c or t
  misc_feature 219: y=c or t
  misc_feature 249: k=g or t
  misc_feature 254: s=g or c
  misc_feature 279: y=c or t
  misc_feature 283: m=a or c
  UNSURE -15: Xaa=Leu or Met
  UNSURE -9: Xaa=Lys or Asn or Thr
  UNSURE -4: Xaa=Pro or Ser
  UNSURE 2: Xaa=Asp or His
  UNSURE 4: Xaa=Ile or Met or Val
  UNSURE 5: Xaa=Ala or Asp
  UNSURE 12: Xaa=Gly or Ser
  UNSURE 17: Xaa=His or Gln
  UNSURE 18: Xaa=Pro or Ser
  UNSURE 42: Xaa=Lys or Asn
  UNSURE 44: Xaa=Ser or Thr
  UNSURE 54: Xaa=Ile or Leu
acaatttnstctayagctcagaacagcaactgctgadgctgccttgggaaraagatgatcctaaacaaagctctgatgmtgggrgccctcgccctgammacmgtgatgagcycttgtggaggtgaasacattrtsgmtgaccacgtwgchtcttacrgtgtaaacttgtaccakycttacggtccctctggccagttcacccatgaatttgatggagaygaggagttctatgtggacctggagaggaakgagastgtctggaagttgcctctgttccayagamttagatttga

SEQ ID NO: 137 - DNA, 352 bp, Homo sapiens
  CDS 62..352
  sig_peptide 62..130: score 6.9 seq ALALTTVMSPCGG/ED
  misc_feature 23: r=a or g
  misc_feature 42: r=a or g
  misc_feature 97: y=c or t
  misc_feature 121: y=c or t
  misc_feature 151: y=c or t
  misc_feature 154: y=c or t
  misc_feature 163: y=c or t
  misc_feature 187: y=c or t
  misc_feature 199: s=g or c
  misc_feature 207: s=g or c
  misc_feature 226: y=c or t
  misc_feature 230: s=g or c
  misc_feature 238: y=c or t
  misc_feature 249: r=a or g
  misc_feature 269: y=c or t
  misc_feature 271: n=a, g, c or t
  misc_feature 282: y=c or t
  UNSURE 26: Xaa=Ser or Thr
  UNSURE 34: Xaa=Glu or Gln
  UNSURE 40: Xaa=Glu or Gly
  UNSURE 47: Xaa= *  or Cys or Arg or Trp
  UNSURE 51: Xaa=Leu or Pro
aggtcctcacaattgctctacarctcagaacagcaactgctraggctgccttgggaagaggatgatcctaaacaaagctctgatgctgggggccctygccctgaccaccgtgatgagcccytgtggaggtgaagacattgtggctgaccaygtygcctcttayggtgtaaacttgtaccagtcttayggtccctctggscagtacasccatgaatttgatggagaygagsagttctaygtggacctggrgaggaaggagactgtctggygnttgcctgttcycagatttagaagatttgacccgcaatttgcactgacaaacatcgctgtgctaaaacataacttgaacatc

SEQ ID NO: 138 - DNA, 454 bp, Homo sapiens
  CDS 31..453
  sig_peptide 31..78: score 13.3 seq LLLLLAFLLPTGA/EA
  misc_feature 394: s=g or c
  misc_feature 396: w=a or t
  misc_feature 397: r=a or g
  UNSURE 106: Xaa=Gly or Arg
  UNSURE 107: Xaa=Asp or Asn
agcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatsgwracgtgaacccagtggctctgctagagccaggagggactgagacccgggacgctgtgc

SEQ ID NO: 139 - DNA, 577 bp, Homo sapiens
  CDS 167..577
  sig_peptide 167..217: score 6.9 seq LFLTMLTLALVKS/QD
  misc_feature 10: y=c or t
  misc_feature 22: m=a or c
  misc_feature 23: r=a or g
  misc_feature 24: s=g or c
  misc_feature 25: n=a, g, c or t
  misc_feature 32: m=a or c
  misc_feature 33: r=a or g
  misc_feature 106: s=g or c
  misc_feature 107: s=g or c
  misc_feature 108: n=a, g, c or t
  misc_feature 332: w=a or t
  misc_feature 370: s=g or c
  misc_feature 479: n=a, g, c or t
  misc_feature 480: n=a, g, c or t
  misc_feature 498: n=a, g, c or t
  misc_feature 506: m=a or c
  misc_feature 507: n=a, g, c or t
  misc_feature 508: n=a, g, c or t
  UNSURE 39: Xaa= *  or Lys
  UNSURE 51: Xaa= *  or Tyr
  UNSURE 88: Xaa=Ala or Cys or Asp or Phe or Gly or His or Ile or Leu or Asn or Pro or Arg or Ser or Thr or Val or Tyr
  UNSURE 94: Xaa=Ala or Glu or Gly or Val
  UNSURE 97: Xaa=His or Ile or Lys or Leu or Met or Asn or Pro or Gln or Arg or Ser or Thr
ctcctcctcytcctgccgccgmrsncgctgcmrgacttcgccagatcagacccacggggctgccctcccctgcgcactcccctcgctgcccgggcccggagcgcassnggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtwaaggtggaatgaagtgtgtcaaccactatggaggatasctctgccttccgaaaacagcccagattattgtcaataatgaacagcctcagcaggaaacacaaccagcagaaggaacctcaggggcaaccaccggggttgtagctgccnncagcatggcaaccagtgnagtgttgmnngggggtggttttgtggccagtgctgctgcagtcgcaggccctgaaatgcagactggccggaataacttt

SEQ ID NO: 140 - DNA, 424 bp, Homo sapiens
  CDS 12..422
  sig_peptide 12..110: score 8.5 seq LSFCVLLAGLCRG/NS
agagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgt

SEQ ID NO: 141 - DNA, 490 bp, Homo sapiens
  CDS 118..489
  sig_peptide 118..168: score 13 seq IFFLLCLAGRALA/AP
gagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccact

SEQ ID NO: 142 - DNA, 304 bp, Homo sapiens
  CDS 118..303
  sig_peptide 118..168: score 13 seq IFFLLCLAGRALA/AP
gagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaattcatacttaataaacaatttagga

SEQ ID NO: 143 - DNA, 335 bp, Homo sapiens
  CDS 118..333
  sig_peptide 118..168: score 13 seq IFFLLCLAGRALA/AP
gagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaaaatgaaattcattgtctcctccaaacctctaccaccaaaacaagtgtgttgcttctgggttcccatctgtc

SEQ ID NO: 144 - DNA, 305 bp, Homo sapiens
  CDS 41..304
  sig_peptide 41..178: score 6.5 seq LLIFVLLPKVVNT/SD
caaaacatcagaggttgtcagactgccctatcctctccaaatgaaatcttcaggtccaccttcttactttattaaaagggaatcgtggggctggacagactttctaatgaacccgatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagca

SEQ ID NO: 145 - DNA, 415 bp, Homo sapiens
  CDS 146..415
  sig_peptide 146..289: score 4.1 seq VFMLIVSVLALIP/ET
aagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaag

SEQ ID NO: 146 - DNA, 461 bp, Homo sapiens
  CDS 29..460
  sig_peptide 29..109: score 8.6 seq ATVLLLSFGSVAA/SH
  misc_feature 431: n=a, g, c or t
  UNSURE 108: Xaa=Ile or Leu or Val
aggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttatgaggtaactgtggagaattttttacgggtantaactgggaggatcccacctagtactcctc

SEQ ID NO: 147 - DNA, 649 bp, Homo sapiens
  CDS 269..649
  sig_peptide 269..337: score 4.1 seq LHILILILLFVAT/LD
  misc_feature 350: w=a or t
  misc_feature 608: n=a, g, c or t
  misc_feature 609: n=a, g, c or t
  misc_feature 610: n=a, g, c or t
  UNSURE 5: Xaa=Arg or Trp
  UNSURE 91: Xaa=any one of the twenty amino acids
gagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtccwggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactnnngccttgatctatgccattcacgccgaggagatcctggag

SEQ ID NO: 148 - DNA, 547 bp, Homo sapiens
  CDS 269..547
  sig_peptide 269..406: score 9.8 seq VLMVLSLILCCLS/FI
  misc_feature 335: m=a or c
  misc_feature 434: r=a or g
  misc_feature 435: s=g or c
  misc_feature 465: s=g or c
  misc_feature 502: w=a or t
  misc_feature 506: n=a, g, c or t
  misc_feature 507: n=a, g, c or t
  misc_feature 508: n=a, g, c or t
  UNSURE -24: Xaa=His or Asn
  UNSURE 10: Xaa=Ala or Gly or Ser or Thr
  UNSURE 20: Xaa=Ser or Thr
  UNSURE 32: Xaa=Phe or Leu
  UNSURE 34: Xaa=any one of the twenty amino acids
gagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtgggcmactttggacaaggctggctgaaggcggtgcaggtcctcatggtgctctccctcattctctgctgtctctccttcatcctgttcatgttccagctctacrscatgcgacgaggaggtctcttctatgccascggcctctgccagctttgcaccagcgtggcggtgttwactnnngccttgatctatgccattcacgccgaggagatcctggag

SEQ ID NO: 149 - DNA, 415 bp, Homo sapiens
  CDS 4..414
  sig_peptide 4..120: score 5.5 seq LLLRAAFQSLLDA/QA
acaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaaga

SEQ ID NO: 150 - DNA, 285 bp, Homo sapiens
  CDS 74..283
  sig_peptide 74..151: score 9.3 seq MXPLLWLLPXXWA/VP
  misc_feature 117: h=a or c or t
  misc_feature 118: w=a or t
  misc_feature 142: m=a or c
  misc_feature 143: w=a or t
  misc_feature 161: r=a or g
  misc_feature 230: w=a or t
  misc_feature 233: r=a or g
  misc_feature 234: w=a or t
  misc_feature 268: m=a or c
  misc_feature 269: w=a or t
  UNSURE -12: Xaa= *  or Phe or Leu or Ser or Tyr
  UNSURE -4: Xaa=His or Gln
  UNSURE -3: Xaa=Ser or Thr
  UNSURE 4: Xaa=Gly or Arg
  UNSURE 27: Xaa=Phe or Ile
  UNSURE 28: Xaa=Asp or Ile or Asn or Val
  UNSURE 39: Xaa=Lys or Asn
  UNSURE 40: Xaa=Arg or Trp
actctcggggagggagttggggaagctgggttggctgggttggtagctcctacctactgtgtggcaagaaggtatgggtcatgaacagaaccaaggagctgcgctgctacagatgthwccacttctgtggctgctaccccamwcctgggccgtccctgaarggtttcctatcgctgaagtgttcacgctgaagcccctggagtttggcaagcccaacactttggtctgtwttrwcagtaatctcttcccacccatgctgacagtgaamwggcagcatcattccgt

SEQ ID NO: 151 - DNA, 659 bp, Homo sapiens
  CDS 174..659
  sig_peptide 174..221: score 5.6 seq KWLLCMLLVLGTA/IV
  misc_feature 36: s=g or c
  misc_feature 37: r=a or g
  misc_feature 157: y=c or t
agggcttcgtgcggtgaggctcgctcgcgcggcagsrgatggccgaggcctcttggttctgcggcacgtgacggtcgggccgcctccgcctctctctttactgcggcgcggggcaaggtgtgcgggcgggaaggggcacgggcacccccgcggtccycgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggt

SEQ ID NO: 152 - DNA, 629 bp, Homo sapiens
  CDS 144..629
  sig_peptide 144..191: score 5.6 seq KWLLCMLLVLGTA/IV
  misc_feature 36: s=g or c
  misc_feature 37: r=a or g
  misc_feature 93: y=c or t
  misc_feature 119: s=g or c
agggcttcgtgcggtgaggctcgctcgcgcggcagsrgatggccgaggcctcttggttctgcggcacgtgacggtcgggccgcctccgcctcyctctttactgcggcgcgggcaccccsgcggtcctcgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggt

SEQ ID NO: 153 - DNA, 290 bp, Homo sapiens
  CDS 39..290
  sig_peptide 39..86: score 11.9 seq VLLSVVLLALSSA/QS
aacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctccc

SEQ ID NO: 154 - DNA, 460 bp, Homo sapiens
  CDS 10..459
  sig_peptide 10..99: score 12.2 seq LLLLLLCVFLVKS/QG
ctagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgc

SEQ ID NO: 155 - DNA, 363 bp, Homo sapiens
  CDS 10..363
  sig_peptide 10..99: score 12.2 seq LLLLLLCVFLVKS/QG
ctagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagtgccctcccgagtagccgggaccacaggcacccgccaccacgcccaactaatttttgtatttttagtagagacagggtttcaccttattggccaggttggtctagaacttcagacctcaagtcatctgcccacctcagcctcccaaagtgtagggatttcaggtgggagccactgcaccagcacccccaacgcc

SEQ ID NO: 156 - DNA, 333 bp, Homo sapiens
  CDS 97..333
  sig_peptide 97..216: score 4.3 seq LVPVFLLPAKLAS/AQ
actctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttggcttccgcccaagtgcagattctgtgccacacgtactgggagcactggacatcccagggtcaggtgcgtatgaggctctttggccaaaggtgccagaagtgctcctggtcccaatatgagatg

SEQ ID NO: 157 - DNA, 487 bp, Homo sapiens
  CDS 189..485
  sig_peptide 189..230: score 4 seq ALLTAFSSSVAVT/DK
  misc_feature 349: m=a or c
  misc_feature 400: r=a or g
  UNSURE 40: Xaa=Pro or Gln
  UNSURE 57: Xaa=Glu or Gly
agccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtccccttcgaccmgtcgggtttgggggctgaagaaagcctaggtctcttagatgattacctggrggtggccaagcacttcaaacctcatgggttctccagcgacaaggctaaggcgggctcctccgaatggctggctgtggatgggttggt

SEQ ID NO: 158 - DNA, 216 bp, Homo sapiens
  CDS 26..214
  sig_peptide 26..91: score 3.7 seq VGASASATPVVRA/AR
  misc_feature 212: y=c or t
  UNSURE 41: Xaa=Pro or Ser
agtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttcyccgc

SEQ ID NO: 159 - DNA, 413 bp, Homo sapiens
  CDS 92..412
  sig_peptide 92..160: score 13.6 seq LVLLLLVLLPTDA/SV
  misc_feature 64: k=g or t
cagttgctttgggaagtgtttgggaccagatggattgtagggagtagggtacaatacagtctgktctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtga

SEQ ID NO: 160 - DNA, 403 bp, Homo sapiens
  CDS 120..401
  sig_peptide 120..200: score 9.8 seq LIPLIFLISGAEA/AS
atataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcga

SEQ ID NO: 161 - DNA, 459 bp, Homo sapiens
  CDS 17..457
  sig_peptide 17..106: score 8.8 seq ALLLALGVERALA/LP
accaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaat

SEQ ID NO: 162 - DNA, 393 bp, Homo sapiens
  CDS 98..391
  sig_peptide 98..160: score 7.9 seq GLVLATLLSQVSP/FK
  misc_feature 225: r=a or g
  UNSURE 22: Xaa= *  or Trp
tttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatrggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagct

SEQ ID NO: 163 - DNA, 303 bp, Homo sapiens
  CDS 99..302
  sig_peptide 99..215: score 3.7 seq VFFSPMSMSCALA/MV
  misc_feature 2: s=g or c
  misc_feature 3: n=a, g, c or t
  misc_feature 7: n=a, g, c or t
  misc_feature 8: n=a, g, c or t
asnccgnngcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacaccc

SEQ ID NO: 164 - DNA, 199 bp, Homo sapiens
  CDS 36..197
  sig_peptide 36..104: score 4 seq AAAAVAAAAAVTA/GE
tcagctgcgttggctgtagaagagaacggacggcgatggcgacggtcgcagcaaatccagctgctgctgcggcggctgtggcggcggcagcggcggtgactgcaggagaatggcatgaaccgcagggggcgggactgcaggaagccaagatcgcaccactgcactccagcctaggtgacagcgagactccgtctcaaaa

SEQ ID NO: 165 - DNA, 425 bp, Homo sapiens
  CDS 196..423
  sig_peptide 196..282: score 7.1 seq LLFLLSAVYLGPG/CQ
agcagtttctctccactcacagcctgaagcatacccggcagggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggcc

SEQ ID NO: 166 - DNA, 507 bp, Homo sapiens
  CDS 280..507
  sig_peptide 280..402: score 3.6 seq AGAGLPALDLAKA/QR
  misc_feature 306: s=g or c
gtcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggscgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggc

SEQ ID NO: 167 - DNA, 446 bp, Homo sapiens
  CDS 96..446
  sig_peptide 96..182: score 8.5 seq LLGLLMAACFTFC/LS
  misc_feature 80: s=g or c
gcgtttgcgcagggggagctggtcgccgccgcggccgcctggaattgtgggagttgtgtctgccactcggctgccggagscgaaggtccgtgactatggctccccagagcctgccttcatctaggatggctcctctgggcatgctgcttgggctgctgatggccgcctgcttcaccttctgcctcagtcatcagaacctgaaggagtttgccctgaccaacccagagaagagcagcaccaaagaaacggagagaaaagaaaccaaagccgaggaggagctggatgccgaagtcctggaggtgttccacccgacgcatgagtggcaggcccttcagccagggcaggctgtccctgcaggatcccacgtacggctgaatcttcagactggggaaagagaggcaaaactccaatatgaggacaagttccgaaataatttgaaaggcaaa

SEQ ID NO: 168 - DNA, 439 bp, Homo sapiens
  CDS 17..439
  sig_peptide 17..94: score 8.3 seq CLLLCGSITLALG/NA
  misc_feature 424: r=a or g
accagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcrgtcttcctgtcctgg

SEQ ID NO: 169 - DNA, 319 bp, Homo sapiens
  CDS 65..319
  sig_peptide 65..133: score 4 seq LLLXLHWKHGAGS/PL
  misc_feature 105: k=g or t
  UNSURE -10: Xaa=Gly or Val
atgaacctctgaaaactgccggcatctgaggtttcctccaaggccctctgaagtgcagcccataatgaaggtcttggcggcaggagttgtgcccctgctgttggktctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaac

SEQ ID NO: 170 - DNA, 434 bp, Homo sapiens
  CDS 119..433
  sig_peptide 119..175: score 11.7 seq IALLLTVLQVSRG/QK
gaaaaaaaaaacctgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgcttcactagcaaggacgagggcactacacgtgtgcactc

SEQ ID NO: 171 - DNA, 428 bp, Homo sapiens
  CDS 200..427
  sig_peptide 200..310: score 3.6 seq PLSLDCGHSFCQA/CI
  misc_feature 322: r=a or g
  misc_feature 340: s=g or c
  misc_feature 381: s=g or c
  misc_feature 388: s=g or c
  UNSURE 24: Xaa=Ser or Thr
  UNSURE 26: Xaa=Phe or Leu
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcraagatcaaggagtcagtsatcatctcaagaggggaaagcagctgtcctgtgtgtcagascagattscagcctgggaacctccgacctaatcggcatctggccaaca

SEQ ID NO: 172 - DNA, 637 bp, Homo sapiens
  CDS 49..636
  sig_peptide 49..105: score 11.8 seq ALLVCAVLGLCLA/VP
acagaagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtg

SEQ ID NO: 173 - DNA, 497 bp, Homo sapiens
  CDS 234..497
  sig_peptide 234..290: score 7.4 seq LLAAVSILSACQQ/SY
  misc_feature 15: k=g or t
  misc_feature 474: n=a, g, c or t
  misc_feature 478: n=a, g, c or t
  misc_feature 479: n=a, g, c or t
  UNSURE 62: Xaa=Cys or Gly or Arg or Ser
  UNSURE 63: Xaa=His or Leu or Pro or Gln or Arg
aaaaacaaacgccgkaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctactngtcnnggtctggtgtacatatat

SEQ ID NO: 174 - DNA, 451 bp, Homo sapiens
  CDS 140..451
  sig_peptide 140..223: score 3.9 seq FQSFSSASSPVNC/QW
  misc_feature 13: s=g or c
aatgagtgccaasataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcatggtttgcatgg

SEQ ID NO: 175 - DNA, 422 bp, Homo sapiens
  CDS 92..421
  sig_peptide 92..148: score 13.5 seq LLLLLSACLAVSA/GP
  misc_feature 388: w=a or t
  misc_feature 395: m=a or c
  UNSURE 80: Xaa=Arg or Ser
  UNSURE 83: Xaa=Ile or Leu
agttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgagagacgtctggagcttatgagwaaacagmtactgatgggaagtttctctatcacaa

SEQ ID NO: 176 - DNA, 475 bp, Homo sapiens
  CDS 222..473
  sig_peptide 222..284: score 12.9 seq LLLLLLLTLLGLG/LV
acctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctg

SEQ ID NO: 177 - DNA, 502 bp, Homo sapiens
  CDS 223..501
  sig_peptide 223..294: score 11.7 seq FVLGLGLTPPTLA/QD
  misc_feature 430: r=a or g
  misc_feature 431: k=g or t
  misc_feature 432: n=a, g, c or t
  UNSURE 46: Xaa=Gly or Ile or Met or Arg or Ser or Val
acctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttrkntcatggcaacaagcgcagatcaaggccatctgtgaaaacaagaatggaaaccctcacagagaaaacctaa

SEQ ID NO: 178 - DNA, 314 bp, Homo sapiens
  CDS 116..313
  sig_peptide 116..187: score 11.7 seq FVLGLGLTPPTLA/QD
  misc_feature 134: k=g or t
  UNSURE -18: Xaa=Phe or Val
gttcacacaactggaacccatctccaggaacaaacagctggaacccatctcccgttgaagggaaactgccagatttttgtaagattcttcctcctgggagcctgtgttggaagagatggtgatgggcctgggckttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatca

SEQ ID NO: 179 - DNA, 477 bp, Homo sapiens
  CDS 74..475
  sig_peptide 74..172: score 11.2 seq ILCLLAWAGLAAG/DR
  misc_feature 467: m=a or c
  UNSURE 99: Xaa=Pro or Thr
agctataaatagggcatcgtgacccggccaggggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaactcttgggcttccgtatatatggcatgcacagtgagctatggggcgtggtccatggggccamcgtcctctcc

SEQ ID NO: 180 - DNA, 553 bp, Homo sapiens
  CDS 105..551
  sig_peptide 105..239: score 3.7 seq EDLLMYLLQLVQA/LK
  misc_feature 4: s=g or c
  misc_feature 44: w=a or t
ttasgaatcaagaaaaagccttgacaaaattcttgaaatgtgtwaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactca

SEQ ID NO: 181 - DNA, 400 bp, Homo sapiens
  CDS 38..400
  sig_peptide 38..88: score 6.5 seq WTITLFLLGAAKG/KE
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatc

SEQ ID NO: 182 - DNA, 364 bp, Homo sapiens
  CDS 63..362
  sig_peptide 63..128: score 5.8 seq LGIILLVLIGXQG/TP
  misc_feature 120: r=a or g
  misc_feature 275: n=a, g, c or t
  misc_feature 321: w=a or t
  misc_feature 332: r=a or g
  UNSURE -3: Xaa=Met or Val
  UNSURE 65: Xaa= *  or Lys
aaaaagaatttctcaggctcaaaatccaatacaggagtgacttggaactccattctatcactatgaagaaaagtggtgttcttttcctcttgggcatcatcttgctggttctgattggartgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagtncaaacatgtctaaacccagattcagcagatgtgaaggaactgattwaaaagtgggaraacaggtcagccaaaagaaaaagcaaaagaat

SEQ ID NO: 183 - DNA, 483 bp, Homo sapiens
  CDS 92..481
  sig_peptide 92..130: score 4.2 seq MLSVRVAAAVVRA/LP
  misc_feature 13: y=c or t
cttcttgaccttytttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgtcgtgtttggaaatgataaactaattaaggaaggagatatagt

SEQ ID NO: 184 - DNA, 259 bp, Homo sapiens
  CDS 92..259
  sig_peptide 92..130: score 4.2 seq MLSVRVAAAVVRA/LP
  misc_feature 13: y=c or t
cttcttgaccttytttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactggtaagttattatttctcagtctacgccgc

SEQ ID NO: 185 - DNA, 466 bp, Homo sapiens
  CDS 213..464
  sig_peptide 213..281: score 3.9 seq GWAGSCFWQWSFC/PP
  misc_feature 13: s=g or c
  misc_feature 14: s=g or c
  misc_feature 71: n=a, g, c or t
  misc_feature 72: k=g or t
  misc_feature 336: s=g or c
  UNSURE 19: Xaa=Leu or Val
agaggaggggccssaatgtctgaggtggcaacacttctcttcagccagacagcactggccagtttggagtnkgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaastccactatgcatctctgcagaggctgccagtgcccagcagtgagggacctgacctcaggggcagagacaagagaggcaccaaggaggatccaagagctgactatgcctgcattgctgagaacaaacccac

SEQ ID NO: 186 - DNA, 486 bp, Homo sapiens
  CDS 197..484
  sig_peptide 197..292: score 11.3 seq LLLAVVLLSACLC/WL
  misc_feature 244: s=g or c
  misc_feature 324: k=g or t
  misc_feature 436: n=a, g, c or t
  UNSURE 11: Xaa=Met or Arg
cacacacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctsggcgggctcctgcttctggcagtggtccttctgtccgcctgcctgtgttggctgcatcgaagagtaaagaggctggagakgagctgggcccagggctcctcagagcaggaactccactatgcatctctgcagaggctgccagtgcccagcagtgagggacctgacctcaggggcagagacaagagaggcacnaaggaggatccaagagctgactatgcctgcattgctgagaacaaacccac

SEQ ID NO: 187 - DNA, 542 bp, Homo sapiens
  CDS 106..540
  sig_peptide 106..180: score 8.9 seq IIAVLMSAQESWA/IK
  misc_feature 87: m=a or c
  misc_feature 507: m=a or c
aatggtcagactctattacaccccacattctcttttcttttattcttgtctgttctgcctcactcccgagctctactgactcccaamagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatmgacaagttcaccccaccagtggtcaatgtcacgtg

SEQ ID NO: 188 - DNA, 453 bp, Homo sapiens
  CDS 62..451
  sig_peptide 62..196: score 5.8 seq ILVAFSFLFTVIT/FP
  misc_feature 268: w=a or t
  misc_feature 285: s=g or c
  UNSURE 30: Xaa=Ala or Gly
attcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggwcgcattttacaaggagsagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaccctg

SEQ ID NO: 189 - DNA, 442 bp, Homo sapiens
  CDS 129..440
  sig_peptide 129..173: score 4.8 seq SLATAAPVPTTLA/QV
  misc_feature 12: s=g or c
  misc_feature 352: s=g or c
  misc_feature 353: r=a or g
  UNSURE 60: Xaa=Pro or Arg
aagtgggcggasgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatcsrtctatcaacccacccaccttgacagcacaccagtctaacagagtttgcaatgctctggcattactgcaatgtgtagcatcacatccaga

SEQ ID NO: 190 - DNA, 332 bp, Homo sapiens
  CDS 75..332
  sig_peptide 75..134: score 8.5 seq WIGLISSVCCVFA/QT
  misc_feature 16: m=a or c
  misc_feature 146: m=a or c
  misc_feature 245: m=a or c
  UNSURE 4: Xaa=Asp or Glu
gagaggcccagcgggmgtcgcggaacagcaggcccgagcccaccgcgccgggccccggacgccgcgcggaaaagatgaatttacaaccaattttctggattggactgatcagttcagtttgctgtgtgtttgctcaaacagatgamaatagatgtttaaaagcaaatgccaaatcatgtggagaatgtatacaagcagggccaaattgtgggtggtgcacaaattcaacatttttacaggaaggmatgcctacttctgcacgatgtgatgatttagaagccttaaaaaagaagggttgccctccagatgacatagaaaatcccagaggctcc

SEQ ID NO: 191 - DNA, 484 bp, Homo sapiens
  CDS 277..483
  sig_peptide 277..336: score 11.3 seq LLLLLVLWGPVCP/LH
ttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgact

SEQ ID NO: 192 - DNA, 242 bp, Homo sapiens
  CDS 31..240
  sig_peptide 31..84: score 7 seq VLGLVLLSVTVQG/KV
ctagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactgtaagtctactctccataattccagagaattagctacgtatggaacagacactaggagagaaggaagaagaagaag

SEQ ID NO: 193 - DNA, 472 bp, Homo sapiens
  CDS 98..472
  sig_peptide 98..229: score 5.8 seq MVFLLGLMFEITA/KA
  misc_feature 69: s=g or c
  misc_feature 409: r=a or g
  misc_feature 426: n=a, g, c or t
  misc_feature 440: r=a or g
  misc_feature 441: n=a, g, c or t
  UNSURE 66: Xaa=His or Leu or Pro or Arg
  UNSURE 71: Xaa=Ala or Glu or Gly or Ile or Lys or Arg or Thr or Val
gtgaggagcagccagcgggaggcggcggcgagtcggtgagcagctgggaagagcagaaccggggcggasacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataarattaacaggcgaatgcncttctccaaaacarnacacagcaagtttaatgaatctggtcagctt

SEQ ID NO: 194 - DNA, 432 bp, Homo sapiens
  CDS 90..431
  sig_peptide 90..173: score 6.1 seq AVGFLSSLLRTRG/CV
aagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggaccctatgaggtgtcctacgcattgggagg

SEQ ID NO: 195 - DNA, 289 bp, Homo sapiens
  CDS 30..287
  sig_peptide 30..95: score 10 seq FLLALTIIASTWA/LT
  misc_feature 133: r=a or g
  UNSURE 13: Xaa=Glu or Gly
tcggactccggcgggacctgctcggaggaatggcgccgccgggttcaagcactgtcttcctgttggccctgacaatcatagccagcacctgggctctgacgcccactcactacctcaccaagcatgacgtggrgagactaaaagcctcgctggatcgccctttcacaaatttggaatctgccttctactccatcgtgggactcagcagccttggtgctcaggtgccagatgcaaaggtaaggctgcttttgtcctggtggtcagggtggttcaggagaaccttcatccc

SEQ ID NO: 196 - DNA, 364 bp, Homo sapiens
  CDS 83..364
  sig_peptide 83..196: score 4.5 seq IIAVIALXAVGLT/QN
  misc_feature 52: n=a, g, c or t
  misc_feature 120: r=a or g
  misc_feature 126: r=a or g
  misc_feature 127: r=a or g
  misc_feature 135: n=a, g, c or t
  misc_feature 149: n=a, g, c or t
  misc_feature 152: n=a, g, c or t
  misc_feature 154: y=c or t
  misc_feature 155: n=a, g, c or t
  misc_feature 180: n=a, g, c or t
  misc_feature 291: w=a or t
  misc_feature 292: w=a or t
  misc_feature 316: n=a, g, c or t
  UNSURE -26: Xaa=Cys or Tyr
  UNSURE -24: Xaa=Lys or Arg
  UNSURE -21: Xaa=Leu or Pro or Gln or Arg
  UNSURE -16: Xaa=Phe or Ile or Leu or Val
  UNSURE -15: Xaa=Ala or Pro or Ser or Thr
  UNSURE -14: Xaa=Ala or Pro or Ser or Thr
  UNSURE -6: Xaa=His or Leu or Pro or Arg
  UNSURE 32: Xaa=Asp or Glu or Val
  UNSURE 40: Xaa=Asp or Glu
ctctcacggagacggaccacagcaagcagaggctgggggggggaaagacgangaaagaggaggaaaacaaaagctgctacttatggaagatacaaaggagtctaacgtgaagacattttrctccarraatatccnagccatccttggcntcncynctatcatagctgtgatagctttgcntgctgtggggttgacccagaacaaagcattgccagaaaacgttaagtatgggattgtgctggatgcgggttcttctcacacaagtttatacatctataagtggccagcagwwaaggagaatgacacaggcgtggancatcaagtagaagaatgcagggttaaaggtcctggaatctcaaaattt

SEQ ID NO: 197 - DNA, 229 bp, Homo sapiens
  CDS 20..229
  sig_peptide 20..97: score 5.2 seq LIFLPVLLSYIGP/SI
  misc_feature 117: r=a or g
  misc_feature 118: w=a or t
  UNSURE 7: Xaa=His or Gln or Arg
ccagatattctacttcaggatgtatttggccatggtcttactgggagccactcacggattaatatttctccctgtcttactcagttacataggcccatcaattcctgagcacgcccrwcccagtggcagcacagtgggcaagacacacggatgcatcaagccgccagggctcacagcccagcaggaaacaaaaggagagtcactaacctctgaaaatgctttgcagccc

SEQ ID NO: 198 - DNA, 410 bp, Homo sapiens
  CDS 96..410
  sig_peptide 96..221: score 5.8 seq FSPICLSTSLSLA/QV
  misc_feature 355: r=a or g
  UNSURE 45: Xaa=Lys or Arg
agacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaractaatcaagcggctctacgtagacaaatctctgaatctttctacagagttcatc

SEQ ID NO: 199 - DNA, 546 bp, Homo sapiens
  CDS 187..546
  sig_peptide 187..255: score 9.6 seq LLLALLHPTIILA/QQ
agaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaat

SEQ ID NO: 200 - DNA, 357 bp, Homo sapiens
  CDS 67..357
  sig_peptide 67..129: score 3.9 seq VVALLVNLTRLDS/SM
  misc_feature 120: r=a or g
  misc_feature 271: k=g or t
  UNSURE 48: Xaa=Asp or Tyr
aaattttatgagctcattctgaagaggctgacgattttactatctcatttttttcctttctccagaatgggttctgggtgggtcccctgggtggtggctctgctagtgaatctgacccgrctggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtkatgtggggatgtttgtggcattgaccaagctggggcagccagatgctgagcagtggaacagccggctggatctcttggagaggagc

SEQ ID NO: 201 - DNA, 476 bp, Homo sapiens
  CDS 87..476
  sig_peptide 87..167: score 11.6 seq ILLLSTLTGRSYG/QP
agtcagccctggtggttataacctgatgtttcttgctagagacattgatctctacttattctacttttcagctgctccagcccgcgatgaggaaaagtccaggtctgtctgactgtctttgggcctggatcctccttctgagcacactgactggaagaagctatggacagccgtcattacaagatgaacttaaagacaataccactgtcttcaccaggattttggacagactcctagatggttatgacaatcgcctgagaccaggattgggagagcgtgtaaccgaagtgaagactgatatcttcgtcaccagtttcggacccgtttcagaccatgatatggaatatacaatagatgtatttttccgtcaaagctggaaggatgaaaggttaaaatttaaaggacctatgacagtcctccggttaaataacctaatggcaagtaaaatctggactccggacacatttttccacaat

SEQ ID NO: 202 - DNA, 400 bp, Homo sapiens
  CDS 106..399
  sig_peptide 106..159: score 16.3 seq LLLLAGLFSLSQA/QY
actctttcactcctctctctcttcctctctcacacgttctccaacccaaggaggccagacagagggacgtggtcactctctgaaaagttcaacttgagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttccccacggccatgtactgtgacaatcgcaacctcaagt

SEQ ID NO: 203 - DNA, 372 bp, Homo sapiens
  CDS 77..370
  sig_peptide 77..136: score 10.7 seq LTLLLLLLAGDRA/SS
  misc_feature 367: n=a, g, c or t
  UNSURE 77: Xaa=His or Gln
gggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccancatcc

SEQ ID NO: 204 - DNA, 356 bp, Homo sapiens
  CDS 53..355
  sig_peptide 53..112: score 10.7 seq LTLLLLLLAGDRA/SS
  misc_feature 336: n=a, g, c or t
  misc_feature 337: s=g or c
  UNSURE 75: Xaa=Ile or Lys or Met or Asn or Arg or Ser or Thr
agctggctccgaggctggctggctccgcaggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccansacccaacccaccatccaac

SEQ ID NO: 205 - DNA, 438 bp, Homo sapiens
  CDS 261..437
  sig_peptide 261..362: score 4 seq IAVLYLHLYDVFG/DP
  misc_feature 102: r=a or g
  misc_feature 181: n=a, g, c or t
gcggggtgagaggccagggccgagaagggcttcaggacgcgggaggcgcacttgcttcaagtcgcgggcgtgggaacggggttgcaaaacggggcctctttrtccgggcttgcttccggcgtcatggctcaaagggccttcccgaatccttatgctgattataacaaatccctggccgaangtactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcacct

SEQ ID NO: 206 - DNA, 438 bp, Homo sapiens
  CDS 82..438
  sig_peptide 82..207: score 7.4 seq SLSVLVLLLTIIA/VT
  misc_feature 36: k=g or t
  misc_feature 37: n=a, g, c or t
  misc_feature 122: w=a or t
  misc_feature 151: k=g or t
  misc_feature 309: s=g or c
  misc_feature 396: n=a, g, c or t
  UNSURE -29: Xaa=Ile or Asn
  UNSURE -19: Xaa=Gly or Trp
  UNSURE 34: Xaa=Lys or Asn
acccggccccgtgcgctcattggtcgggatgtgtcknctcagcagcctccaacttctcccgaatcccactgattttaggtgatgggcaagtcagaaagtcagatggatataactgatatcawcactccaaagccaaagaagaaacagcgakggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaasactgagccttgtacagactttttcaaatatgcttgcggaggctggttgaaacgtaatgtcattcccgagaccagctcccgttacggnacctttggcattttaagagatgaactagaagtcgttttgaaa

SEQ ID NO: 207 - DNA, 516 bp, Homo sapiens
  CDS 160..516
  sig_peptide 160..285: score 7.4 seq SLSVLVLLLTIIA/VT
  misc_feature 168: k=g or t
  misc_feature 372: n=a, g, c or t
  misc_feature 373: n=a, g, c or t
  misc_feature 374: r=a or g
  misc_feature 474: n=a, g, c or t
  UNSURE -40: Xaa=Lys or Asn
  UNSURE 29: Xaa=His or Gln
  UNSURE 30: Xaa=Cys or Asp or Gly or His or Asn or Arg or Ser or Tyr
atagttccctgcggcctctgccttggggagttatgttttgttaccgagatccgcgctaccagattgcaccggggctgatttgggggctgggaatttgccattctgctgtacagacactgattttttttttcttctttttaaaaagcaagattttaggtgatgggcaaktcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccannrcatggatgccaccactgagccttgtacagactttttcaaatatgcttgcggaggctggttgaaacgtaatgtcattcccgagaccagctcccgttacggnacctttggcattttaagagatgaactagaagtcgttttgaaa

SEQ ID NO: 208 - DNA, 311 bp, Homo sapiens
  CDS 15..311
  sig_peptide 15..86: score 4.6 seq QGMLLAILEXCGA/IP
  misc_feature 75: r=a or g
  UNSURE -4: Xaa=Glu or Lys
tcctcaagttcttcatggtcaagtccgtcatctttctttccttctggcaaggcatgctcctggccatcctggagragtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaagtgccaacatacggcccttacggccgctgtgcccccatgaagagcatctccagcagcctcaaggag

SEQ ID NO: 209 - DNA, 435 bp, Homo sapiens
  CDS 29..433
  sig_peptide 29..82: score 12.7 seq LWVLLPLVTMAWG/QY
  misc_feature 268: r=a or g
gacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacrccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacag

SEQ ID NO: 210 - DNA, 432 bp, Homo sapiens
  CDS 61..432
  sig_peptide 61..126: score 9.1 seq LLLLSGALALTET/WA
  misc_feature 40: r=a or g
  misc_feature 49: y=c or t
  misc_feature 71: y=c or t
  misc_feature 85: s=g or c
  misc_feature 105: r=a or g
  misc_feature 163: k=g or t
  misc_feature 166: r=a or g
  misc_feature 202: n=a, g, c or t
  misc_feature 227: w=a or t
  misc_feature 253: r=a or g
  misc_feature 266: n=a, g, c or t
  misc_feature 269: m=a or c
  misc_feature 273: s=g or c
  misc_feature 282: r=a or g
  misc_feature 319: r=a or g
  misc_feature 321: s=g or c
  UNSURE -19: Xaa=Met or Thr
  UNSURE -14: Xaa=Leu or Val
  UNSURE 13: Xaa=Ala or Ser
  UNSURE 14: Xaa=Met or Val
  UNSURE 26: Xaa=Ala or Pro or Ser or Thr
  UNSURE 34: Xaa=Leu or Gln
  UNSURE 43: Xaa=Ala or Thr
  UNSURE 47: Xaa=Lys or Met or Arg or Thr
  UNSURE 48: Xaa=Ala or Glu
  UNSURE 65: Xaa=Asp or Glu or Lys or Asn
agtcccggttctaaagtccccagtcacccacccggactcrgattctccycagacgccgagatgcgggtcayggcgccccgaaccstcctcctgctgctctcgggrgccctggccctgaccgagacctgggccggctcccactccatgaggtatttctacacckccrtgtcccggcccggccgcggggagccccgcttcatcncagtgggctacgtggacgacacgcwgttcgtgaggttcgacagcgacgccrcgagtccgagganggmgccscgggcgccrtggatagagcaggaggggccggagtattgggaccggrasacacagatctccaagaccaacacacagacttaccgagagaacctgcgcaccgcgctccgctactacaaccagagcgaggccgggtctcacatcatccagaggatgtacggc

SEQ ID NO: 211 - DNA, 358 bp, Homo sapiens
  CDS 61..357
  sig_peptide 61..132: score 9.4 seq LLSGALALTETWA/XS
  misc_feature 43: n=a, g, c or t
  misc_feature 49: y=c or t
  misc_feature 71: y=c or t
  misc_feature 85: s=g or c
  misc_feature 105: r=a or g
  misc_feature 133: k=g or t
  misc_feature 186: r=a or g
  misc_feature 202: k=g or t
  misc_feature 225: s=g or c
  misc_feature 266: n=a, g, c or t
  misc_feature 282: r=a or g
  misc_feature 332: n=a, g, c or t
  UNSURE -21: Xaa=Met or Thr
  UNSURE -16: Xaa=Leu or Val
  UNSURE 1: Xaa=Cys or Gly
  UNSURE 24: Xaa=Ala or Ser
  UNSURE 45: Xaa=Lys or Met or Arg or Thr
  UNSURE 67: Xaa=Cys or Phe or Ser or Tyr
agtcccggttctaaagtccccagtcacccacccggactcggantctccycagacgccgagatgcgggtcayggcgccccgaaccstcctcctgctgctctcgggrgccctggccctgaccgagacctgggcckgctcccactccatgaggtatttctacaccgccgtgtcccggcccggccgcggrgagccccgcttcatckcagtgggctacgtggacgacacscagttcgtgaggttcgacagcgacgccgcgagtccgagganggagccccgggcgccrtggatagagcaggaggggccggagtattgggaccggaacacacagatctncaagaccaacacacttcgcaggagat

SEQ ID NO: 212 - DNA, 529 bp, Homo sapiens
  CDS 62..529
  sig_peptide 62..127: score 9.9 seq XLLLSGALALTQT/WA
  misc_feature 40: r=a or g
  misc_feature 89: s=g or c
  misc_feature 109: y=c or t
  misc_feature 139: y=c or t
  misc_feature 159: y=c or t
  misc_feature 173: n=a, g, c or t
  UNSURE -13: Xaa=Leu or Val
  UNSURE 11: Xaa=Phe or Ser
  UNSURE 16: Xaa=Gly or Arg or Trp
agtcccggttctaaagtccccagtcacccacccggactcrgattctccccagacgccgaggatggccgtcatggcgccccgaaccctcstcctgctactctcgggggcyctggccctgacccagacctgggcgggctcycactccatgaggtatttctycacatccgtgtccnggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctct

SEQ ID NO: 213 - DNA, 424 bp, Homo sapiens
  CDS 64..423
  sig_peptide 64..114: score 9.3 seq SLLLLLSGALALT/DT
aggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatg

SEQ ID NO: 214 - DNA, 435 bp, Homo sapiens
  CDS 24..434
  sig_peptide 24..74: score 8.4 seq TLLLLLSEALALT/QT
ctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatggctgcgagctggggcccgaaggcgcttcctccgcgggtatgacagttcgcc

SEQ ID NO: 215 - DNA, 301 bp, Homo sapiens
  CDS 100..300
  sig_peptide 100..162: score 10.5 seq VLGLCLLSVGVWG/QD
ctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcg

SEQ ID NO: 216 - DNA, 399 bp, Homo sapiens
  CDS 87..398
  sig_peptide 87..146: score 7.4 seq FGMVFSLLQVVSG/ES
  misc_feature 283: y=c or t
  UNSURE 46: Xaa=Ile or Thr
ttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacaycaccaatctggaatttgaaatatgtggggccctcgtggaggtaaagtgcctgaatttcaggaaactacaagagatatatttcatcgagacaaagaaattcttactgattggaaaga

SEQ ID NO: 217 - DNA, 466 bp, Homo sapiens
  CDS 20..466
  sig_peptide 20..91: score 3.8 seq LLRLLQSGRRVHS/VA
  misc_feature 229: n=a, g, c or t
  misc_feature 230: n=a, g, c or t
  UNSURE 47: Xaa=Phe or Ile or Leu or Val
aagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcnnttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtc

SEQ ID NO: 218 - DNA, 271 bp, Homo sapiens
  CDS 46..270
  sig_peptide 46..180: score 6.5 seq LLLLVLHPSRXSA/VS
  misc_feature 123: n=a, g, c or t
  misc_feature 173: w=a or t
  UNSURE -20: Xaa=Phe or Leu
  UNSURE -3: Xaa=His or Leu
ataaaatggcgcgtgctgcaacccgcgcccgcttcggagagagaaatgctggggtgcagcttcaagcttaggaccacccaccatgcctatccaggtgctgaagggcctgaccatcactcattnaagaacagaggaggctgcctgttactcctggtgttgcatccctccagacwctctgctgtttcctgcctaggcgtggctgcagccatggctaggaaagtgctgccacccacccacctgggccagagctggttctgctcctgctgcaggg

SEQ ID NO: 219 - DNA, 311 bp, Homo sapiens
  CDS 135..311
  sig_peptide 135..185: score 8.9 seq ILIIGILLPQSLA/HP
gcccagtcgcgccgccagcgggctgagggtaggaagtagccgctccgcagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgg

SEQ ID NO: 220 - DNA, 813 bp, Homo sapiens
  CDS 182..811
  sig_peptide 182..277: score 8.1 seq FLLFFWLDRSVLA/KE
aaaaaaatttacatgacattatttacataccaaacctgccctacgcttcctggaaactttactacttatgagtgtggctcctccttccctttcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacga

SEQ ID NO: 221 - DNA, 717 bp, Homo sapiens
  CDS 182..715
  sig_peptide 182..277: score 8.1 seq FLLFFWLDRSVLA/KE
  misc_feature 384: n=a, g, c or t
  UNSURE 36: Xaa=Ala or Glu or Gly or Val
aaaaaaatttacatgacattatttacataccaaacctgccctacgcttcctggaaactttactacttatgagtgtggctcctccttccctttcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttgctgggcatggagcagcattatgaacttggagagtatataagaaagagatatagaaaattcttgaatgagtcctataaacatgnacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacga

SEQ ID NO: 222 - DNA, 237 bp, Homo sapiens
  CDS 78..236
  sig_peptide 78..137: score 11.3 seq VLLLWGILGAIQA/QQ
  misc_feature 36: s=g or c
actcggcgcccgcgcctcgggccgtcgggagcggasctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacct

SEQ ID NO: 223 - DNA, 485 bp, Homo sapiens
  CDS 167..484
  sig_peptide 167..205: score 6.4 seq MWGDLWLLPXASA/NP
  misc_feature 195: y=c or t
  misc_feature 266: d=a or g or t
  misc_feature 340: n=a, g, c or t
  misc_feature 341: k=g or t
  misc_feature 355: r=a or g
  misc_feature 356: n=a, g, c or t
  misc_feature 357: n=a, g, c or t
  UNSURE -4: Xaa=Leu or Pro
  UNSURE 21: Xaa= *  or Glu or Lys
  UNSURE 45: Xaa=Lys or Asn
  UNSURE 46: Xaa=Ala or Ser
  UNSURE 51: Xaa= *  or Ala or Glu or Gly or Lys or Leu or Met or Pro or Gln or Arg or Ser or Thr or Val or Trp
tttccggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcagacccttgtctgagaccgagctatgtggggcgacctctggctcctcccgcytgcctctgccaatccgggcactgggacagaggctgagtttgagaaagctgcagaggaggttaggcaccttdagaccaagccatcggatgaggagatgctgttcatctatggccactacaaacaagcaactgtgggcgacataaankcagaacggcccggrnngttggacttcacgggcaaggccaagtgggatgcctggaatgagctgaaagggacttccaaggaagatgccaatgaaagcttacatcaacaaagtagaagagctaaagaaaaaatacgggataatgaga

SEQ ID NO: 224 - DNA, 443 bp, Homo sapiens
  CDS 175..441
  sig_peptide 175..234: score 11.6 seq ILGLLTAVPPASC/QQ
  misc_feature 325: n=a, g, c or t
  misc_feature 326: n=a, g, c or t
  misc_feature 412: m=a or c
  UNSURE 31: Xaa=Ala or Cys or Asp or Phe or Gly or His or Ile or Leu or Asn or Pro or Arg or Ser or Thr or Val or Tyr
atccgacgcccgtcttcgtgtctcctccctccctcgccttcctccttcctagctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcnnccacttctggtgccaggaggagccggagcctgcacacatgatcctgaccgtcggaaacaaggcagatggagtcctggtgggaaacmgatggaaaggtactcttcgatggcgggccag

SEQ ID NO: 225 - DNA, 397 bp, Homo sapiens
  CDS 106..396
  sig_peptide 106..156: score 5.7 seq LLYYALCFSLSKA/SA
  misc_feature 63: k=g or t
agaacaaagataaggcatcacggacaccacaccgggcacgagctcacaggcaagtcaagctgkgaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtgagactcctgatgtccctaactgggccaggctctcttctgggatttagacaag

SEQ ID NO: 226 - DNA, 204 bp, Homo sapiens
  CDS 44..202
  sig_peptide 44..106: score 8.9 seq VLLFSGFWGLAMG/AF
  misc_feature 38: w=a or t
agagagaaagagagagcgcgcgccagggagaggagaawagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccag

SEQ ID NO: 227 - DNA, 502 bp, Homo sapiens
  CDS 114..500
  sig_peptide 114..257: score 4.7 seq LFTLSHITQLVLS/HN
  misc_feature 24: s=g or c
  misc_feature 251: m=a or c
  misc_feature 354: n=a, g, c or t
  UNSURE 33: Xaa= *  or Glu or Lys or Gln
agggcgtgttcgctgttcagtgcsggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtmctcagccataacaagctaacaatggtgccaccgaacatcgcagaactgaagaatttggaggtgctcaacttttttaataaccaaatcgaggagctgcccacanagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaactt

SEQ ID NO: 228 - DNA, 355 bp, Homo sapiens
  CDS 11..355
  sig_peptide 11..70: score 4.3 seq VGCLPVLCSGTAG/HL
  misc_feature 241: n=a, g, c or t
  UNSURE 57: Xaa=Arg or Ser
ggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagncacctgatgagccagcagtatagaccatatagtttcttcactaaattgactgcagatgagctgtggaaaggcgctttagcagagactggtgctggagcaaaaaaaggaagaggc

SEQ ID NO: 229 - DNA, 376 bp, Homo sapiens
  CDS 213..374
  sig_peptide 213..320: score 8.3 seq LCLLVFVCLQSLS/AM
taatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgccc

SEQ ID NO: 230 - DNA, 424 bp, Homo sapiens
  CDS 190..423
  sig_peptide 190..285: score 11 seq LGLLLSVLAATLA/QA
  misc_feature 341: s=g or c
  UNSURE 19: Xaa=Arg or Thr
aactttgctcaaagtcgctggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccasgggcgacctgctggtgggccgagctgacagactgactgcctcatccacttgtggcctgaatggccccagcctactgcatcgtc

SEQ ID NO: 231 - DNA, 503 bp, Homo sapiens
  CDS 124..501
  sig_peptide 124..186: score 7.7 seq GFVVLVLLQCCSA/YK
ggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttct

SEQ ID NO: 232 - DNA, 539 bp, Homo sapiens
  CDS 99..539
  sig_peptide 99..158: score 9.1 seq LLLLLLVFPATVL/FR
  misc_feature 19: y=c or t
  misc_feature 181: y=c or t
  UNSURE 8: Xaa=Leu or Ser
ccctcgctgcccggagccyggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggctygttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgcca

SEQ ID NO: 233 - DNA, 567 bp, Homo sapiens
  CDS 273..566
  sig_peptide 273..314: score 3.7 seq GLTISSLFSRLFG/KK
  misc_feature 49: r=a or g
  misc_feature 56: r=a or g
gtcgccgcggccgccgcgtgacgtggcacagccagagcctaaaggctaraagccgragctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaa

SEQ ID NO: 234 - DNA, 407 bp, Homo sapiens
  CDS 87..407
  sig_peptide 87..146: score 8.4 seq AVVGCLLVPPAEA/NK
  misc_feature 274: n=a, g, c or t
  misc_feature 337: s=g or c
  UNSURE 43: Xaa=Leu or Pro or Gln or Arg
  UNSURE 64: Xaa=Arg or Thr
aggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgcnagtgcctggccatgacgtggaggcctactgcctgctgtgcgagtgcaggtacgaggagcgcasaccaccaccatcaaggtcatcattgtcatctacctgtccgtggtgggtgcctgttgctctacatggcttc

SEQ ID NO: 235 - DNA, 442 bp, Homo sapiens
  CDS 87..440
  sig_peptide 87..200: score 6.3 seq GLSISLRLTGSSA/QE
  misc_feature 8: m=a or c
  misc_feature 16: n=a, g, c or t
  misc_feature 30: m=a or c
  misc_feature 60: m=a or c
gctcaacmtggcggcnttctgtgccacgcmccctccgctaacgggcacgttactccgtcmgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggcggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattga

SEQ ID NO: 236 - DNA, 445 bp, Homo sapiens
  CDS 129..443
  sig_peptide 129..191: score 9.5 seq LGLVLCLAQTIHT/QE
  misc_feature 332: s=g or c
  misc_feature 410: m=a or c
  UNSURE 47: Xaa= *  or Tyr
aagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatasaatgatactgaagatgtgtctcaagctagtccatctgagtcagaggccagattccgcattgactcagtaagtgaaggmaatgccgggccttatcgctgcatctattataagcc

SEQ ID NO: 237 - DNA, 375 bp, Homo sapiens
  CDS 75..374
  sig_peptide 75..128: score 11.7 seq VLLLLLLVEQAAA/LG
gactctgtggtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgatggagtctccctctatcaccaggctggagtgcagtggcatgatctgggctcactgcaacctctgcctcccgggttcaagagattctcgtgcttcagcctccc

SEQ ID NO: 238 - DNA, 423 bp, Homo sapiens
  CDS 90..422
  sig_peptide 90..167: score 8.9 seq GLLWAFCAPGARA/EE
  misc_feature 406: s=g or c
  UNSURE 80: Xaa=Ser or Thr
gaagccgaggaagagcgttttggggacgggggctggtgaggctcacgttggagggcttcgcgtctgcttcggagaccgtaaggatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggastgaacaggcaccactaa

SEQ ID NO: 239 - DNA, 450 bp, Homo sapiens
  CDS 67..450
  sig_peptide 67..138: score 3.8 seq VVALAGVLQSGFQ/EL
  misc_feature 34: s=g or c
  misc_feature 438: m=a or c
  UNSURE 100: Xaa= *  or Tyr
gatagcgttttgcccgcattcggggcgcgcggastggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggttacccctttgctttgttttatcggcattaccttttctacaaggagacctacctcatccacctcttccatacctttacaggcctctcaattgcttattttaactttggaaaccagctctaccactccctgctgtgtattgtgcttcagttcctcatccttcgactaatgggccgcaccatcactgccgtcctcactaccttttgcttccagatggcctamcttctggctgga

SEQ ID NO: 240 - DNA, 500 bp, Homo sapiens
  CDS 311..499
  sig_peptide 311..415: score 5.1 seq FLLFRSLPRXXFG/LV
  misc_feature 104: y=c or t
  misc_feature 163: k=g or t
  misc_feature 164: k=g or t
  misc_feature 406: n=a, g, c or t
  misc_feature 407: r=a or g
  misc_feature 408: n=a, g, c or t
  misc_feature 424: n=a, g, c or t
  misc_feature 445: s=g or c
  misc_feature 448: m=a or c
  misc_feature 449: s=g or c
  UNSURE -4: Xaa=His or Gln
  UNSURE -3: Xaa=Ala or Asp or Gly or Ile or Asn or Ser or Thr or Val
  UNSURE 3: Xaa=His or Gln
  UNSURE 10: Xaa= *  or Tyr
  UNSURE 11: Xaa=Phe or Leu
  UNSURE 12: Xaa=Asp or His
attattggttgggggaaacccacgaggggacgcggccgaggagggtcgctgtccacccgggggcgtgggagtgaggtaccagattcagcccatttggccccgaygcctctgttctcggaatccgggtgctgcggattgaggtcccggttcctaacgaatctckkgctggattggccgtaaccctgtccccgagcgggctcacagggtctgaaggccacgcatgaggcaaaggtaaagttctgagccacccggtgcctccttcccaggactgcaagatggaggaaggcgggaactaggaggcctgattaagatggtccatctactggtcttgtcaggtgcctggggcatgcaaatgtgggtgaccttcgtctcaggcttcctgcttttccgaagccttccccgacanrncttcggactagtgcanggcaaactcttccccttctasttmsacatctccatgggctgtgcttcatcaacctctgcatcttggcttcacagca

SEQ ID NO: 241 - DNA, 419 bp, Homo sapiens
  CDS 194..418
  sig_peptide 194..265: score 6.6 seq KMVHLLVLSGAWG/MQ
  misc_feature 71: s=g or c
  misc_feature 73: s=g or c
  misc_feature 143: k=g or t
attattggttgggggaaacccacgaggggacgcggccgaggagggtcgctgtccacccgggggcgtgggastsagaatctctgctggattggccgtaaccctgtccccgagcgggctcacagggtctgaaggccacgcatgakgcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgcttcatcaacctctgcatcttggcttcacagca

SEQ ID NO: 242 - DNA, 487 bp, Homo sapiens
  CDS 114..485
  sig_peptide 114..170: score 7.4 seq LIWASSFFTLSLQ/KP
ttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgac

SEQ ID NO: 243 - DNA, 365 bp, Homo sapiens
  CDS 71..364
  sig_peptide 71..187: score 4.9 seq IILVGLLHMVLLS/IP
acttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttactcttcccg

SEQ ID NO: 244 - DNA, 490 bp, Homo sapiens
  CDS 215..490
  sig_peptide 215..274: score 3.5 seq IVLGTGLTECILS/GI
  misc_feature 15: y=c or t
  misc_feature 16: n=a, g, c or t
  misc_feature 17: n=a, g, c or t
  misc_feature 18: n=a, g, c or t
  misc_feature 401: m=a or c
  misc_feature 427: m=a or c
  UNSURE 43: Xaa=Pro or Thr
  UNSURE 51: Xaa=Asp or Glu
ccctcccctcctcgynnnctcccctcctctccgcgcccagttcttctcttcccgtctgaggtggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagagagtgcatctataacaccattggaagatttatacaaaagatttaaaataccaggatcaccamccgagtcaatggggagaggaagagamtggaatgttgacttgattcccaagttccttatggctaatggtcagctggttaagatgctgctt

SEQ ID NO: 245 - DNA, 508 bp, Homo sapiens
  CDS 245..508
  sig_peptide 245..289: score 9.6 seq EYVLLLFLALCSA/KP
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctca

SEQ ID NO: 246 - DNA, 435 bp, Homo sapiens
  CDS 45..434
  sig_peptide 45..113: score 11.2 seq GLLLLLWGSCTFG/LP
  misc_feature 248: m=a or c
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacmcttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcg

SEQ ID NO: 247 - DNA, 615 bp, Homo sapiens
  CDS 269..613
  sig_peptide 269..364: score 5 seq LCLLSLLPSGFMS/LD
  misc_feature 461: r=a or g
  misc_feature 541: s=g or c
  misc_feature 542: s=g or c
  misc_feature 543: n=a, g, c or t
  misc_feature 555: s=g or c
  misc_feature 567: s=g or c
  misc_feature 580: r=a or g
  UNSURE 33: Xaa=Gly or Ser
  UNSURE 60: Xaa=Ala or Glu or Gly or Leu or Pro or Gln or Arg or Val
  UNSURE 64: Xaa=Ser or Thr
  UNSURE 68: Xaa=Ser or Thr
aaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctrgtacccttggaagtaccagcctgcaccctgtgtctcaacatggcaatgaggccacaacaaacatcacagaaacgacagtssngttcacatctasctctgtgataasctcagtttatggraacacaaactcttctgtccagtcacagacctctgt

SEQ ID NO: 248 - DNA, 555 bp, Homo sapiens
  CDS 316..555
  sig_peptide 316..420: score 3.6 seq LEPGLSSSAACNG/KE
aaggttttccgtcagaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaa

SEQ ID NO: 249 - DNA, 430 bp, Homo sapiens
  CDS 188..430
  sig_peptide 188..265: score 8.8 seq AVLVLLFVSTIVS/QW
  misc_feature 55: s=g or c
  misc_feature 56: n=a, g, c or t
  misc_feature 68: s=g or c
  misc_feature 331: n=a, g, c or t
gttaaaggggaacgccaggagcctcccactgcccccttgcttcgcgcgcgcgcasncccgcagcgcastttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggnaaatgtccaccactgttcttcatcatcaccaaacgaatggctgcagtctgtccaggccaccatgatcctgtcgatcatcttcagcattctgtctctgta

SEQ ID NO: 250 - DNA, 240 bp, Homo sapiens
  CDS 88..240
  sig_peptide 88..165: score 8.8 seq AVLVLLFVSTIVS/QW
ctccgtcgctcggcccagtgcgttcggcctcacgcccagcgctctcctcgcaggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgcccac

SEQ ID NO: 251 - DNA, 346 bp, Homo sapiens
  CDS 147..344
  sig_peptide 147..194: score 10.5 seq LWRLVSLLALSQA/LP
  misc_feature 96: n=a, g, c or t
  misc_feature 294: n=a, g, c or t
  UNSURE 34: Xaa=Leu or Met or Val
actctctccacaaactgcccaggagtgagtagctgctttcggtccgccggacacaccggacagatagacgtgcggacggcccaccaccccagcccnccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcntggacccggactctgtcacacccacccatgttactataaactacctgtattt

SEQ ID NO: 252 - DNA, 468 bp, Homo sapiens
  CDS 30..467
  sig_peptide 30..89: score 6.6 seq SALAARLLQPAHS/CS
  misc_feature 127: n=a, g, c or t
  UNSURE 13: Xaa=Ala or Asp or Gly or Val
ccctcccggcgcagtcaccggcgcggtctatggctgcgacttctctaatgtctgctttggctgcccggctgctgcagcccgcgcacagctgctcccttcgccttcgccctttccacctcgcggcagntcgaaatgaagctgttgtcatttctggaaggaaactggcccagcagatcaagcaggaagtgcggcaggaggtagaagagtgggtggcctcaggcaacaaacggccacacctgagtggatcctggttggcgagaatcctgcaagtcactcctatgtcctcaacaaaacccagggcggctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatg

SEQ ID NO: 253 - DNA, 349 bp, Homo sapiens
  CDS 134..349
  sig_peptide 134..193: score 10.6 seq LLLLLPLVHVSAT/TP
ataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgc

SEQ ID NO: 254 - DNA, 364 bp, Homo sapiens
  CDS 53..364
  sig_peptide 53..97: score 12.6 seq WLLLLGLVALSEC/IM
  misc_feature 332: n=a, g, c or t
  misc_feature 343: m=a or c
  UNSURE 79: Xaa=Asp or His or Asn or Tyr
gcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttnacaccggctcmtccaacctgtgggtgccctca

SEQ ID NO: 255 - DNA, 471 bp, Homo sapiens
  CDS 180..470
  sig_peptide 180..236: score 5.9 seq ALMYLGSLAFLGA/DT
  misc_feature 470: r=a or g
aactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccggggra

SEQ ID NO: 256 - DNA, 315 bp, Homo sapiens
  CDS 67..315
  sig_peptide 67..138: score 10.5 seq LVLVSMLALGTLA/EA
aaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaa

SEQ ID NO: 257 - DNA, 486 bp, Homo sapiens
  CDS 173..484
  sig_peptide 173..256: score 5.3 seq ASCLVLAARHASA/SS
gaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgct

SEQ ID NO: 258 - DNA, 278 bp, Homo sapiens
  CDS 83..277
  sig_peptide 83..133: score 11.5 seq LLPILLLSGWAFC/SQ
  misc_feature 33: s=g or c
acttctcttttccctagactgcagccagcggasccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacacca

SEQ ID NO: 259 - DNA, 338 bp, Homo sapiens
  CDS 133..336
  sig_peptide 133..213: score 5.7 seq LVSLFCSCFLADP/LN
  misc_feature 310: n=a, g, c or t
  UNSURE 33: Xaa= *  or Gly or Arg
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaangaagagctcaggcagacacggtggacct

SEQ ID NO: 260 - DNA, 499 bp, Homo sapiens
  CDS 112..498
  sig_peptide 112..180: score 10.6 seq CMLLLAFSSWSLC/SD
  misc_feature 440: n=a, g, c or t
  misc_feature 441: n=a, g, c or t
  UNSURE 87: Xaa=Ile or Lys or Met or Asn or Arg or Ser or Thr
atatagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaanntgtcacagcagggcttttcaacactgggagttaatccaggaagatattcttgatactg

SEQ ID NO: 261 - DNA, 455 bp, Homo sapiens
  CDS 63..455
  sig_peptide 63..155: score 11.5 seq LLLFLLGPRLVLA/IS
  misc_feature 277: s=g or c
  UNSURE 41: Xaa=Ser or Thr
acgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcascacctcaagatcacagattctgctggccatattctctactccaaagaggatgcaaccaaggggaaatttgcctttaccactgaagattatgacatgtttgaagtgtgttttgagagcaagggaacagggaacagggcggatacctgaccaactcgtgatcctagacatgaagcatgga

SEQ ID NO: 262 - DNA, 352 bp, Homo sapiens
  CDS 32..352
  sig_peptide 32..70: score 3.5 seq MAATLLAARGAGP/AP
  misc_feature 133: r=a or g
  misc_feature 134: y=c or t
  UNSURE 22: Xaa=Pro or Ser
agttgctttgaggcagtaccggaggagaaagatggcggctaccttactagctgctcggggagccgggccagcaccggcttgggggccggagggttcactccagactgggaaagccgagaagtttccactgggrycctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcg

SEQ ID NO: 263 - DNA, 426 bp, Homo sapiens
  CDS 156..425
  sig_peptide 156..197: score 15 seq LLPLLLLLPMCWA/VE
cgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaacc

SEQ ID NO: 264 - DNA, 432 bp, Homo sapiens
  CDS 105..431
  sig_peptide 105..161: score 8.1 seq LLGVLVVSPDALG/ST
  misc_feature 415: s=g or c
  UNSURE 85: Xaa= *  or Ser
agtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatsagtgccccaggaaaccc

SEQ ID NO: 265 - DNA, 284 bp, Homo sapiens
  CDS 108..284
  sig_peptide 108..170: score 11.2 seq LLCLFSLLTQVTT/EP
  misc_feature 104: s=g or c
  misc_feature 251: r=a or g
agaggtcctttggctgctgccttaagacgtgcagcctgggccgtggctgtcactgcgttcggacccagacccgctgcaggcagcagcagcccccgcccgcgcasagcatggagctctggggggcctacctcctcctctgcctcttctccctcctgacccaggtcaccaccgagccaccaacccagaagcccaagaagattgtaaatgccaagaaagatgttgtgaacacaaagatgtttgaggagctcaaragccgtctggacaccctggcccaggaggtggcc

SEQ ID NO: 266 - DNA, 211 bp, Homo sapiens
  CDS 58..210
  sig_peptide 58..165: score 5.4 seq LLCYPGWSAVAQS/QL
gacgtagcaatgagccggaatcagaaagcaagctctagttctactgtttcctaatgcatgattcaggccacatcactgtcttccttgattcttggtttttcttttcttttttttgaagatggggtcttgctgtgttacccaggctggagtgcagtggcacaatcacagctcactgcagcatcagtcttctgggatcaagtgattctcccac

SEQ ID NO: 267 - DNA, 473 bp, Homo sapiens
  CDS 8..472
  sig_peptide 8..115: score 10.1 seq SFVVLALFAVTQA/EE
ctttcggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcactggacagggaggaatcctggctcagcg

SEQ ID NO: 268 - DNA, 453 bp, Homo sapiens
  CDS 8..451
  sig_peptide 8..115: score 10.1 seq SFVVLALFAVTQA/EE
ctttcggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggccctgggaatcccactgcacttggcctacaattccagcctggtcaccttccaagagcccccgggggtcaacaccacagagctgccatcctt

SEQ ID NO: 269 - DNA, 364 bp, Homo sapiens
  CDS 105..362
  sig_peptide 105..227: score 3.9 seq ALFLCGCYVVALG/AH
gagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaa

SEQ ID NO: 270 - DNA, 396 bp, Homo sapiens
  CDS 219..395
  sig_peptide 219..266: score 4.3 seq ALPAAGFLYWVGA/GT
  misc_feature 2: n=a, g, c or t
gnaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggccggggctcggagaatgggcagttgtcacaggtagtactga

SEQ ID NO: 271 - DNA, 414 bp, Homo sapiens
  CDS 108..413
  sig_peptide 108..197: score 7.3 seq LKLLILSMAAVLS/FS
ctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtac

SEQ ID NO: 272 - DNA, 288 bp, Homo sapiens
  CDS 55..288
  sig_peptide 55..153: score 9.5 seq LLLGLVMPLAIIA/QV
atcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggtgagctttgggggacattctgct

SEQ ID NO: 273 - DNA, 454 bp, Homo sapiens
  CDS 100..453
  sig_peptide 100..180: score 7.2 seq VLWLSGLSEPGAA/RQ
  misc_feature 324: m=a or c
  misc_feature 338: n=a, g, c or t
  misc_feature 339: n=a, g, c or t
  misc_feature 355: r=a or g
  UNSURE 48: Xaa=Asp or Glu
  UNSURE 53: Xaa=Ile or Lys or Met or Asn or Arg or Ser or Thr
  UNSURE 59: Xaa=Ala or Thr
gtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagamgaatatctggttannatcaggttcacgccarcagtacctcattgctctttggcgactcttattgggctgtgcttaagagtaaaacttcagcgatgtttaccatttaaacataagttggaaatctacattt

SEQ ID NO: 274 - DNA, 399 bp, Homo sapiens
  CDS 81..398
  sig_peptide 81..152: score 10 seq LLLLQALPSPLSA/RA
  misc_feature 251: y=c or t
gaagaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgyaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgag

SEQ ID NO: 275 - DNA, 272 bp, Homo sapiens
  CDS 118..270
  sig_peptide 118..180: score 14.3 seq LLLCAVLLSLASA/SS
gcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcgggtcagtatccgccccctcgggctgaaggcccagagcctccgccccccagcctctacagccggcggggccgtggggactccaggct

SEQ ID NO: 276 - DNA, 448 bp, Homo sapiens
  CDS 15..446
  sig_peptide 15..155: score 7.1 seq SLLFLLMGLRASG/KD
  misc_feature 401: s=g or c
  misc_feature 420: r=a or g
  UNSURE 82: Xaa= *  or Tyr
  UNSURE 89: Xaa=Gly or Arg
gaaaatagatcatcatggtggcaccaaagagtcacacagatgactgggctcctgggcctttctccagtaagccacagaggagtcagctgcaaatattctcttctgttctacagacctctctcctcttcctgctcatgggactaagagcctctggaaaggactcagccccaacagtggtgtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctasaaagcccagataaaccaarggaattttgaagtcaccactgaggagga

SEQ ID NO: 277 - DNA, 552 bp, Homo sapiens
  CDS 207..551
  sig_peptide 207..284: score 10 seq LWLALVSCILTQA/SA
ttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcatgcctacctgcgagacccaactgcagcagcatcttgcag

SEQ ID NO: 278 - DNA, 503 bp, Homo sapiens
  CDS 207..503
  sig_peptide 207..284: score 10 seq LWLALVSCILTQA/SA
  misc_feature 302: y=c or t
  misc_feature 303: w=a or t
  misc_feature 309: r=a or g
  misc_feature 460: n=a, g, c or t
  misc_feature 498: r=a or g
  UNSURE 7: Xaa=Asn or Tyr
  UNSURE 9: Xaa=Asp or Asn
  UNSURE 59: Xaa= *  or Leu or Ser
  UNSURE 72: Xaa=Gly or Arg
ttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggywatggaraccccattgaagccagtatgtatgggctggacctggactccggagctcctggcaccccagaggctcatgtctgttttgacccctgtcagaattacaccatcctggatgaacccttccgaagcacagagaactcagcagggggggtgcgatnaaaacatgagcggctggtaccgctttgtaggggaaggrggagt

SEQ ID NO: 279 - DNA, 416 bp, Homo sapiens
  CDS 262..414
  sig_peptide 262..306: score 6.4 seq RLLLSGLSPKALT/LG
ttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagaattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggccaggagagaacac

SEQ ID NO: 280 - DNA, 343 bp, Homo sapiens
  CDS 68..343
  sig_peptide 68..136: score 9.1 seq GLLAAGFCPAVLC/HP
  misc_feature 92: r=a or g
  UNSURE -15: Xaa=Ala or Thr
ccactactccagacagacggctttggaatccaccagctacatccagctccctgaggcagagttgagaatggagagaatgttacctctcctgrctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagctgggagtccgcctcagggatcgtggagttctgggtagatgggaagcccagggtgaggaagagtctgaagaagggatacactgtgggggc

SEQ ID NO: 281 - DNA, 554 bp, Homo sapiens
  CDS 68..553
  sig_peptide 68..136: score 9.1 seq GLLAAGFCPAVLC/HP
  misc_feature 92: r=a or g
  misc_feature 473: r=a or g
  misc_feature 492: w=a or t
  misc_feature 493: y=c or t
  misc_feature 497: y=c or t
  misc_feature 498: n=a, g, c or t
  UNSURE -15: Xaa=Ala or Thr
  UNSURE 113: Xaa=Gly or Ser
  UNSURE 119: Xaa=Asp or Val
  UNSURE 121: Xaa= *  or Leu or Pro or Gln or Arg or Ser
ccactactccagacagacggctttggaatccaccagctacatccagctccctgaggcagagttgagaatggagagaatgttacctctcctgrctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgrgtatgggaaaatgccatgwytgtynaagagcaactcagtctgctggacaggttcacggaggatgccaagaggctgtatggc

SEQ ID NO: 282 - DNA, 435 bp, Homo sapiens
  CDS 160..435
  sig_peptide 160..228: score 9.1 seq GLLAAGFCPAVLC/HP
  misc_feature 112: k=g or t
ccactactccagacagacggctttggaatccaccagctacatccagctccctgaggcaggtaatccatgatgttttacatcctgggagcggaggaatctgtttttccaggakagttttaggcagcagcctggagtgtgtggagtgtgagggagttgagaatggagagaatgttacctctcctgactctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagctgggagtccgcctcagggatcgtggagttctgggtagatgggaagcccagggtgaggaagagtctgaagaagggatacactgtgggggc

SEQ ID NO: 283 - DNA, 646 bp, Homo sapiens
  CDS 160..645
  sig_peptide 160..228: score 9.1 seq GLLAAGFCPAVLC/HP
  misc_feature 112: k=g or t
  misc_feature 565: r=a or g
  misc_feature 584: w=a or t
  misc_feature 585: y=c or t
  misc_feature 589: y=c or t
  misc_feature 590: n=a, g, c or t
  UNSURE 113: Xaa=Gly or Ser
  UNSURE 119: Xaa=Asp or Val
  UNSURE 121: Xaa= *  or Leu or Pro or Gln or Arg or Ser
ccactactccagacagacggctttggaatccaccagctacatccagctccctgaggcaggtaatccatgatgttttacatcctgggagcggaggaatctgtttttccaggakagttttaggcagcagcctggagtgtgtggagtgtgagggagttgagaatggagagaatgttacctctcctgactctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgrgtatgggaaaatgccatgwytgtynaagagcaactcagtctgctggacaggttcacggaggatgccaagaggctgtatggc

SEQ ID NO: 284 - DNA, 383 bp, Homo sapiens
  CDS 168..383
  sig_peptide 168..224: score 9.8 seq LLILQALLLPSLA/DG
acatgacccaaggggagggctcccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaat

SEQ ID NO: 285 - DNA, 440 bp, Homo sapiens
  CDS 101..439
  sig_peptide 101..235: score 6.8 seq IMVLVVAAESVWG/DE
agtacctggtggcatagggcagacacgcctgcagacattctctgggaaagggcagcagcagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggcatggggaccc

SEQ ID NO: 286 - DNA, 315 bp, Homo sapiens
  CDS 143..313
  sig_peptide 143..190: score 3.7 seq VVIGAGVIGLSTA/LC
  misc_feature 264: m=a or c
  misc_feature 308: s=g or c
  UNSURE 25: Xaa=Pro or Gln
  UNSURE 40: Xaa=Leu or Val
gcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcacccmactcaccaccaccgacgtggctgccggcctctggcagccctacstttctga

SEQ ID NO: 287 - DNA, 402 bp, Homo sapiens
  CDS 40..402
  sig_peptide 40..105: score 6.5 seq SLLFLQLPLLGVG/LN
aacagacagactacacccagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggag

SEQ ID NO: 288 - DNA, 434 bp, Homo sapiens
  CDS 201..434
  sig_peptide 201..263: score 8.6 seq FTLCLLLSEMASG/GN
  misc_feature 149: r=a or g
aaatgacaccaggggttagtgattagaagttcacccttgactgtggcacctcccttcagttccgtcgacgaggttgtgcaatccaccagtcttataaatacagtgacgctccagcctctggaagcctctgtcagctcagcctccaaagragccagcctctccccagttcctgaaatcctgggtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacgagggaaggccaagtgctgcaagtgagctgggagtgaccagaagaaatgacgca

SEQ ID NO: 289 - DNA, 305 bp, Homo sapiens
  CDS 144..305
  sig_peptide 144..197: score 7.7 seq AFLFLLGVLGALT/EM
  misc_feature 281: n=a, g, c or t
aattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttcnctggagcacttgaaccccagcatc

SEQ ID NO: 290 - DNA, 448 bp, Homo sapiens
  CDS 234..446
  sig_peptide 234..281: score 7.4 seq VVLLSVSLRRTEA/HL
aacgccttcgcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaatttgctagtttgctaggcagcatcttttggacctgcgaaccatatgcatttcacctcaaatttgtttccaagttgaaaatctttgggtctttcta

SEQ ID NO: 291 - DNA, 452 bp, Homo sapiens
  CDS 25..450
  sig_peptide 25..96: score 5.3 seq CLPVLAAAGRARG/RA
  misc_feature 373: r=a or g
  UNSURE 93: Xaa=Met or Val
aatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcartgcggagagccctgactcacattgaccacagcttgagtcgtcagactgtcctttcctggctggggagacagaatctcta

SEQ ID NO: 292 - DNA, 391 bp, Homo sapiens
  CDS 90..389
  sig_peptide 90..146: score 5.7 seq GLLVLTTPLASLA/PR
  misc_feature 253: m=a or c
  UNSURE 36: Xaa=Ser or Tyr
ttctccgttagtgcttccgggttgcagccagggaagcctccgcggtggtgcaagtggaacccaagccttgaggtttcagcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtmcagccccgtgcaggccacgtttgaggttcttgatttcatcacgcacctctatgctggcgccgacgtccacaggcacttggacgtcagaatcctactgaccaatatccgaaccaagagcacctttctccctcccctgcc

SEQ ID NO: 293 - DNA, 412 bp, Homo sapiens
  CDS 125..412
  sig_peptide 125..172: score 7.7 seq TLLLSLLGAVGLA/AV
  misc_feature 12: m=a or c
  misc_feature 66: s=g or c
acaccgcggggmccaggaggcacgctggttttccggggccgctccatcgcgccttcctcctgcgcstcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgccacggaagcccac

SEQ ID NO: 294 - DNA, 433 bp, Homo sapiens
  CDS 157..432
  sig_peptide 157..195: score 3.8 seq MAHCVTLVQLSIS/CD
  misc_feature 147: r=a or g
  misc_feature 148: s=g or c
agagcgggccgacggcattttgtgaagcggcgaaggaggtggtggctgcgttgggctccgggaagccgttcgggctggggctgtcggccgcggggcggaggcactcgcgcggggggtaattcggggtctgggttctggtgccgcgcrstttccccgatggcccactgcgtgaccttggttcagctgtccatttcctgtgaccatctcattgacaaggacatcggctccaagtctgacccactctgcgtccttttacaggatgtgggagggggcagctgggctgagcttggccggactgaacgggtgcggaactgctcaagccctgagttctccaagactctacagcttgagtaccgctttgagacagtccagaagctacgctttggaatctatgacatagacaacaagacgccagagctgagggatgatgact

SEQ ID NO: 295 - DNA, 435 bp, Homo sapiens
  CDS 197..433
  sig_peptide 197..241: score 5.2 seq WSCLVTGAGGLLG/QR
  misc_feature 42: n=a, g, c or t
  misc_feature 408: s=g or c
  misc_feature 409: w=a or t
  UNSURE 56: Xaa=Ala or Gly
aagggctgagacacaagccacagagcataaagctccagtccntcctccagggatgaggcagtaaggacttggactcctctgtccagcttttaacaatctaagttacgccctcttctgggtcacgctagaatcagatctgctctccagcatcttctgtttcctggcaagtgtttcctgctactttggattggccacgatgggctggagctgccttgtgacaggagcaggagggcttctgggtcagaggatcgtccgcctgttggtggaagagaaggaactgaaggagatcagggccttggacaaggccttcagaccagaattgagagaggaattttctaagctccagaacaggaccaagctgactgtacttgaaggagacattctggatgagccattcctgaaaagagswtgccaggacgtctcggtcgtcatcca

SEQ ID NO: 296 - DNA, 408 bp, Homo sapiens
  CDS 11..406
  sig_peptide 11..73: score 13.2 seq VLLLSLFLLGGQA/QH
ttcattacagatgtgcagcaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcagcctgccctccaccatgcgcatgacagtggctgacggcactgtatacatagcccagcagatgcactttcactggggaggtgcgtcctcggagatcagcggctctgagcacaccgtgga

SEQ ID NO: 297 - DNA, 385 bp, Homo sapiens
  CDS 196..384
  sig_peptide 196..255: score 5.1 seq FILLWSAVGIAKA/AK
  misc_feature 4: s=g or c
  misc_feature 8: k=g or t
  misc_feature 20: y=c or t
  misc_feature 33: n=a, g, c or t
aaascatkgctatcaactgygaacccagagagncctccttagccaacacgctaactccgaagcctcccttacgcccccgaaccaccgaagcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccc

SEQ ID NO: 298 - DNA, 322 bp, Homo sapiens
  CDS 72..320
  sig_peptide 72..134: score 7.6 seq LTPLLCVLHGACP/RA
  misc_feature 280: r=a or g
  UNSURE 49: Xaa=Asn or Ser
acttcttatttctcgtcctgtctctttgcaaagtatgggcttttttgtttttgttttttaagggaaacgaaatggaattcgaagggaccttttcactaaccccacttctgtgtgttctgcatggcgcctgccccagggcatctgccaactccagtatcagctctcacagtgtacttggtaccatccctgggctctgctggcgagacgaaacagctgtagagatgaaaacaggctgcagaggctggcacagctggccggcttttctccatctggggaacartcctactccaagaacactgcacaccagctcctcacacagatc

SEQ ID NO: 299 - DNA, 426 bp, Homo sapiens
  CDS 66..425
  sig_peptide 66..122: score 7.6 seq LPVLLVPFLLCQA/LV
  misc_feature 389: k=g or t
  UNSURE 89: Xaa=Ile or Met
attaattgttcggcgatcgctggctgccgggacttttctcgcgctggtctcttcggtggtcagggatggcgcggaagtcgaacttgcctgtgcttctcgtgccgtttctgctctgccaggccctagtgcgctgctccagccctctgcccctggtcgtcaacacttggccctttaagaatgcaaccgaagcagcgtggagggcattagcatctggaggctctgccctggatgcagtggagagcggctgtgccatgtgtgagagagagcagtgtgacggctctgtaggctttggaggaagtcctgatgaacttggagaaaccacactagatgccatgatcatggatggcactactatggatgtaggagcagtaggagatctcagacgaatkaaaaatgctattggtgtggcacggaaagtactggaac

SEQ ID NO: 300 - DNA, 237 bp, Homo sapiens
  CDS 78..236
  sig_peptide 78..170: score 4.5 seq LLSLPSWASLAYS/YL
tgcctagggttgcccgctgtggcctgctcccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcaccca

SEQ ID NO: 301 - DNA, 394 bp, Homo sapiens
  CDS 166..393
  sig_peptide 166..282: score 4.8 seq IILFSAIVGFIYG/YV
  misc_feature 8: m=a or c
  misc_feature 9: y=c or t
  misc_feature 377: r=a or g
  UNSURE 32: Xaa=His or Arg
gtcggagmytccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcrccggcatcctctcaagt

SEQ ID NO: 302 - DNA, 359 bp, Homo sapiens
  CDS 22..357
  sig_peptide 22..144: score 4.3 seq RVVSWLFSIVVFG/SI
aaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggc

SEQ ID NO: 303 - DNA, 310 bp, Homo sapiens
  CDS 105..308
  sig_peptide 105..149: score 7 seq LLFLLPLVMQGVS/RA
acacagaccccggtgacggaagtgacgtaaggccggggctggagggcagcgctgggctggtcccgcagcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaa

SEQ ID NO: 304 - DNA, 250 bp, Homo sapiens
  CDS 46..249
  sig_peptide 46..144: score 11.5 seq LLSLCCLLPSCLP/AG
  misc_feature 17: m=a or c
  misc_feature 18: w=a or t
gagtgcgagctgaaagmwgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagg

SEQ ID NO: 305 - DNA, 397 bp, Homo sapiens
  CDS 151..396
  sig_peptide 151..291: score 6.8 seq PLGLLRLLQLVST/CV
  misc_feature 381: n=a, g, c or t
tcagacccttccagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctcngtgaccctgatcatcc

SEQ ID NO: 306 - DNA, 299 bp, Homo sapiens
  CDS 83..298
  sig_peptide 83..127: score 11.7 seq SLVLLLCLAQLWG/CH
ctacctttcccagcagagcacctgggttggtcccgaagcctccaaccacctgcacgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagc

SEQ ID NO: 307 - DNA, 414 bp, Homo sapiens
  CDS 208..414
  sig_peptide 208..264: score 5.4 seq LSHLLPSLRQVIQ/EP
  misc_feature 292: m=a or c
  misc_feature 293: y=c or t
  misc_feature 360: m=a or c
  UNSURE 10: Xaa=Leu or Met or Pro or Thr
  UNSURE 32: Xaa= *  or Tyr
tgtttgattggtgtgcctgaaagtgaaggggagaatgaaaacatctgccagctccgccgacccggcccccgcggccctcccagctcggctccggctcagtggacaggaaccactgaagtttgcctgacaccatcaaccaggccctagtcacctggctttgcctttgccctgctgtgtgatcttagctccctgcccaggcccacagccatggccatggcccagaaactcagccacctcctgccgagtctgcggcaggtcatccaggagcctcagctatctctgcagccagagmyggtcttcacggtggatcgagctgaggtgccgccgctcttctggaagccgtacatctatgcgggctamcggccgctgcatcagacctggcgcttctatttccgcacgctgttccagcagcac

SEQ ID NO: 308 - DNA, 279 bp, Homo sapiens
  CDS 30..278
  sig_peptide 30..98: score 7.9 seq LGLWSLCWSLAIA/TP
  misc_feature 250: k=g or t
  UNSURE 51: Xaa=Cys or Phe
gagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtktgtgtggaagagtcacaaatgggaccggg

SEQ ID NO: 309 - DNA, 303 bp, Homo sapiens
  CDS 54..302
  sig_peptide 54..110: score 7.6 seq FALFSCLFGICDA/VT
aatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctacctggggggttgttgctttgagggaagttacgcttattttt

SEQ ID NO: 310 - DNA, 417 bp, Homo sapiens
  CDS 149..415
  sig_peptide 149..265: score 11.6 seq GLLLLQAVSWASG/AR
  misc_feature 7: m=a or c
atcgggmagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtggcgacggatggagctg

SEQ ID NO: 311 - DNA, 246 bp, Homo sapiens
  CDS 42..245
  sig_peptide 42..152: score 5 seq PACLSPSPHLSSA/AN
  misc_feature 143: y=c or t
aagcctgacttcagcgctcccactctcggccgacacccctcatggccaaccgttacaccatggatctgactgccatctacgaggtgagtccccgccgcacggcatccccggtacctgcatgcctgagtccgagtccccacctytctagcgccgcaaactccagcccgggacgcttgcctcccttctccaactggggctccctagcgccgcgccctccagcctggggcccctgcctcccgctcagac

SEQ ID NO: 312 - DNA, 441 bp, Homo sapiens
  CDS 34..441
  sig_peptide 34..84: score 8.7 seq RLVCAFLLAACCC/CP
  misc_feature 383: n=a, g, c or t
  misc_feature 386: n=a, g, c or t
  misc_feature 387: r=a or g
  misc_feature 388: n=a, g, c or t
  UNSURE 100: Xaa=Lys or Met or Arg or Thr
  UNSURE 101: Xaa= *  or Leu or Ser or Trp
  UNSURE 102: Xaa= *  or Glu or Lys or Gln
actcacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgcangtnrnaagcgccctcggtcccaggagtaccgcatccagctccgcgtctacaaagctcc

SEQ ID NO: 313 - DNA, 185 bp, Homo sapiens
  CDS 9..185
  sig_peptide 9..71: score 4 seq AACTAAAPLQAHG/AD
  misc_feature 138: r=a or g
  misc_feature 144: m=a or c
  UNSURE 23: Xaa=Gly or Arg
  UNSURE 25: Xaa=Leu or Met
agtgatggatgatgagaacgacagcgagagtcgctgcgtgtactgctgcagccccattgcaagcccacggtgcagacattcagcaggatccagacagcctctgctctagaaggctcagcagagaaggactttctgcarggcgamtgcaccaaagcgaaacagaagctgaactggaagccccgggt

SEQ ID NO: 314 - DNA, 455 bp, Homo sapiens
  CDS 87..455
  sig_peptide 87..146: score 3.5 seq IVLGTGLTECILS/GI
atctttggtccagtgcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgag

SEQ ID NO: 315 - DNA, 278 bp, Homo sapiens
  CDS 105..278
  sig_peptide 105..179: score 12.2 seq LLTACALLPFAQG/QT
  misc_feature 260: s=g or c
atctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgagggsttccccaacctctacccc

SEQ ID NO: 316 - DNA, 207 bp, Homo sapiens
  CDS 12..206
  sig_peptide 12..140: score 4.1 seq VLITQLCLGKGQS/EP
tcaatccttgaatgctctgggagactgatttgagtaccaataaaactccagtctcctgcacagctggctctgcgtgtgctctttctctattgcaattccctgtcttgataactcagctctgtctaggcaaagggcaaagtgaacccattgggccattacaagattttgtgtctttggaaagcacttcacatttttattctttttttt

SEQ ID NO: 317 - DNA, 391 bp, Homo sapiens
  CDS 149..391
  sig_peptide 149..196: score 6 seq LTALPLFWIMISA/SR
  misc_feature 43: s=g or c
ctagaccctggaaggcaggggactgcgagctgggctggcggasagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtc

SEQ ID NO: 318 - DNA, 458 bp, Homo sapiens
  CDS 203..457
  sig_peptide 203..256: score 11.9 seq ALLFLILANGAQA/FR
  misc_feature 181: w=a or t
agcctcttcctcttttttttcccctcctagccctattcaggcaggagctgctcttctggggtatcgcgatccacttaaggatgaggcagacttggtgacaagctggtctgagcagcgcttccagagccagaactgagcccagtgagagcgcaccctggggcagcctggattcctggggtgwccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcggatactggctcgctgtgacatcatggtgctgcaggaggtggtggactcttccggcagcgccatcccgctcctgcttcgagaactcaatcgatttgatggctctgggccctacagcaccctga

SEQ ID NO: 319 - DNA, 429 bp, Homo sapiens
  CDS 99..428
  sig_peptide 99..152: score 9.9 seq SLLLAALLLLLSG/DG
  misc_feature 167: y=c or t
  misc_feature 299: y=c or t
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgytgcgacacacctgccaactgcacctatcttgacctgctgggcacctgggtcttccaggtgggctccagcggttcccagcgcgatgtcaactgctcggttatgggaccacaagaaaaaaaagtagtggtgtaycttcagaagctggatacagcatatgatgaccttggcaattctggccatttcaccatcatttacaaccaaggctttgagattgtgttgaatgactacaagtggtttgccttttttaagtataaagaagagg

SEQ ID NO: 320 - DNA, 327 bp, Homo sapiens
  CDS 86..325
  sig_peptide 86..133: score 4.6 seq LFPLIFPAEPAQA/SG
  misc_feature 259: s=g or c
  misc_feature 264: s=g or c
  misc_feature 268: s=g or c
  misc_feature 289: n=a, g, c or t
  misc_feature 309: m=a or c
  UNSURE 42: Xaa=His or Gln
  UNSURE 44: Xaa=Ser or Thr
  UNSURE 45: Xaa=Ile or Met
  UNSURE 59: Xaa=Ser or Tyr
aatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccascccascatsaagatcaatggctacacaggnccagggacagtgcgcatctmcctggtcaccaaggaccc

SEQ ID NO: 321 - DNA, 442 bp, Homo sapiens
  CDS 119..442
  sig_peptide 119..214: score 7.2 seq YMLVSLLLIGVAA/WG
  misc_feature 10: y=c or t
  misc_feature 115: r=a or g
  misc_feature 287: s=g or c
  misc_feature 291: k=g or t
  misc_feature 331: m=a or c
  UNSURE 25: Xaa=Leu or Val
  UNSURE 26: Xaa=Leu or Arg
  UNSURE 39: Xaa=His or Gln
gtattgggtytggctggcctcgatttaaagagacagaagctgtcggggtcctggaagacggtccccaataccctccccccaagtccttgggaccacttgggtccccagagctggrgagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttstccktattgcagtggctggactggtgggtgctgtcaaccaccamcaagtcctgctgttcttttacatgatcatccttggtttggtcttcatcttccaatttgtaatctcttgctcatgtctggctattaacgaagcaaacagacagatgtcatca

SEQ ID NO: 322 - DNA, 375 bp, Homo sapiens
  CDS 160..375
  sig_peptide 160..282: score 4.3 seq VASFFHLFFRVSA/II
  misc_feature 114: y=c or t
  misc_feature 120: y=c or t
aaaagcggaggtgaggccggactgaggctcttacagtggtccctgctggcccttggtgacgggtcgcgtcagttccgacccggacccgtacgctgctgcgctgacgtggctccyggaagyagggctggcgtagggccgccatgttgcagcaggatagtaatgatgacactgaagatgtttcactgttttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggca

SEQ ID NO: 323 - DNA, 303 bp, Homo sapiens
  CDS 141..302
  sig_peptide 141..227: score 3.6 seq VMLLVALPCFLQN/CP
  misc_feature 102: k=g or t
cagtagcagagtaagcacaaggttttaatcgagttgcataagacacctttgcatagctatttaattgcccaatgtaaaactttaatgccatttctaatgctkttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctcttttcctttgctgtgcacttgatg

SEQ ID NO: 324 - DNA, 434 bp, Homo sapiens
  CDS 124..432
  sig_peptide 124..195: score 4.3 seq LXFLGMFLSGMVA/QI
  misc_feature 3: s=g or c
  misc_feature 16: w=a or t
  misc_feature 137: k=g or t
  misc_feature 142: r=a or g
  misc_feature 154: k=g or t
  misc_feature 161: k=g or t
  misc_feature 328: r=a or g
  UNSURE -20: Xaa=Gly or Val
  UNSURE -18: Xaa=Ala or Thr
  UNSURE -14: Xaa=Ala or Ser
  UNSURE -12: Xaa=Leu or Arg
  UNSURE 45: Xaa=Gly or Arg
ggsctttggattggawagaggagctgggcaggaggcagggcaaggagaaagctgttcgggggtcttgtctggattttggttgcctcctccaatgttcctctacctctactacaaggatgggtcatgtttgtgtctgkaacarcgtttttctttkcgctcckctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccrggcagccactcctgagtgataaccagtataacataaacgtagcagcctcaatttttgcctttatgacgacagcttgttatggttgcagtttgggtctggctttacg

SEQ ID NO: 325 - DNA, 452 bp, Homo sapiens
  CDS 277..450
  sig_peptide 277..333: score 9.6 seq FCILLAAVSGAEG/WG
  misc_feature 93: s=g or c
  misc_feature 199: k=g or t
  misc_feature 352: n=a, g, c or t
  misc_feature 363: k=g or t
  UNSURE 7: Xaa=Asp or His or Asn or Tyr
agaggctggggaaggggggaggtgagaggaaagagggtggaaaggagaggatagagagacaagagcggaggaccaggaaccagagagagagasagagaaaagagagaggagagacagagcgcttgggggcgaaaggagagagggagggaagggtgggtaaggaggagagagcggtctgctgcaaaccccaggaggagakcttggagcccaagccagaactcgagccctagccggagccgttcacagggaggcggctgccgagaccgtcagccctgcatgatgcatctccggctcttctgcatcctgctcgccgcggtctcaggagccgagggctggggctactacggctgcnacgaggagctkgtgggtcccctgtatgcacgctccctgggcgcctcctcctactacagtctccttactgcgccgcgattcgccaggctgcacggcataag

SEQ ID NO: 326 - DNA, 476 bp, Homo sapiens
  CDS 200..475
  sig_peptide 200..283: score 5.5 seq FLAIVYFCTIVQG/QV
  misc_feature 103: s=g or c
  misc_feature 237: n=a, g, c or t
  UNSURE -16: Xaa=His or Leu or Pro or Arg
agaaggagagggagagagaaagagagagaggctaattaaaaaaggatactccgagggaagagagcaagggcggtgcgccgccaaggaccaactagcggcggasttcgatcttgcctaggcgcggagagctcccaacctgggctggaaccttgcccagcacatgtggctgctacaccccatgtaaaaagcggaaaataaaatgaagattttccagcgcaagatgcggtactggttgcntccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagacc

SEQ ID NO: 327 - DNA, 301 bp, Homo sapiens
  CDS 15..299
  sig_peptide 15..65: score 3.7 seq ACLAGWLAWLAWL/AV
gcttggctggatggatggcttggctggcttgcctggctggctggctggcttggctggcttggctggctgtctggctggattggcaggcttggctggatggctggcttggctggcttggctggctctggaggtggttgcatcaagtgtgccgtgtacaatgccctgttgcggtgagacctggtggagcagctgttatgcctggtgttcagtggcaggacagcagtaccttcccccaggctagttctgtagcatggcttcagtttggtctggctgctgctgcttctcctctcttcctcctcct

SEQ ID NO: 328 - DNA, 217 bp, Homo sapiens
  CDS 35..217
  sig_peptide 35..76: score 3.8 seq LLVSAAPLGFGQG/VW
  misc_feature 112: s=g or c
  UNSURE 12: Xaa= *  or Tyr
cttgggtcagctctgcaaaggggttgtttactgaatgcttctggtatctgcagccccgctggggttcggacagggggtctggaatagggcttcacaactacagcagggctasgaccctcttgggctggaaggagctggagaggcctctgcaagctgtcacaggctcttggtgctggcactggctcaggctttcacacacacacacgcgcacacacac

SEQ ID NO: 329 - DNA, 184 bp, Homo sapiens
  CDS 32..184
  sig_peptide 32..139: score 4.4 seq WLLFCTNQSLSLS/PP
tagtgtttttaattcatcaatgttctagttaatgtctacctcagcacctcctcttagcctaattttaggaggttgcccaattttgtttcttcaattttactggttacttttttgtacaaatcaatctctttctctctctcctccccacctctcacccttgccctctccatctccctctcccgcc

SEQ ID NO: 330 - DNA, 281 bp, Homo sapiens
  CDS 84..281
  sig_peptide 84..161: score 12 seq LLLALLLPTQIYS/SE
accttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagcc

SEQ ID NO: 331 - DNA, 269 bp, Homo sapiens
  CDS 1..267
  sig_peptide 1..120: score 6.4 seq RGSLLLAVAGATS/LV
atgaaagccccctgctctggctctggttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggagga

SEQ ID NO: 332 - DNA, 308 bp, Homo sapiens
  CDS 114..308
  sig_peptide 114..215: score 7.5 seq FVFFVFFLRQSLA/LL
  misc_feature 124: s=g or c
  UNSURE -31: Xaa=Cys or Ser
ggctctcgggcctttggcctcagactgagggctgcactgttggcttccctagttttgaggctttcagacttggactgagccacactaccggcttctctttccccagctggcagatggcccattstgcgactttgccttgtgatcatgtgagccaattctccctaataaactttttttttgttttttttgttttttttttgaggcagagtctagctctgttgcccaggctggagtgcagaggcacgatctcggctcactgcaacctccacctcccgggttcacgccattctcctgcctcagcccccgcc

SEQ ID NO: 333 - DNA, 428 bp, Homo sapiens
  CDS 114..428
  sig_peptide 114..239: score 8.1 seq LFCFLLLCLSAAS/LL
aggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattttactgctcactaggacctgattctctcttaccaaatatattcttcacaataaaatacaaacccaagcagttaggacttcaggaattatttcctcaaggtcatagctgtgctgtttgtggt

SEQ ID NO: 334 - DNA, 167 bp, Homo sapiens
  CDS 15..167
  sig_peptide 15..155: score 3.5 seq CLXFGILASEVYS/WN
  misc_feature 124: k=g or t
  misc_feature 131: k=g or t
  UNSURE -11: Xaa=Gly or Val
atatttcatggcgaatgtaccacaatttatttgctctgttgttgatagacattcatgttgttctagttttttactgcctggatctcttaatgattcatattttctattgtaaatactgccttgkatttggkattttagcaagtgaagtctattcttggaacatttac

SEQ ID NO: 335 - DNA, 254 bp, Homo sapiens
  CDS 39..254
  sig_peptide 39..101: score 3.5 seq WLCVCVFSCVGFL/KK
gaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcc

SEQ ID NO: 336 - DNA, 174 bp, Homo sapiens
  CDS 9..173
  sig_peptide 9..68: score 7.9 seq FLFFIYFLRWSLA/LS
  misc_feature 132: y=c or t
  UNSURE 22: Xaa=Pro or Ser
tatatctgatggcttatttagtggtgtattttttattttttatttattttttgaggtggagtcttgctctgtcacccaggctggagtgcagtggtgcaatcttgtctcactgcaacctctgccacctgggtycacgcaattctcctgcctcagcctacctagtagctggctgta

SEQ ID NO: 337 - DNA, 284 bp, Homo sapiens
  CDS 49..282
  sig_peptide 49..156: score 7.2 seq FCFFGFFLRQSFA/LV
attattttccgcagcatgtcagctaagtagacccaatggggagagaaaatgcctgctttctttccctctttttctgcactgccatattcaccccctgccttgccgggtttttttgttttttgtttttttgggttttttttgagacagagtttcgctcttgttgcccaggctggagtgcagtggtatgatatcagcggactgcaacctccgcctcccaggttcaagcgactatcctacctcagcctcccaagtagctggattacaggcatgcatcactatgcact

SEQ ID NO: 338 - DNA, 348 bp, Homo sapiens
  CDS 152..346
  sig_peptide 152..286: score 4.6 seq LIFCIFSRGGVSQ/CW
caaaaaaattagctgggcattgtggcatgtgcctgtaatcccagctactcaggaggctgaggcagaagaattgcttgaacctgggatgcggaggttgcagtgagccgagatcccactgctgcactccagtctgggcaacagtggtgcaatcatggctcactgtagccttgacttcccaggttcaagcaattcttgtgcctcagccacccaagtagctgagattacaggtgtgtgccaccatgcccagctaattttttgcattttcagtagaggtggagtttcgcaatgttggctaggcaaacttgaatcctgttggctaggatcctgttggcctgagtccttgaactc

SEQ ID NO: 339 - DNA, 504 bp, Homo sapiens
  CDS 16..504
  sig_peptide 16..99: score 4.2 seq CLETLAVPSECSA/FS
  misc_feature 186: r=a or g
  misc_feature 497: n=a, g, c or t
  UNSURE 133: Xaa=Leu or Pro or Gln or Arg
cctttgtcatcagatatgctcattatgcccaaagctttgaaagaagagagcgaggatacctgcctagagaccctggctgttccctctgaatgctctgctttctcagagaatattgaggatcctggagagggtccctcaaatccatgcttagataccagccagaatcaaccttccatggaatcagaratgggggctgcagcatgccctgggagttgttcaagggaatgcgaggtttcatttagtgcctctaaccctgtctgggattattcacatcttatgagtagtgaaagaaattttcagagactggattttgaagaacttgaggaagaaggtcaagcctctgacaagtcattgcttccaagtcgcattaatctttctctattagatgatgatgaggaagacgaagaacttccacgcttcattttacattatgagacacatccgtttgaaacaggaatgatagtctggtttaaatatcagaaatatccattttggcnagcggaa

SEQ ID NO: 340 - DNA, 308 bp, Homo sapiens
  CDS 77..307
  sig_peptide 77..169: score 4.5 seq VAFGLYNPSLCHA/CT
ctgacgtgtctttgctcctgataccatttttccccacaccacaccactgtcctctgtgcctgtggaaaccactcaaatgcctctccccaagccttctttcagtaacaaccatctcatccggttgattactgtagctttcggcctgtataacccctccttatgtcatgcctgtaccagatgttccactgcatctgtatcccaccagattgcacattccccgaagcagaaaccttctaatctgggggccattcagggcctagcacagtgcctagtagagcatatgtgttgtagaataaatatagacacat

SEQ ID NO: 341 - DNA, 261 bp, Homo sapiens
  CDS 55..261
  sig_peptide 55..150: score 3.8 seq IRTATLVISLARG/WQ
acactcattttagccagtgtccaggctatcagcagagaaagacaggtgggcagcatggctccgggcgaaaaggaaagcggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccgg

SEQ ID NO: 342 - DNA, 306 bp, Homo sapiens
  CDS 91..306
  sig_peptide 91..198: score 6.7 seq LELLSSGCLPASA/SQ
aaaagaaagagagaaaagaagatgacattgaatgcaaccacccactgctaaatttgattggctaaaaaattattattattattacttgagatggagtctcacctgtctatttttgtatttttagtagagacaagtttttgccatgttggccaggctggtctcgaactcctgagctcgggttgtctgcctgcctcagcctcccagagtgctgggattacaggtgtgagccaccgcacccagcctgactggctaaaaaaaatttttttaataaaaaaaagaaaagaaaattatattgagaaggggaga

SEQ ID NO: 343 - DNA, 407 bp, Homo sapiens
  CDS 135..407
  sig_peptide 135..194: score 7.9 seq TVTLALVLAVAWA/ME
gcagctggcgcaagtagcctagctggagaggctcaccccaggaaggagggaggccaccgacctactgggccgacggactcccacacagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattct

SEQ ID NO: 344 - DNA, 303 bp, Homo sapiens
  CDS 26..301
  sig_peptide 26..103: score 6.5 seq LALGSAGLLWCLA/GF
  misc_feature 223: s=g or c
  misc_feature 224: r=a or g
  UNSURE 41: Xaa=Asp or Asn
gcagaccggccgccgcttcaccggcatggtcttcgccaccatcggtttctcgctgaagtcgggcctggcccttggctcggcgggcctgctgtggtgcctggccggtttcttcggctacgacacacagcagcccacggcacccaacgccatcgagggctaccgcgtcatgtccagcttcggcgtcggcgcgctgttcgccgcctgcacgatctgcctgctggcsracaagctgaacaagcagacgacgctgaagatggccgacgacctcgcccaacggcgccagcaggccgaccttgcgccggc

SEQ ID NO: 345 - DNA, 369 bp, Homo sapiens
  CDS 197..367
  sig_peptide 197..256: score 4.3 seq FNFLFLVQLCILA/CD
  misc_feature 120: k=g or t
agataaattggggaattctagggaaacccttgaataccaagatagaaaactaaagtttttacttcatttggtcatgggaaacttgcactgagcatgggagtcaataattagaagcaagtkaaattcaaaaagtcgaaccccattcataaaaccagctgatagtctgaaaatacgctttgagctaagcaaagaatacatgttgacaaatcgtaactactttaacttcctttttcttgtacaattgtgcatcctggcttgtgacaatgcataccttcagtcgtgtcccctcacctcaaagactcctctgttacaaacccactctgctcttttctataatagtacatatgggattttcctactcctaggagt

SEQ ID NO: 346 - DNA, 393 bp, Homo sapiens
  CDS 60..392
  sig_peptide 60..143: score 9.8 seq LLPLSLLVTSIQG/HL
  misc_feature 14: r=a or g
  misc_feature 276: r=a or g
  misc_feature 277: r=a or g
  misc_feature 376: s=g or c
  UNSURE 45: Xaa=Glu or Gly or Lys or Arg
  UNSURE 78: Xaa=Ser or Thr
ctttttctagccargctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagarratctaagtactttgaatccaaatttaaaggcagggtcagacttgatcctcagagtggtgcactgtacatctctaaggtccagaaagaggacaacagcasctacatcatgagggtgt

SEQ ID NO: 347 - DNA, 398 bp, Homo sapiens
  CDS 229..396
  sig_peptide 229..285: score 4.8 seq ATYLVQSSACCPA/IV
  misc_feature 20: k=g or t
  misc_feature 42: v=a or c or g
  misc_feature 53: b=c or g or t
  misc_feature 308: b=c or g or t
  misc_feature 345: s=g or c
  UNSURE 8: Xaa=Leu or Ser or Trp
  UNSURE 20: Xaa=Asp or Glu
ccacggggacaaggactgckcccacgatggtgctcctgccavgccccagctgbacggggagtcctgtggggcccaggccttgaacagccacatgcctgctgagaccgaggagctgggacggtggggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagtbgtaccggtccatgcctgtcttcctggaccccgcagasattgccaccttagagggcatcagctggaggttacccagtgccccgtctgatga

SEQ ID NO: 348 - DNA, 321 bp, Homo sapiens
  CDS 130..321
  sig_peptide 130..171: score 4.4 seq HIFFLSFFIETDS/HS
  misc_feature 195: s=g or c
  misc_feature 200: r=a or g
  misc_feature 256: s=g or c
  misc_feature 292: y=c or t
  UNSURE 10: Xaa= *  or Trp
  UNSURE 29: Xaa=Leu or Val
  UNSURE 41: Xaa=Pro or Ser
aacacaaaaccagcagccgacgccccagacacagaggcgttgagggcgtggggccaacacgcttgcccccctaacggtttgctgaataatcactaacaatgaactagatagattactaagaaacaagacatgcatattttctttctttctttttttattgagacggactctcactctgtcgcccaggctggagtscagtrgcgcgatctcggctcactgcaagctccgcttcccgggttcacgccattctcctgcstcagcctcccgagtagctgggactacaggtgcccaycaccatgcccggctaattttttttgcatt

SEQ ID NO: 349 - DNA, 360 bp, Homo sapiens
  CDS 16..360
  sig_peptide 16..84: score 3.7 seq FLPPLXRAFACRG/CQ
  misc_feature 60: m=a or c
  misc_feature 61: w=a or t
  UNSURE -8: Xaa=Cys or Ser
agggggcgtggggccatggtggtcttgcgggcggggaagaagacctttctcccccctctmwgccgcgccttcgcctgccgcggctgtcaactcgctccggagcgcggcgccgagcgcagggatacagcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactca

SEQ ID NO: 350 - DNA, 303 bp, Homo sapiens
  CDS 139..303
  sig_peptide 139..240: score 3.8 seq RWASSCLHPSARS/SN
  misc_feature 87: m=a or c
  misc_feature 275: s=g or c
  UNSURE 12: Xaa=Ser or Trp
agcccaaggtgctgccgttgcccgtacaactcggacttgctgttgctcgagccgcgtctgcacgggtctcggaccgagcggagtccmagcctcggtcccggagcccaccttcgcctcgcccttgcccagcctgcggtgatggaggcggccaccacactgcacccaggcccgcgcccggcgctgcccctcggggcccgggcccgctgggcgagttcctgcctccacccgagtgcccggtcttcgaacccagctgggaagagttcgcggaccccttsgctttcatccacaagatccggcccgggg

SEQ ID NO: 351 - DNA, 377 bp, Homo sapiens
  CDS 70..375
  sig_peptide 70..180: score 8.5 seq LLVLLLYAPVGFC/LL
  misc_feature 7: s=g or c
  misc_feature 8: s=g or c
  misc_feature 48: n=a, g, c or t
  misc_feature 193: s=g or c
  UNSURE 5: Xaa=Gly or Arg
aagagcssctgcggccgggcgcgaaaatggcggcggcggcgacggccnggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgsgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccacca

SEQ ID NO: 352 - DNA, 202 bp, Homo sapiens
  CDS 19..201
  sig_peptide 19..78: score 10.5 seq PLALCLLAAPASA/LV
gacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggcccctcccacacacacccacacactcgcccaccat

SEQ ID NO: 353 - DNA, 377 bp, Homo sapiens
  CDS 222..377
  sig_peptide 222..296: score 6.5 seq LGSLSXXVWPAWP/CR
  misc_feature 44: k=g or t
  misc_feature 45: d=a or g or t
  misc_feature 212: r=a or g
  misc_feature 213: m=a or c
  misc_feature 274: k=g or t
  misc_feature 275: y=c or t
  misc_feature 276: y=c or t
  misc_feature 277: w=a or t
  misc_feature 348: m=a or c
  misc_feature 352: m=a or c
  UNSURE -8: Xaa=Gly or Val
  UNSURE -7: Xaa= *  or Leu or Gln
  UNSURE 18: Xaa=Lys or Gln
  UNSURE 19: Xaa=Asn or Thr
tgataagaaagttcaaagtttctcttccttgctttgttgtgtgkdctaattcttttctgcccatcccccagtaaagaaaaggctcagtatgatttcttgaatagattgtttaagctattttcaaaacaggacttggtcaggggccgaagtgtgccctttgctgcctctccctctgccccttgggatcaccccagccacaagcccttcgaggrmcctataccatggcccaccttggagcagagagccaagcatcttccctgggaagtctttctgkyywagtctggccagcctggccctgcaggtctcccatgaaggccaccccatggtctgatgggcatgaagcatctmagamtccttggcaaaaaacggagtccgca

SEQ ID NO: 354 - DNA, 199 bp, Homo sapiens
  CDS 40..198
  sig_peptide 40..81: score 3.8 seq YCFFAKFVSLSHS/LP
ggctgggattacaggcgtgagccaccgcacacagccgacatgtactgtttctttgctaaatttgtttccctttctcactccctacctgatgaaaagcacccattgtttacccgaaagtccaaacctagggtttcaccccagacatttcccacttatacatccatgtccttcctgccttccccaccagttcagccccaaa

SEQ ID NO: 355 - DNA, 390 bp, Homo sapiens
  CDS 91..390
  sig_peptide 91..138: score 10.9 seq RVLLLTALTLCHG/FN
ccttctttgctttggtggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccca

SEQ ID NO: 356 - DNA, 354 bp, Homo sapiens
  CDS 31..354
  sig_peptide 31..90: score 8.4 seq FSLTVLFLRQSFA/HV
aatgatgttttatttaggaaagtaaatacaatgagtaggactcagctccagttttctcttactgttttgtttttgagacagagtttcgctcatgttacccaggctggagtgcagtggcatggtcttggatcactgcaacctccacctcccaggttcaagctattgtcctgcctcagcccccaagtaggtgggattactggcacctgccaccatgcccagctaatttttgtatttttaatagagatggggtttcaccatgttggtcaggctggtctcgaactcctgacctcaggtgatccacccacctcagcctcccaacctgctgggattataggcatgaaccaccacgcccag

SEQ ID NO: 357 - DNA, 198 bp, Homo sapiens
  CDS 31..198
  sig_peptide 31..90: score 8.4 seq FSLTVLFLRQSFA/HV
  misc_feature 111: k=g or t
  misc_feature 115: k=g or t
  misc_feature 116: k=g or t
  misc_feature 120: w=a or t
  misc_feature 137: m=a or c
  UNSURE 9: Xaa=Gly or Leu or Val or Trp
  UNSURE 16: Xaa=Ala or Glu
aatgatgttttatttaggaaagtaaatacaatgagtaggactcagctccagttttctcttactgttttgtttttgagacagagtttcgctcatgttacccaggctggagtkcagkkggcwtggtcttggatcactgmaacctccacctcccaggttcaagctattgtcctgcctcagcccccaagtaggtgggatact

SEQ ID NO: 358 - DNA, 295 bp, Homo sapiens
  CDS 34..294
  sig_peptide 34..102: score 4.6 seq LELLTSGGSPASA/SQ
ccatgcccggctaattgtgtatttttagtagagatggggtttctccatgttggtcaggctggtctcgaactcctgacctcaggtggatctcctgcctcggcctcccaaaatgctggaattacaggcatgagccaccgcacctggccccattttctttttttaatacagaatctcactctgtcacccaggctggagtacagtggtgcagtctcagctcactgcaacttctgcctttggaactcatcctcccaccttagtctcctgagtagctgggactacaggtatgtaccaccac

SEQ ID NO: 359 - DNA, 293 bp, Homo sapiens
  CDS 106..291
  sig_peptide 106..180: score 4 seq LLQELGLCMCLLS/AE
tatttttagtagaaatggggtttcaccatgttggccaggatgatctcgatctcttgatcttgtgatccgcccaactcggcctcccaaagtcctgggattacaggcatgagccactgcgcccagcccaaagcctgccctgagcttctgcaggagcttggcctctgcatgtgccttctcagcgcagagcccagcctgcatccctggcgttggctgcgccccttgcacacacacaacctcctgggccctccaggggaagtgttcttcccattcctgagtgccaagcccccgctcta

SEQ ID NO: 360 - DNA, 189 bp, Homo sapiens
  CDS 16..189
  sig_peptide 16..102: score 5.9 seq FSYISXFLSPVCG/CS
  misc_feature 54: w=a or t
  misc_feature 79: k=g or t
  misc_feature 180: n=a, g, c or t
  UNSURE -8: Xaa=Cys or Gly
  UNSURE 26: Xaa=Phe or Leu
tcaaaattctctttgatgaaatgtttaaaagtgaacccttttttatttctggtwtttaatttcttttcctacatcagtkgctttttgtcaccagtatgtggatgttctgtctgtaatttaaaacactgggagaatgagcttctatttccttctccccactttttgccatataaatttttntttcttttt

SEQ ID NO: 361 - DNA, 303 bp, Homo sapiens
  CDS 55..303
  sig_peptide 55..162: score 7.4 seq LCLLGSSDSPASA/SR
  misc_feature 103: k=g or t
  UNSURE -20: Xaa= *  or Glu
tatttgagggtttgtttctggcttctctattcttgctttttttttcatttttgcatggggggatggattctcgctctgtcatccaagctggagtgcagcagtkagatcttggctcactgcaacctctgcctcctgggttcaagtgattctcctgcctcagcctcccgagtagctgggattacaggcatgtgccaccatgcctggctaatttttgtatttttagtagagatggggtttcaccacgttagtcagtctggtctcaaactcctgacctcaagcaatctgcccgcctcggcctcccat

SEQ ID NO: 362 - DNA, 202 bp, Homo sapiens
  CDS 24..200
  sig_peptide 24..80: score 8.2 seq QVLALVLVAALWG/GT
aagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgcc

SEQ ID NO: 363 - DNA, 243 bp, Homo sapiens
  CDS 79..243
  sig_peptide 79..150: score 3.8 seq XVFXFXFLXRXLX/XX
  misc_feature 12: y=c or t
  misc_feature 114: k=g or t
  misc_feature 121: k=g or t
  misc_feature 128: k=g or t
  misc_feature 137: r=a or g
  misc_feature 143: s=g or c
  misc_feature 144: y=c or t
  misc_feature 149: y=c or t
  misc_feature 152: k=g or t
  misc_feature 154: y=c or t
  misc_feature 177: m=a or c
  misc_feature 180: r=a or g
  misc_feature 182: y=c or t
  misc_feature 189: y=c or t
  misc_feature 195: m=a or c
  misc_feature 214: y=c or t
  misc_feature 225: y=c or t
  misc_feature 228: k=g or t
  UNSURE -13: Xaa=Phe or Leu
  UNSURE -10: Xaa=Cys or Gly
  UNSURE -8: Xaa=Leu or Trp
  UNSURE -5: Xaa=Lys or Arg
  UNSURE -3: Xaa=Ser or Thr
  UNSURE -1: Xaa=Leu or Pro
  UNSURE 1: Xaa=Leu or Trp
  UNSURE 2: Xaa=Pro or Ser
  UNSURE 11: Xaa=Ile or Thr
  UNSURE 15: Xaa= *  or Cys
  UNSURE 22: Xaa=Pro or Ser
tttttgacatcytattaatagccattctggctggtgtcaggtggtatctcattgtggtttcgattttggatttctctaatgattagtaatggtaagtttttttgtttttttttkgtttttkgtttttkgtttttgaracggasyttgcyctkgycgcccaggctggagtgcaatggmaarayctcggcycactgmaacctccgcctcctgagtycaagcaattcyctkgcctcagccccccga

SEQ ID NO: 364 - DNA, 202 bp, Homo sapiens
  CDS 46..201
  sig_peptide 46..156: score 4.3 seq LELMASSDLPASA/SQ
  misc_feature 186: s=g or c
agcgattcttctgcctcagcctcctgagtagctgagattacaagcatgcgccaccatacccagctaatttttgtatttttagttgagatggggtttcactatattggccaggctgatctcgaactcatggcctcgagtgatctgcctgcctcagcctcccaaagtgctgggattacaggcgtgacsaccatgccccgccgac

SEQ ID NO: 365 - DNA, 244 bp, Homo sapiens
  CDS 89..244
  sig_peptide 89..154: score 4.4 seq LVIPALWEAEVGG/SP
  misc_feature 199: v=a or c or g
  misc_feature 200: v=a or c or g
  UNSURE 16: Xaa=Glu or Lys or Gln
caaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagcaatccttctgtctcggcctcvvaaagtgctgggattgcaggcatgtcccaccatgcccagacttta

SEQ ID NO: 366 - DNA, 261 bp, Homo sapiens
  CDS 98..259
  sig_peptide 98..199: score 9.2 seq VVVVCLFLRQSLA/LS
  misc_feature 169: w=a or t
tgtttaggttattgattggatttttttttaagtatcagagcatactactctacattttcctataagcactgtttctgctgcatcccatgtttttggaatggtactttatctttttgttttcattttcattcatctcaacttgtttttttcggggtcttttgttgttgtwgtttgtttgtttttgagacagagtctcgctctgtcacacaggctgaagtgcagtggcatgatctcagctcactgcaacctctgcctcccggg

SEQ ID NO: 367 - DNA, 202 bp, Homo sapiens
  CDS 46..201
  sig_peptide 46..156: score 4.3 seq LELMASSDLPASA/SQ
  misc_feature 4: s=g or c
  misc_feature 185: s=g or c
  UNSURE 10: Xaa=Ser or Thr
agcsattcttctgcctcagcctcctgagtagctgagattacaagcatgcgccaccatacccagctaatttttgtatttttagttgagatggggtttcactatattggccaggctgatctcgaactcatggcctcgagtgatctgcctgcctcagcctcccaaagtgctgggattacaggcgtgascaccatgccccgccgac

SEQ ID NO: 368 - DNA, 231 bp, Homo sapiens
  CDS 1..231
  sig_peptide 1..117: score 4.2 seq SLALASLRLGITG/TR
  misc_feature 164: r=a or g
  UNSURE 16: Xaa=Glu or Gly
atgctcttgtcgcccaggctggagtgcagtgacgcgatctcggctcactgcaacctccgcctcctgggttcaaacgattctcttgccttagcctccctgaggctaggaattacaggcacccgccgccacccctggctaatttttgtatttttagtagagacagrgtttcgccatgttagccaggctggtctcgaactcctgacctcaggtgatccacccacctcggcctcc

SEQ ID NO: 369 - DNA, 203 bp, Homo sapiens
  CDS 43..201
  sig_peptide 43..138: score 4.7 seq FVCLFVFKTESHS/VT
  misc_feature 12: y=c or t
tctggacttaayaaaaattgaacatgtaccattattcttttcatgacatttaaaactcctcaaaatcaagagcgcacagctctgcctcagttttgtttttttgtttgtttgtttgtttttaagacagagtctcactctgtcacccaggctggagtgcagtggtgtgatcttggctcactgcaacctctgcctcccgggttctt

SEQ ID NO: 370 - DNA, 316 bp, Homo sapiens
  CDS 145..315
  sig_peptide 145..273: score 4.5 seq LELLTSGDPPALA/SQ
tggtcaattttgttttaagactgagtttcactcttgttgcccaggctggagtgcaatggcacgatctcggctcactgcaacctccacctcctgagttcaagtgattctcctgcctcagtatctcgagtagctgagattacaggcatgcaccaccacgcctggctatttatttatttatttttatttttatttttttttagtagagacagatttttccatgttggtcaggctggtctcgaactcctgacctcaggagatccacccgccttggcctcccaaactgctgggattataggcatgagccaccgtgcccggc

SEQ ID NO: 371 - DNA, 185 bp, Homo sapiens
  CDS 33..185
  sig_peptide 33..131: score 5.5 seq SLCLLTVAVLVLT/FK
  misc_feature 157: d=a or g or t
  UNSURE 9: Xaa= *  or Leu
aatgaagggtactagaacacctgcccatccatatgggaaaaaaaaaaatctggacccctagctcatatcccatgcccagtcataaacatgtatccctatgtcttctaacggttgcagttttagttcttacatttaagtctttaattcattttgagtdaatttttgcatatgagataggggtccag

SEQ ID NO: 372 - DNA, 322 bp, Homo sapiens
  CDS 111..320
  sig_peptide 111..215: score 6.3 seq LFFLDGVSLRAQA/GV
  misc_feature 23: r=a or g
  misc_feature 24: k=g or t
  misc_feature 247: d=a or g or t
  misc_feature 248: d=a or g or t
  misc_feature 249: y=c or t
  misc_feature 311: n=a, g, c or t
  misc_feature 314: m=a or c
  UNSURE 11: Xaa=His or Leu or Gln or Arg
  UNSURE 12: Xaa=Pro or Ser
  UNSURE 32: Xaa=Arg or Ser
tttgtatctttgttagagacgarkttctccatgttggtcagactggtcttgaactcctgagctcaagttatctacctgtcttggcctcccatagtgctgggattacaggcatgagccaccatgcccggcccgttatgcccttttgctttatatttttcgtttttcaaattttctttcttttttttttagacggagtctcgctccgtgcccaggctggagtgcagtggcacgatatcggctcactgcddyctccacctccctggttcaagcaattcgcctgcctcagcctcccaagtagctgggattacagncgmacgccaat

SEQ ID NO: 373 - DNA, 175 bp, Homo sapiens
  CDS 15..173
  sig_peptide 15..53: score 4.9 seq MVVCACSSSCLRG/LR
  misc_feature 116: y=c or t
  misc_feature 127: r=a or g
  misc_feature 130: y=c or t
  misc_feature 137: m=a or c
  UNSURE 25: Xaa=Lys or Arg
  UNSURE 26: Xaa=Ala or Val
  UNSURE 28: Xaa=His or Gln
tggccgggctgggcatggtggtgtgcgcctgtagttccagctgcttgagggggctgaggcgggagaatcacttgaacctgggaagtggaagtcacagtgagccaagatcgtgccaytacacttccarggytgggcamcagaatgagactccgtctcaaaaaaaaaaaaaaaaaaa

SEQ ID NO: 374 - DNA, 263 bp, Homo sapiens
  CDS 102..263
  sig_peptide 102..230: score 3.7 seq VWCLXLKLVPALC/IS
  misc_feature 15: y=c or t
  misc_feature 16: y=c or t
  misc_feature 114: m=a or c
  misc_feature 115: m=a or c
  misc_feature 132: s=g or c
  misc_feature 134: h=a or c or t
  misc_feature 135: y=c or t
  misc_feature 139: r=a or g
  misc_feature 143: y=c or t
  misc_feature 205: m=a or c
  UNSURE -39: Xaa=Lys or Pro or Gln or Thr
  UNSURE -33: Xaa=Gly or Arg
  UNSURE -31: Xaa=Asn or Ser
  UNSURE -9: Xaa=Ser or Tyr
tcccagcagaagggyyagcgcctggctgtcagcagcgtgtgcctcaggagggatctgcggtgacggggttgttacttcagtaggatgaggaagagtcacaaatgcggggttggmmggctcctgcttggagasghytgarcacyaggagactaccaatggggagcaggcacggtgccagcccggcctctgccgtctggtgtctgtmcctcaagttagtcccagctttgtgcattagcgggctcaccctcggaatccagggattc

SEQ ID NO: 375 - DNA, 304 bp, Homo sapiens
  CDS 141..302
  sig_peptide 141..245: score 8.7 seq LLLSVAFNQLVFA/LY
  misc_feature 266: w=a or t
  misc_feature 267: b=c or g or t
  misc_feature 279: d=a or g or t
  misc_feature 280: d=a or g or t
  UNSURE 8: Xaa=Phe or Leu or Val
  UNSURE 12: Xaa= *  or Glu or Gly or Ile or Lys or Leu or Arg or Val
tttctcatcaatttcttgcttctctggcaacctcaacctctgattcctgaggccaataaaactgaaactttctgcttgagctcttgttttgccaggctgatggggctgaggtgcaccctctgaggaaaagctgtaaatacatggattttacccaatgccattcccttcttttaagggttgaatattctccagtgtctgtctgctttttattactttccgttgccttcaatcagttggtttttgctttgtatccaatacaagctacwbtctgtttctctddagtttctctccctttccccgctca

SEQ ID NO: 376 - DNA, 237 bp, Homo sapiens
  CDS 60..236
  sig_peptide 60..179: score 3.5 seq SLAHCSLCLPGSS/DS
  misc_feature 92: k=g or t
  misc_feature 94: k=g or t
  misc_feature 95: k=g or t
  misc_feature 96: r=a or g
  misc_feature 118: n=a, g, c or t
  UNSURE -30: Xaa=Ile or Met
  UNSURE -29: Xaa=Cys or Phe or Leu or Trp
  UNSURE -28: Xaa=Gly or Arg
  UNSURE -21: Xaa=His or Leu or Pro or Arg
cccatttacagatgaggaaactaacagagagaaatgacttctaaggttgtacagctaaaatggtaatgctaatgctaatatatatatatatktkkrgacggagtctcgctctgttgcncaggctggagtggcaggatctcagcttagctcactgcagcctctgcctccctggttccagtgattctcctgcctcggcctcctgggtagctgagattataggcatgcaccaccacgccc

SEQ ID NO: 377 - DNA, 259 bp, Homo sapiens
  CDS 77..259
  sig_peptide 77..121: score 5.4 seq LLEALAPSGGSRG/KK
  misc_feature 151: k=g or t
  misc_feature 152: s=g or c
  UNSURE 11: Xaa=Leu or Val
tacctggaaagaacagaaatttgttaatttacaggtctgaaggtgagaaatctgaaattagtcttacaaaactaaaatgaagttgttggaagccttggctccttctggaggttccaggggaaaaaagtatgtttccttgactttccagcckstacaggcccacagcattcctgcttgcagccctatgtcatgtcacctgtcctcttggtgctgtcattgtcacaatgccttctttctgaccctgtcattcctggcctcc

SEQ ID NO: 378 - DNA, 291 bp, Homo sapiens
  CDS 104..289
  sig_peptide 104..154: score 3.6 seq VIFVSLXXYSIYS/RX
  misc_feature 111: w=a or t
  misc_feature 115: k=g or t
  misc_feature 118: h=a or c or t
  misc_feature 127: w=a or t
  misc_feature 130: y=c or t
  misc_feature 135: k=g or t
  misc_feature 138: k=g or t
  misc_feature 158: y=c or t
  misc_feature 165: k=g or t
  misc_feature 171: k=g or t
  misc_feature 180: w=a or t
  misc_feature 213: d=a or g or t
  misc_feature 214: s=g or c
  misc_feature 252: k=g or t
  misc_feature 268: y=c or t
  misc_feature 271: k=g or t
  UNSURE -15: Xaa= *  or Leu
  UNSURE -14: Xaa=Phe or Leu
  UNSURE -7: Xaa=Met or Arg
  UNSURE -6: Xaa=Leu or Trp
  UNSURE 2: Xaa=Pro or Ser
  UNSURE 4: Xaa=Cys or Phe
  UNSURE 6: Xaa=Leu or Trp
  UNSURE 9: Xaa=Ile or Lys
  UNSURE 20: Xaa= *  or Cys or Phe or Leu or Trp or Tyr
  UNSURE 33: Xaa=Leu or Arg
ttaaaaacatcagcatgtgtctagtgtataaaatacatatgcaccaagatggtctgtattcatcttgtgatttttttttttttaaatacagaatatatgctggatgatttwattkgthatttttgtwagyctcakgtkgtactctatttacagtaggyctttttktgtttkgttttcgawacagagcttcgctcttgtgaccaggctggagtdsaatggcacaatctcagctcactgcaacctccaccttckgggttcaagtgattcycckgcctcagcctcccaagtagc

SEQ ID NO: 379 - DNA, 158 bp, Homo sapiens
  CDS 1..156
  sig_peptide 1..144: score 5 seq VVVVVSSSPCVPG/EV
atggattcaataacgccagagcttaaaaaacaccacaaattctcaggctccaccctggatggactggttcagaaacactggggcaatggattttgggaatttgttgttgttgttgttgtttcaagttccccatgtgttcctggcgaagttgcagtgat

SEQ ID NO: 380 - DNA, 267 bp, Homo sapiens
  CDS 14..265
  sig_peptide 14..82: score 4.5 seq LELLTSGDPPALA/SQ
atttttagtagaaatggggtttcaccatgttagccaggctggtctcgaactcctgacctcaggtgatcctcccgctttggcctctcaaagtgctgggattacagatgtgagccaccgtgcccgccctcaaaataaaaatgtagaaaacattgattttggtggatctatcttgacaaccatatttctccgtgagaagcttcagctgttcctccttcttcgtgtccatcttctgaaatgccctgttggcattatagtacaaaaccacca

SEQ ID NO: 381 - DNA, 296 bp, Homo sapiens
  CDS 108..296
  sig_peptide 108..176: score 5.4 seq LELLTSTDPPASA/SQ
  misc_feature 206: s=g or c
  UNSURE 10: Xaa=Arg or Ser
acctccaccttccaggttcaagtgatcctcctgcctcagcctcccaagtagctgggattacaggcgagagccaccatgcccagctaatttttgtattttcagtaaagatggggtttcaccatgttggccaggctggtctcgaactcctgacctcaactgatccacccgcctcggcctcacaaagtgctgggattacatgcgtgagscactgcgccccaccattctgctttgtctatgaatttgactgctctgggtatcttacgaaagcggaattggtggggcgcagtggctcacgc

SEQ ID NO: 382 - DNA, 266 bp, Homo sapiens
  CDS 43..264
  sig_peptide 43..135: score 4 seq FLSFLKILRQGLA/LS
  misc_feature 63: y=c or t
  misc_feature 232: s=g or c
  UNSURE 33: Xaa=Leu or Val
tatttggcaattagtgcttgtattttaattttcatttcacatatgtgttccattttcctaacyaagattgaaataagccatctcctattaggtatttttctttcttttttaaaaattttgagacagggtcttgctctgtcactcaggctggagtgcagaggtgcaatcatggctcagtgcaacatccacctcccaggctcaagcgatcctgccccctcaccctctggcgtastgggaccacaggtgcgcaccaccatgcccggcag

SEQ ID NO: 383 - DNA, 282 bp, Homo sapiens
  CDS 64..282
  sig_peptide 64..162: score 8.1 seq LFCFVLFCFVLFC/FV
acactattttcttacaagagtcctaataactgattagggctcttgtaagagccactaaatccaatggctacagtcacaagaataccctgtgaatgccagcttctagttctccattggtgtgttttgttttgttttgttttgttttgttttgttttgttttgttttgttttgtttgagacagggtctcagtctgttgcccaggctggagtacagtcatgtgatctctgctcactgcaacctccacctcctgggctcaagcgattctcccagctcagcctcccc

SEQ ID NO: 384 - DNA, 332 bp, Homo sapiens
  CDS 89..331
  sig_peptide 89..208: score 4.4 seq LNLGVLMCIECSG/IH
ccaagccatccagagccagatcctggccagcctgcagtcatgcgagagcagtaaaagcaagtcccagctgaccagccagagtgaggccatggccctgcagtcgatccaaaacatgcgtgggaactcccactgcgtggactgtgagacccagaatcctaagtgggccagtttgaacttgggagtcctcatgtgtattgaatgttcaggaatccaccgcagtcttggcacccgcctttcccgtgtgcgatctctggagctggatgactggccagttgagctcaggaaggttatgtcatctattggcaatgacctagccaacagcatccgggaag

SEQ ID NO: 385 - DNA, 286 bp, Homo sapiens
  CDS 119..286
  sig_peptide 119..202: score 7.6 seq LLFLLTXPHSCXP/PS
  misc_feature 183: k=g or t
  misc_feature 197: r=a or g
  misc_feature 198: r=a or g
  misc_feature 230: s=g or c
  UNSURE -7: Xaa=Cys or Phe
  UNSURE -2: Xaa=Asp or Gly or Asn or Ser
  UNSURE 10: Xaa=Leu or Val
attctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagtgaaccttccctccttttcctgttgacttkcccacactcctgtrrccctccctccctcccttcttcctctctctctstctcactcacgcacacgcacacacacacacacacacacacacacacacacacacac

SEQ ID NO: 386 - DNA, 263 bp, Homo sapiens
  CDS 59..262
  sig_peptide 59..127: score 3.6 seq VLFVAVCFLVLFX/IY
  misc_feature 126: k=g or t
  misc_feature 134: k=g or t
  misc_feature 135: k=g or t
  misc_feature 160: k=g or t
  misc_feature 161: y=c or t
  UNSURE -1: Xaa=Cys or Phe
  UNSURE 3: Xaa= *  or Gly or Leu or Val
  UNSURE 11: Xaa=Lys or Asn
  UNSURE 12: Xaa=Phe or Leu
tatttacttagaactgtgatcagtgctacagaggagaatatgacctatcagatacagaatgattaacagtggttctacacctcccagggttctttttgttgctgtttgttttttggttttattttktatttatkkatttatttatttttttgagacgaakytcactcttgtccctcaggctggagtgcaatggtgcaatctcagctcactgcaacctccgcctcccgggttcaggcaattctcctgcctcaagccgcccgagg

SEQ ID NO: 387 - DNA, 377 bp, Homo sapiens
  CDS 4..375
  sig_peptide 4..93: score 5.2 seq SLCFIFWDGVSLC/RS
  misc_feature 257: k=g or t
  misc_feature 376: r=a or g
  misc_feature 377: h=a or c or t
  UNSURE 55: Xaa=Cys or Phe
ttaatggaatgctctgtatatggaatgccaggggatgggaagagaagagaaaaatcgctttgttttattttttgggatggagtctcgctatgtcgctcgggatggagtctcgctatgtcgctcaggctggagtgcagtagcaccgtactggctcactgcaacctccacctcctgagttcaggcgaatttcctgcttcagcctccgaagtagctgagattaccggcgcatgtcaccacacccagcaaatttttgtgtktttattggagatggggtttcatcatgttggccaggctgttctcaaactcctgatgacaagtgatctgctgtcttggcctcccaaagttctggaattaccagcaggtgtgagccaccgcrh

SEQ ID NO: 388 - DNA, 458 bp, Homo sapiens
  CDS 51..458
  sig_peptide 51..122: score 7.8 seq VALLLAAAGTAVG/DR
  misc_feature 267: h=a or c or t
  misc_feature 268: h=a or c or t
  UNSURE 49: Xaa=Phe or His or Ile or Leu or Asn or Pro or Ser or Thr or Tyr
acagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggachhcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggac

SEQ ID NO: 389 - DNA, 349 bp, Homo sapiens
  CDS 119..349
  sig_peptide 119..190: score 11 seq LVLLFTLVQRSNG/EC
  misc_feature 10: d=a or g or t
  misc_feature 11: s=g or c
  misc_feature 16: s=g or c
  misc_feature 32: d=a or g or t
  misc_feature 33: r=a or g
  misc_feature 51: v=a or c or g
  misc_feature 54: r=a or g
  misc_feature 117: k=g or t
  misc_feature 331: k=g or t
  UNSURE 47: Xaa= *  or Tyr
agatgcgggdsgacastgacttgctgagaccdrggcggggaggcgcggacvccrgtgtggtccttgcgccgctgacttctccactggttcctgggcaccgaaagataaacctctcakaatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcagaaacacccatccagaatgtcattctacatgagcatcacattttccttggggccactaactacatttakgttttaaatgaggaagac

SEQ ID NO: 390 - DNA, 433 bp, Homo sapiens
  CDS 268..432
  sig_peptide 268..411: score 4.1 seq FTTLSNLSLPSQT/KD
  misc_feature 305: k=g or t
  misc_feature 306: v=a or c or g
  misc_feature 307: m=a or c
  UNSURE -36: Xaa=Leu or Arg
  UNSURE -35: Xaa=His or Asn
cgtccatcagatcctgaccctaaggctggtgactttgtagctatgaaagcaggaaatgaaggcatagtacaatttcctaaagatgaaaaacaatatcttgttcccctctgtttttgttattacaagaaataatctatctactactcgtcagcacctgtctttgtgtctgaagccaagaataaattcatcaacttggtagccactgctgcaactgaagccaaccgcagtcaatgttggctatatgttgagttgccggaggcgcctggaatgtgctaccttgcagaattgtccctgacaacatttckvmatggctatattgttaccagtagggccacaacaacaacaacacttgcaatccaacctgggcttcctttcaccacactaagcaatctatctttgccaagtcagacaaaagatgaactccaccctccct

SEQ ID NO: 391 - DNA, 210 bp, Homo sapiens
  CDS 47..208
  sig_peptide 47..118: score 4.6 seq SLLLYSLPLNIIG/LN
  misc_feature 180: v=a or c or g
  UNSURE 21: Xaa=His or Pro or Arg
tagcaatagaaagagccagaatatgtgctttagtttgttttaatgaatgtatccttcacttttagttgactatttccctagtcttttgctatacagtttacccttgaacatcataggtttgaactgtgcatatccacttataaataattttttaaaaaataatagttacacttgtgtgcvtgtccctcttgctttcccttccatgccgtc

SEQ ID NO: 392 - DNA, 261 bp, Homo sapiens
  CDS 80..259
  sig_peptide 80..199: score 6.1 seq ICIGILVLPFIRC/CC
  misc_feature 11: n=a, g, c or t
agaataggatnattcactggtaataatagagtcattaagaaatattaagcattgcagctaaaaattgaacaaccctgtaatgatacatttaagaattattcaaaggtgctacatggcagggttagagaataaaaagaacgtggtgtttgaagcaaaacagatctgtattggcatcttggttctcccttttatcagatgttgttgccttgtgcaaatcacattttctctgagtctccattttctcatttataacatgcggcg

SEQ ID NO: 393 - DNA, 340 bp, Homo sapiens
  CDS 71..340
  sig_peptide 71..148: score 5.5 seq AMFLLSYAXPSCG/RS
  misc_feature 68: s=g or c
  misc_feature 70: h=a or c or t
  misc_feature 134: n=a, g, c or t
  UNSURE -5: Xaa=Leu or Met or Val
gttctcagggtgtgtggaatcaactttccggaagcaaccagcccaccagaggaggtcccgagcgcgasghatgacgatgcagcggagactggttcagcagtggagcgtcgcgatgttcctgctgagctacgcgntgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacaac

SEQ ID NO: 394 - DNA, 417 bp, Homo sapiens
  CDS 233..415
  sig_peptide 233..364: score 3.8 seq AIASLTLNEEILA/RV
  misc_feature 126: w=a or t
  misc_feature 131: r=a or g
  misc_feature 312: r=a or g
  UNSURE -18: Xaa=Cys or Tyr
agactctgatggctctgtagctaactggcccatcctcagagactaacgcaaaggaacgaatttccaggatgttcgactatgtggagaaaacaaaaaaaaagcaaagaaaaaaatatttttaaagawagaargaaggccaggtgcagtggctcacgcctgtaatcccaacactttgggaggccgaggcagacagatcacctgaggtcaggagttcaagaccagcctggccaacatggagatctgcgctgacccccagtttatcattggaggagccacccgcacagacatctgccaaggagccctaggtgactrctggctgctggcagccattgcctccctcaccttgaatgaagaaatcctggctcgagtcgtccccctaaaccagagcttccaggaaaactatgcagggatctttca

SEQ ID NO: 395 - DNA, 344 bp, Homo sapiens
  CDS 54..344
  sig_peptide 54..119: score 5.9 seq LIYILWQLTGSAA/SG
  misc_feature 197: k=g or t
aatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagtkgactctattgtctggaccttcaacacaacccctcttgtcaccatacagccagaagggggcactatcatagtgacccaaaatcgtaatagggagagagtagacttcccagatggaggctactccctgaagctcagcaaactgaagaag

SEQ ID NO: 396 - DNA, 480 bp, Homo sapiens
  CDS 216..479
  sig_peptide 216..326: score 6.5 seq LLVFFLIVRTLSC/RS
  misc_feature 10: k=g or t
  misc_feature 11: k=g or t
  misc_feature 31: r=a or g
  misc_feature 32: d=a or g or t
  misc_feature 255: m=a or c
  UNSURE -24: Xaa=Ile or Leu
gcatccccckktagctcagagaagtttgttrdgaccgatcttctgaagcctacttctgtcaactcatcaaagtcattctccatccagctttgttccattatgggtgaggagctacgatcctttggaggagaagaggcactctgatttttagaattttcagcttttctgctctggtttcgccccatctttgtggttttatctaccttcggtctttgatgatggtgacctacagatggggttttggtgtggatgtcmtttttgttgctgttgatgctattcctttctgtttgttagttttctttctaatagtcaggaccctcagctgcaggtctgttggagtatgctggaggtccactccagaccctgtttgcctaggtatcaccagcagaggctgcagaacagaaatattgcagaacagcaaatgttgctccctgatccttcctctggaagcttcgtctcaaaggggcactgaatgtatga

SEQ ID NO: 397 - DNA, 427 bp, Homo sapiens
  CDS 31..426
  sig_peptide 31..111: score 4.4 seq TSLLSPAAGPSFC/IV
  misc_feature 381: d=a or g or t
tgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtdgcagtagccccatggggcccggagctgctgtggcctccactggcat

SEQ ID NO: 398 - DNA, 252 bp, Homo sapiens
  CDS 59..250
  sig_peptide 59..115: score 5.2 seq LLVAFRVFLGLFS/LP
  misc_feature 36: v=a or c or g
  misc_feature 232: k=g or t
ctgtagccaaattaaaatctgagtctggcgtttccvtttgggaaggtgctcagtagctatgtacatgtggtccaaactcttggtggcattcagggtctttcttggccttttcagcctcccctctaaccacaacacatactgtcccttccagccttggggaattccttgcagcctcagaataggaggcctcctccatctgcagtgccctttgcccccctctctacatcctctkcctagtctactcaccagccg

SEQ ID NO: 399 - DNA, 181 bp, Homo sapiens
  CDS 28..180
  sig_peptide 28..105: score 4.7 seq TALSLVSSAFSFC/DM
caagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagaa

SEQ ID NO: 400 - DNA, 280 bp, Homo sapiens
  CDS 85..279
  sig_peptide 85..180: score 5.9 seq WTAMLISLAIVIA/LP
  misc_feature 111: w=a or t
cgaatttactatactacagagagagacgaacaaggcagcaaaatcaatgatttctttctgcggtctgaagacctcttcaatgaaatgaattggcagaagaaactgagaggwaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgcct

SEQ ID NO: 401 - DNA, 270 bp, Homo sapiens
  CDS 49..270
  sig_peptide 49..159: score 4.4 seq LELLTSGDPPASA/SQ
gtctcccaggttcaagtgattctcctgcctaagtctgggattacaggcatgcaccaccacacccggctaatttttgtatttttagtagagatggggtttcaccatattggccaggctagtcttgaacttctgacttcaggtgatccacctgcctcggcctcccaaagtgctgggattacaggcgtgaagcaccacgcccagcctgaaataatattttaccttttactttgtgctttttgtgttttactcaggaagtcctcccctacccta

SEQ ID NO: 402 - DNA, 396 bp, Homo sapiens
  CDS 192..395
  sig_peptide 192..236: score 8 seq FISFLCLIALAGT/SS
  misc_feature 286: k=g or t
  misc_feature 289: r=a or g
  misc_feature 302: m=a or c
  misc_feature 309: w=a or t
  misc_feature 315: k=g or t
  misc_feature 317: h=a or c or t
  misc_feature 320: k=g or t
  misc_feature 323: y=c or t
  misc_feature 325: m=a or c
  misc_feature 332: m=a or c
  misc_feature 373: w=a or t
  UNSURE 17: Xaa=Leu or Trp
  UNSURE 18: Xaa=Lys or Arg
  UNSURE 22: Xaa=Asp or Glu
  UNSURE 25: Xaa=Asn or Tyr
  UNSURE 27: Xaa= *  or Cys or Gly
  UNSURE 30: Xaa=Pro or Gln
  UNSURE 46: Xaa= *  or Leu
gattctcagcttagttgctgttggtgtataggagagctactgatttgtgtacattaattttgtatccggaaactttgttgaattattttatcagttctaggagctttttggaggagtctttagggttctctaggtatacaatcatatcatcagcaaacagtgacaattcgacttcctctttatggatttgtatgccctttatttctttcctttgtctgattgctctggctgggacttccagtactatgttgagaagtgctctggctgggacttccagtactatgtkgargagaagtggtgamagtgggwatcctkghctkgtycmagtcctmagagggaatgctttcagctttttcccattcagtctgatgtwggctatgggttgtcatagatggc

SEQ ID NO: 403 - DNA, 197 bp, Homo sapiens
  CDS 15..197
  sig_peptide 15..92: score 7.9 seq RVCLLSLSLFLWA/NR
aatacgccaggaacatgctaaggacctggagctctctaccctggacccgttttcgggtttgcttgctctctctctctctctttctctgggctaatcgtttagaggacagtcgctcctgccaacctaatcccatgagcctgactaccttgccgggccacaggctcaaagaagcagtgtggctgccagcaccctcactt

SEQ ID NO: 404 - DNA, 300 bp, Homo sapiens
  CDS 147..299
  sig_peptide 147..272: score 7 seq LFLYSLFTENVLA/HP
  misc_feature 11: m=a or c
  misc_feature 12: m=a or c
  misc_feature 13: m=a or c
tgtattgtttmmmttatttactagtatgcagatctggttttcattcttttcatattgaatttcgttatgggtagaatcatttgcaaacatttctagacatttttaaagatctatttaatttgtttaagaatggaaaacataaaataatgcatgattcttcaggcaagaataatttcagaaagatacctgttgtaaatttaatttatctctatgtagacatacatatacataaattatttttatatagtctctttacagaaaatgtattggcacatccttgcattgttctacgccgcctat

SEQ ID NO: 405 - DNA, 371 bp, Homo sapiens
  CDS 187..369
  sig_peptide 187..270: score 8.3 seq ILFLINILPGTTG/QG
aagctagcgagcaaaccagagagacagaccgagagagggaccaggagagagacccagagagagaagaagcagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactga

SEQ ID NO: 406 - DNA, 268 bp, Homo sapiens
  CDS 41..268
  sig_peptide 41..100: score 5.4 seq WFVHSSALGLVLA/PP
  misc_feature 35: d=a or g or t
acgatacaaatggtaggccttcatgtgagccagtdactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcgacacgct

SEQ ID NO: 407 - DNA, 307 bp, Homo sapiens
  CDS 89..307
  sig_peptide 89..190: score 4.4 seq SLHLLWSRTVTTG/ET
  misc_feature 241: r=a or g
  misc_feature 242: d=a or g or t
  UNSURE 18: Xaa= *  or Gly or Arg
tctcattgttgcaggttgctttcccagacactcactggaaggaagaacgggaattgttagtttaagctcatcactaaagtcgcatcaaatgcacggaccttctcccaggaaggcggccttttgcattatgaaccccactggaagagctccaagtcttcacttgctgtggtcaagaactgtaaccacaggagagacgggatttcactatgttggccgggctggtcttgaactcctaacctcrdgatctgcctgcctcggcctcccaaactgctgggattacaggcgtgagccaccccacccggacatc

SEQ ID NO: 408 - DNA, 434 bp, Homo sapiens
  CDS 146..433
  sig_peptide 146..232: score 11.2 seq GLLVVLLVGGCAA/EE
  misc_feature 393: k=g or t
  UNSURE 54: Xaa=Cys or Phe
acgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtktgatgagagtgccggggcagtgctgaggatccagccgctga

SEQ ID NO: 409 - DNA, 340 bp, Homo sapiens
  CDS 17..340
  sig_peptide 17..94: score 3.6 seq TQAFGALLSGAGS/QV
  misc_feature 243: s=g or c
  misc_feature 244: s=g or c
  misc_feature 299: m=a or c
  UNSURE 50: Xaa=Pro or Arg
  UNSURE 69: Xaa=Leu or Met
tcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggcsscgcgaagagctggaggccctcagctatgctcggcacttccagccctttgctcggmtgcaccagcggggtgagtgcccaggcagctggggttgtgct

SEQ ID NO: 410 - DNA, 198 bp, Homo sapiens
  CDS 45..197
  sig_peptide 45..191: score 4.4 seq CLFSILFPLFIIS/AK
  misc_feature 44: w=a or t
cactgtactgctttgaatatcgttggttcaataaaggaattgawatgcaccagcggttgtctaacatagaaaggaattggccttactactttaggtttggtttgcccttggcttttctcacagcaatgcagtcctcatatattatcagtggctgccttttctctatcctctttcctttattcattatcagcgccaaga

SEQ ID NO: 411 - DNA, 204 bp, Homo sapiens
  CDS 46..204
  sig_peptide 46..162: score 4.4 seq LELLTSGDPPASA/SQ
agttcaagcaattctcctccctcagcctccctagtacgtgggactatgggcatgtgccaccatgcccagctaatttttgtatttttagtagagacggggtttcaccatgttggccaggctggtctcgaactcctgacctcaggtgatcctcccgcctcggcctcccaaagtgctgggattacaggcctgagccaccacgccacg

SEQ ID NO: 412 - DNA, 341 bp, Homo sapiens
  CDS 79..339
  sig_peptide 79..135: score 10.8 seq SLCCLLVLANARS/RP
  misc_feature 18: k=g or t
  misc_feature 25: k=g or t
  misc_feature 39: y=c or t
  misc_feature 40: d=a or g or t
  misc_feature 48: y=c or t
  misc_feature 49: k=g or t
  misc_feature 51: w=a or t
  misc_feature 52: r=a or g
  misc_feature 146: k=g or t
  misc_feature 336: r=a or g
  UNSURE 4: Xaa=Cys or Phe
aaaccgctccgctgcgckcaggctkggctgcaggctctydgctgcagykcwrggtggatctaggatccggcttccaacatgtggcagctctgggcctccctctgctgcctgctggtgttggccaatgcccggagcaggccctcttkccatcccgtgtcggatgagctggtcaactatgtcaacaaacggaataccacgtggcaggccgggcacaacttctacaacgtggacatgggctacttgaagaggctatgtggtaccttcctgggtgggcccaagccaccccagagagttatgtttaccgaggacctgaagctgcctgcaagcttcgatgcrcggga

SEQ ID NO: 413 - DNA, 430 bp, Homo sapiens
  CDS 58..429
  sig_peptide 58..147: score 6.6 seq LVWVMAAVVLCTA/QV
  misc_feature 42: k=g or t
  misc_feature 43: y=c or t
  misc_feature 44: s=g or c
agagctccaggcgcacatccgcagtcagccacctcgcgcgckystccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaata

SEQ ID NO: 414 - DNA, 223 bp, Homo sapiens
  CDS 10..222
  sig_peptide 10..150: score 4.5 seq PIFGLLVPSQIFS/SL
  misc_feature 91: r=a or g
  misc_feature 92: s=g or c
  UNSURE -20: Xaa=Ala or Gly or Ser or Thr
caaccatacatgtgcacactcacagacacacacactcacgtccaagtgcacaagtcaaaaccttgccagctcctctcccctcctccaccarsccatggtcctcttcttctccctatctttggccttcttgtgccctctcagattttcagctctcttctcaattctctacatctgggcctgccttccttcccaaagatgccactcatgattttcctcccccgct

SEQ ID NO: 415 - DNA, 428 bp, Homo sapiens
  CDS 203..427
  sig_peptide 203..259: score 8 seq LLLLVATAWHGQG/IP
  misc_feature 131: s=g or c
aactctgtggttgccttgcctagctaaaaggggaagaagaggatcagcccaaggaggaggaagaggaaaacaagacaaacagccagtgcagaggagaggaacgtgtgtccagtgtcccgatccctgcggastagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccg

SEQ ID NO: 416 - DNA, 273 bp, Homo sapiens
  CDS 83..271
  sig_peptide 83..136: score 4.7 seq LFFCFCFCFVLRQ/SL
cttgcctttgcatttatttattcatttttaagttattttgccagcatctttttaatgataaataataattgtatatatttatatggtacagggtgatttgtttttttgtttttgtttttgttttgttttgagacagagtctccctctgtcacccaggctggagtgcagtggcgcgatctcagctcactgcaacctctacctcctggattcagacgattcttatgccttagtctccctagtagcagggactacaggcatctgccaccatacccc

SEQ ID NO: 417 - DNA, 200 bp, Homo sapiens
  CDS 12..200
  sig_peptide 12..83: score 5.1 seq IFIYLLFSRQGLA/LS
  misc_feature 7: m=a or c
  misc_feature 8: m=a or c
  misc_feature 138: m=a or c
  UNSURE 19: Xaa=Ile or Leu
acagtammagtatgtatgtttgtgatatgcaagtagttggggaaatttttatttatctccttttttcgagacagggtcttgctctgtcacccaggctggagtgcagttgtgtgaatatagctcactacagccttcaamttctgggctcaaacaatcctcccatatcagcttcccaagtatcttctgggaccacaggcatg

SEQ ID NO: 418 - DNA, 248 bp, Homo sapiens
  CDS 46..246
  sig_peptide 46..147: score 4 seq VIFLSIFVIIVTC/LM
aatccagggtgctgatgttgtgggaggggacttaaaacagaaaaaatgttttacaagggcagcatgaagcaggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattccagcc

SEQ ID NO: 419 - DNA, 300 bp, Homo sapiens
  CDS 30..299
  sig_peptide 30..113: score 4.2 seq LACGXGXXHPTXA/FV
  misc_feature 7: m=a or c
  misc_feature 8: n=a, g, c or t
  misc_feature 9: n=a, g, c or t
  misc_feature 10: s=g or c
  misc_feature 88: m=a or c
  misc_feature 94: s=g or c
  misc_feature 95: m=a or c
  misc_feature 98: m=a or c
  misc_feature 109: r=a or g
  misc_feature 110: w=a or t
  misc_feature 123: r=a or g
  misc_feature 281: d=a or g or t
  UNSURE -9: Xaa=Lys or Thr
  UNSURE -7: Xaa=Ala or Gly
  UNSURE -6: Xaa=Phe or Leu
  UNSURE -2: Xaa= *  or Cys or Tyr
  UNSURE 4: Xaa=Met or Val
acacctmnnsaccctactagactgagtgcatgaacttcgtgaagttgctgcatgcctacaaccgcacccatttgctggcctgtggcamgggagsmttmcacccaacctrwgcctttgtggaartgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcaggacgagactdtaccatctttcgcagccta

SEQ ID NO: 420 - DNA, 389 bp, Homo sapiens
  CDS 229..387
  sig_peptide 229..282: score 6.3 seq LFLLFFFFHFSFL/NW
catttgagcacggagcctctgcggccgtcttccttggattctctcatatccctgaaaaacacaaattgtacctggattttccttctgtttccaaagtccaccaacttgttcttcaatgtaattgattttaacttgttttctttcttttacttttcttatttttttctttcttttcatttttttcttatttcttttccttctatttattttacttttcttatttgttatatgttatttctttttcttttcttacttttcttcttttttcatttttcttttttaaattggagtctcactctgttgcccaggctggagtgcagtggtgcaatcttggctcactgcagcctccacctcctgggttcaagcgattctcctgcctcagccccccc

SEQ ID NO: 421 - DNA, 461 bp, Homo sapiens
  CDS 75..461
  sig_peptide 75..125: score 9.2 seq PALLLAFLPLASQ/KS
  misc_feature 15: n=a, g, c or t
gacctgagttttganagcgtcttctgctcctcttcatctggtccctttccttccaagaccccagagaggaaggcatgcggtgggccccagccctgcttctagctttcctgcctcttgccagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccacctgggacaggcacagtgattcacacctgccctacaccacactgg

SEQ ID NO: 422 - DNA, 386 bp, Homo sapiens
  CDS 105..386
  sig_peptide 105..203: score 5 seq LELLGLSGPPASG/SL
  misc_feature 20: r=a or g
  misc_feature 87: y=c or t
  misc_feature 103: m=a or c
aataatatttctcagagtcrtaactgtcttgctttccctgtcctctccagattttgccctgaaagccttccctgtaggaagaatgtytgtttttttttaaagmgatggggtctttactctgttgcccaagctggagtgcagtggtgatcatagttcactgtaacctcgaacttctgggcttaagtggtcctcctgcctcaggttccctagtaggtaggactacaggtgtgtgccagcatgccccgctaattaaaaaaaatttttttttcgtagagacaggggtctcactatgtttgaccaggctggtctggaactctgggcctcaagcaaagcattgggattacaggtccaagccactgtgccaggtccaggaagaatgcgccccc

SEQ ID NO: 423 - DNA, 350 bp, Homo sapiens
  CDS 23..349
  sig_peptide 23..151: score 11 seq VFVLLLVLSLAIG/LY
  misc_feature 42: y=c or t
  misc_feature 44: b=c or g or t
  misc_feature 45: b=c or g or t
  misc_feature 79: k=g or t
  misc_feature 196: s=g or c
  misc_feature 296: m=a or c
  misc_feature 297: b=c or g or t
  misc_feature 314: b=c or g or t
  UNSURE -37: Xaa=Ile or Thr
  UNSURE -36: Xaa= *  or Ala or Gly or Leu or Pro or Arg or Ser or Val
  UNSURE 15: Xaa=Asp or Glu
  UNSURE 49: Xaa=Ile or Leu or Pro or Arg or Ser or Thr
  UNSURE 55: Xaa= *  or Glu or Gln
agatcacagacacagtgaggatatgagtgtaggggtgagcaycbbagcccctctttccccaacctcgggcacaagcgtkggcatgtctaccttctccatcatggactatgtggtgttcgtcctgctgctggttctctctcttgccattgggctctaccatgcttgtcgtggctggggccggcatactgttggtgasctgctgatggcggaccgcaaaatgggctgccttccggtggcactgtccctgctggccaccttccagtcagccgtggccatcctgggtgtgccgtcagagmbctaccgatttgggaccbaatattggttcctgggctgctgctactttctggggc

SEQ ID NO: 424 - DNA, 449 bp, Homo sapiens
  CDS 185..448
  sig_peptide 185..325: score 5.8 seq LMCFGALIGLCAC/IC
cattagtgatgaggcagatgaaaagacttataatgatgcactttttcgatacaatggcacagtgggattgtggagacggtgtatcaccatacccaaaaacatacattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagg

SEQ ID NO: 425 - DNA, 430 bp, Homo sapiens
  CDS 125..430
  sig_peptide 125..199: score 7.1 seq LFVMAFLLSGAAP/LK
  misc_feature 116: r=a or g
  misc_feature 121: m=a or c
attgccgaggaaggcttgcacagggtgaaagctttgcttctctgctgctgtaacagggactagcacagacacacggatgagtggggtcatttccagatattaggtcacagcagaarcagcmaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatc

SEQ ID NO: 426 - DNA, 173 bp, Homo sapiens
  CDS 11..172
  sig_peptide 11..118: score 4.4 seq LWFFLPSLXCPEC/CP
  misc_feature 105: m=a or c
  UNSURE -5: Xaa=His or Pro
tctggtctgcatgtggaccctccccagcctcagtgcatcgtttcagccttttctgggcagccttcgcccttctcacatcctgtggttcttcctgccctccctccmctgcccagaatgctgccctcctgatccaggatctccagcctccagggaccctaacgtggcctgcgaac

SEQ ID NO: 427 - DNA, 183 bp, Homo sapiens
  CDS 6..182
  sig_peptide 6..62: score 4.1 seq FLWLSSIPSYIYT/HT
tgcaaatgccattaattcattcctttttatggctgagtagtattccatcatatatatacacacatacacacatgtatgtatatacatatatatacacacgcacatatatgtatgtatatacatacacacacacaaacacccccacccaccacagtttctttatcctttcattgattgctgggc

SEQ ID NO: 428 - DNA, 249 bp, Homo sapiens
  CDS 43..249
  sig_peptide 43..96: score 5.7 seq AFFSLAALAEVAA/ME
  misc_feature 23: m=a or c
  misc_feature 30: s=g or c
acacaacaccgaggtcggggagmcgcggasagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggtcctgtacttatttcctgcgctgaccagtgaagcgccctttcattgtaaaacattgtgctttacctactaccctagcact

SEQ ID NO: 429 - DNA, 452 bp, Homo sapiens
  CDS 237..452
  sig_peptide 237..287: score 4.2 seq LAFLLVSLYWSHM/HP
  misc_feature 84: s=g or c
  misc_feature 85: s=g or c
  misc_feature 86: n=a, g, c or t
atagggctgaaccgaggactgaaaaagggaggaggcagaccactcggagaggagctgggaagcagtgcagagaggagagcggassnagctgccgctgagcaaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgt

SEQ ID NO: 430 - DNA, 222 bp, Homo sapiens
  CDS 24..221
  sig_peptide 24..65: score 3.7 seq CSLLSGWGQLLRC/VQ
  misc_feature 106: b=c or g or t
  UNSURE 14: Xaa=Leu or Pro or Arg
agtggtcccaggaccactcatggatgtgtagtttgctgagtggctggggacagcttcttagatgtgtacagaccccagcagagcccagagatgtaaacaagaagcbagaaaaaaaggaaaagtacatgcccctggtagattccctctgtggagggttaggaactaggaatagtgactgcctcagagggggagctggcaggggcagagatgggagaaggataa

SEQ ID NO: 431 - DNA, 305 bp, Homo sapiens
  CDS 113..304
  sig_peptide 113..256: score 5.8 seq LHLLGSSNSPASA/SS
  misc_feature 137: k=g or t
  misc_feature 141: y=c or t
  misc_feature 150: w=a or t
  misc_feature 274: y=c or t
  UNSURE -40: Xaa=Leu or Val
  UNSURE -39: Xaa=Phe or Ser
  UNSURE -36: Xaa=Asp or Val
ctatataaatcaagccaaatctatattgtctgcaagtattcctgcaatatagttgatgttcataatgtgatccagatattttcagtatacttctgtgtattttgattatcacatgactttttatttatttgtttgtktgtytatttatgwtttgagatggagtctagctctgtcacccaggctggagtgcagtggtgcaatctcggctcactgcagcctccacctcctgggttcaagcaattcacctgcctcagcctcctcagctaatttttgyatttttagtagagatgggatttcactctgtt

SEQ ID NO: 432 - DNA, 213 bp, Homo sapiens
  CDS 11..211
  sig_peptide 11..76: score 7.2 seq IIYALQFLFLVFA/PS
attcaatcaaatgaaccgatcttgtagaaacactggaatcatttatgcgttgcagtttctctttcttgttttcgctccttcttccctgggatattttgagtggattgtggctattaatcaagatctcgtgctattcgtgttttgcttgtcgttttcgctcaggattagcatcattcaaggcaaacgcaaagctgcttttcccacccccccccc

SEQ ID NO: 433 - DNA, 195 bp, Homo sapiens
  CDS 16..195
  sig_peptide 16..144: score 4 seq AAWCSLVLSFCRL/HK
tcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctccga

SEQ ID NO: 434 - DNA, 155 bp, Homo sapiens
  CDS 2..154
  sig_peptide 2..100: score 6 seq LAHFLIGLTVCFG/EG
  misc_feature 106: r=a or g
  misc_feature 107: w=a or t
  UNSURE 3: Xaa=Arg or Trp
catgtacctgtacctgttgtccatttgtatgtcttctttgaagaaatgtctattcaagttcttagcccactttttaatcgggttaacagtttgttttggtgagggrwggctaatgagttataggagttcttatttattacttaaaggaccaccgg

SEQ ID NO: 435 - DNA, 190 bp, Homo sapiens
  CDS 29..190
  sig_peptide 29..109: score 5 seq CVLTASSWAVLWS/AR
  misc_feature 152: r=a or g
  misc_feature 153: b=c or g or t
  UNSURE 15: Xaa=Ala or Gly or Ile or Ser or Thr or Val
aagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcarbtagaggaatgcccatggttctcagcattggaaggact

SEQ ID NO: 436 - DNA, 210 bp, Homo sapiens
  CDS 58..210
  sig_peptide 58..108: score 3.6 seq WIYAFISLGYILG/SG
  misc_feature 63: h=a or c or t
  misc_feature 64: n=a, g, c or t
  UNSURE -16: Xaa=Arg or Ser
  UNSURE -15: Xaa=Phe or Ile or Leu or Val
agtttgggttgtttctgcttttcgttaaaaatagtagtacttctctgaacactgtggatgaghntttgctggatatatgctttcatttctcttgggtatatacttgggagtggaattgttgggttatttggtaattttatgtttaaacttttgaggaactgccagaccgttttccaggatggctatgctatattacccttcccaccaacg

SEQ ID NO: 437 - DNA, 166 bp, Homo sapiens
  CDS 5..166
  sig_peptide 5..88: score 4.5 seq FLPFLLSLPLDQT/LP
  misc_feature 9: k=g or t
  misc_feature 11: s=g or c
  misc_feature 13: b=c or g or t
  misc_feature 46: s=g or c
  UNSURE -27: Xaa=Cys or Phe
  UNSURE -26: Xaa=Ala or Pro
  UNSURE -15: Xaa=Asp or Glu
agatatgtkcscbaaagcctgcagaaccctcgcttggttgcctgasccgttcttaccctttctcctcagtcttcccttggaccagacgcttcctcgccagggtcctggccaatccctgtccttcccagaaaactaccagactcttcccaagagcacccgacaccct

SEQ ID NO: 438 - DNA, 380 bp, Homo sapiens
  CDS 151..378
  sig_peptide 151..189: score 4.9 seq MLTASLAFQLVDG/VS
  misc_feature 353: s=g or c
  UNSURE 55: Xaa=Ala or Gly
gaatctgctcgctcttctggagctgagacactcatcttctcctgccctggcacatcaaaactccaggttctctgatctttgaacactgggacttaatccagcatccccttactgcctgaagttctcaggactttggacttggactgaacgatgctaacagcttccctggctttccagcttgtagatggcgtatcatggaatttctcagtctccaaaatgctggcatcaccatctacatcaggtcagctgtctcagtttggggcaagtttatacgggcaacaaagtgcactaggccttccaatgagggggatgagcaacaatacccctcagttaaatcgcagcttatcacaagsactcagttaccgagccacgtcacgcca

SEQ ID NO: 439 - DNA, 226 bp, Homo sapiens
  CDS 23..226
  sig_peptide 23..166: score 5.2 seq EVVTLPLTSHCLA/QV
tgaatttctaaaactcttttttatgggacttcacatttctctgattaaatttcttcttgctaatggaccccatattcctagtcaccaaagaccttttgaacctaaaggggaaaaaagctgcagaattgaagtggtgactctgccacttactagccattgtcttgcccaagttgcaagttctgacctcatccataggatgagaaccataacaggtacctcgtcacac

SEQ ID NO: 440 - DNA, 339 bp, Homo sapiens
  CDS 42..338
  sig_peptide 42..179: score 6.9 seq VTMLMGFLGCIGA/VN
cttctgtgaaatggccatgctagtgcctgccaggcagggtgatgtcagagttggagacggcgtgtggaaagcccatgaggcacaaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggtggcatcgtgactgagctcattcgagactacaacagcc

SEQ ID NO: 441 - DNA, 239 bp, Homo sapiens
  CDS 42..239
  sig_peptide 42..116: score 4.6 seq GFFCLFVLRQSFT/LS
  misc_feature 197: m=a or c
aattttagggtgacggtgatactcaaaaatctcacactgccatgtttccattcccacatactcagtgtcttcacttaggtttcttttgtttgtttgttttgagacagagtttcactctgtcacccaggctggagtgcagtggcgcaatcttggctcactgcaacctctgcctcccacgttcaagcagtactcctgcmtcagcctcccaagagctaggattgcagatgcgcaccaccgta

SEQ ID NO: 442 - DNA, 207 bp, Homo sapiens
  CDS 9..206
  sig_peptide 9..116: score 5.5 seq LHFVYCFLCCAEA/FL
ctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatt

SEQ ID NO: 443 - DNA, 175 bp, Homo sapiens
  CDS 7..174
  sig_peptide 7..102: score 10.6 seq VVFLLLLVSTLSS/VV
cgtataatgacttactttcctctgggtagatacccagtaatgggattgctggatcaaatggtagttgtgtttttacttcttttagtctccacactttcttccgtagtggttttactagtttgcattcccaccagcagtgtaaaattgttcccttttcaccatatccacaccaact

SEQ ID NO: 444 - DNA, 232 bp, Homo sapiens
  CDS 28..231
  sig_peptide 28..120: score 6.4 seq GFMVLLMIPWGSA/AK
  misc_feature 162: r=a or g
  misc_feature 171: r=a or g
  misc_feature 182: w=a or t
  misc_feature 183: r=a or g
  misc_feature 190: r=a or g
  misc_feature 193: s=g or c
  misc_feature 211: m=a or c
  misc_feature 213: m=a or c
  UNSURE 21: Xaa=Leu or Gln
  UNSURE 24: Xaa=Gly or Arg
  UNSURE 25: Xaa=Leu or Val
  UNSURE 31: Xaa=His or Lys or Asn or Gln
agagcaggacctggaaagctggtttgtatgggctgcagcctgccgctgagctgcatcatggtgcggtctgtggcctgggcaggtttcatggtcctgctgatgatcccatggggctctgctgcaaaactggtctgctacttcaccaactgggcccagtacagrcagggggargctcgcttccwrgcccaargasttggaccccagcctttgmamccacctcatctacgccttc

SEQ ID NO: 445 - DNA, 336 bp, Homo sapiens
  CDS 177..335
  sig_peptide 177..320: score 3.5 seq LIIHLMGTTGLCA/SL
  misc_feature 16: k=g or t
  misc_feature 131: k=g or t
  misc_feature 192: r=a or g
  misc_feature 193: r=a or g
  UNSURE -43: Xaa=Glu or Gly or Lys or Arg
catattaactcttcakgtaaaaaccatcttgtagctgggcaaggtggcacatgcctgtagtcccagctacttgggggactgaggcaggtggatcgcttgagcctaggagttcaaggctgtagtacgctatkgatcacgtctatcaatagccactggactccagcctggacaatgtaatgagagtctgtctcrraaaaaaggaacaatcttgtgtttgcgtgtgtgctcatgtctttgttggaataatactgacacagtcactcaaattaactctcaaatctttgattattcatttgatgggaacaacaggtttatgtgccagcttatcaggactta

SEQ ID NO: 446 - DNA, 241 bp, Homo sapiens
  CDS 68..241
  sig_peptide 68..133: score 4.3 seq LFFETGSPSVAQS/GV
  misc_feature 217: b=c or g or t
  misc_feature 218: d=a or g or t
  misc_feature 219: r=a or g
  UNSURE 28: Xaa=Arg or Ser
  UNSURE 29: Xaa= *  or Glu or Gly or Lys or Arg or Trp
cttacagagttaataagcatcaaagaacttactgaaggactttataaattaaataccattatgtagaatggtggtggttagtgcctttatttatttattttttgagacagggtctccctctgtcgcccagtctggagtgcagtggtgtgatctcggcttactgcagcctccgcctcctggattcaagcgattctcttgcctcagcctcctaggtagbdrggattgcagacgtgcgccaccc

SEQ ID NO: 447 - DNA, 179 bp, Homo sapiens
  CDS 10..177
  sig_peptide 10..117: score 5.3 seq SLLIATSTSRVQA/TL
aaagatgctatgctggttcgttgtttttttttgagatggagtctcactctgtcacctgactggagtacagtggcgcaatctctgctcattgcaacctccacctcccgggttcaagcgaccctcctgcctcagccttgtgagtatctggaactacaggcatgtgccaccacacctggcat

SEQ ID NO: 448 - DNA, 286 bp, Homo sapiens
  CDS 84..284
  sig_peptide 84..203: score 4.9 seq SLKICGLVFGILA/LT
agccgactcacttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactac

SEQ ID NO: 449 - DNA, 249 bp, Homo sapiens
  CDS 12..248
  sig_peptide 12..146: score 14 seq LLLLLLLPSPLHP/HP
tttagtcctccatggggctagaagagagaaggacggagtcgagtggcaccctagaagacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaacc

SEQ ID NO: 450 - DNA, 169 bp, Homo sapiens
  CDS 1..168
  sig_peptide 1..90: score 7.4 seq LFPLLTHSEPSQG/QS
atgtgtagaatttcctgttcaaaccttagtaacacgttgatgagaaatctactttttccactcttgactcactctgagccttcacaggggcagtctgcgaagattgcaggcattgtttgttcttgtcttggatttatgcctttaaatttcaccttttattacacagcca

SEQ ID NO: 451 - DNA, 407 bp, Homo sapiens
  CDS 228..407
  sig_peptide 228..341: score 4 seq FKPXSCLSLLSNX/DY
  misc_feature 12: m=a or c
  misc_feature 264: y=c or t
  misc_feature 265: s=g or c
  misc_feature 269: w=a or t
  misc_feature 314: s=g or c
  misc_feature 323: m=a or c
  misc_feature 338: y=c or t
  misc_feature 340: s=g or c
  misc_feature 378: k=g or t
  misc_feature 380: w=a or t
  UNSURE -26: Xaa=Pro or Arg or Ser or Trp
  UNSURE -25: Xaa=His or Gln
  UNSURE -10: Xaa=Phe or Leu
  UNSURE -1: Xaa= *  or Ser
  UNSURE 13: Xaa= *  or Cys or Gly
tgagttttatgmttgatttatatcttttggttacaagtcctttgtcagatatatgatttgcaaatattttctcactctgggtaggttgtctttttactttcttgataatgtcctcttttgttgcttgtgttatctccttttttgttttttattctttttaaagttatctcttacaggaaggattccttttttcttaaaaaagtttttcaattctttttttttttgagatggagtctcactctgtcgcccaggctaggatgcggysgcawaatctcagctcactgcaacctctgccgcctgggttcaagccattstcctgcctmagcctcctgagtaaytsagattacaggcatgcaccaccattcctggctaattttkgwatttttcatagagatggagtttcacca

SEQ ID NO: 452 - DNA, 331 bp, Homo sapiens
  CDS 78..329
  sig_peptide 78..137: score 6.9 seq LYLLGMLVPGGLG/YD
cttgatgcattcattctcaaggacacttgatccactgccagagaggcccagaattttctaacttactgtgtggcagaatgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaacccgc

SEQ ID NO: 453 - DNA, 267 bp, Homo sapiens
  CDS 31..267
  sig_peptide 31..102: score 4.6 seq FFIFCSLNTLLLG/GV
acaactatcctgcctgctgcttgctgcaccatgaagtctgccaagctgggatttcttctaagattcttcatcttctgctcattgaataccctgttattgggtggtgttaataaaattgcggagaagatatgtggagacctcaaagatccctgcaaattggacatgaattttggaagctgctatgaagttcactttagatatttctacaacagaacctccaaaagatgtgaaacttttgtcttctccagctgtaatggcaaccttaac

SEQ ID NO: 454 - DNA, 392 bp, Homo sapiens
  CDS 172..390
  sig_peptide 172..288: score 5.9 seq SAWWCVLLEWSQG/AS
ctggggaaattgagcctaagagaacagaaagtacttgaggtcccacaatgaatctatggatgaatgagtgcttattcattcactcattttttaaaaaaatccattccacaagtatgtcttaatcactgcagtgtaaggcacatagggacaaaatagaagattcctgtcctcatggaactcacaaacaagcaaacaggaactgacagacatgaacaggtactacggagggtaaagcaagacaagaggataagtgcatggtggtgcgttttactggagtggtcacagggggcctctctgaggaggcaacatcgaggggagacaagccccaaatctggggaaagactttccaggcagagagaacagcaaaaaccgcagatgagtgacaagagcct

SEQ ID NO: 455 - DNA, 350 bp, Homo sapiens
  CDS 185..349
  sig_peptide 185..253: score 9.4 seq SLLFICFFGESFC/IC
  misc_feature 278: w=a or t
  misc_feature 279: w=a or t
  misc_feature 284: k=g or t
  misc_feature 285: r=a or g
  UNSURE 9: Xaa= *  or Lys or Leu or Met
  UNSURE 11: Xaa= *  or Glu or Gly
atattttgctgactggcaaggttatatgaagtgcttttattgaagcaccattttaactaatagctcctggtattttctgcttcccttcgtagggaatttagttattttattttattatttagctaatttagctattttaaaatagctaaattttagctacttttttttcaattgacaaagaaggatgtctaatcaaagactaccgctgattttttctctgttgtttatctgcttcttcggggagagtttctgcatttgtgatggaactgtctggacawwggttkratgggagattcttccagaagaagtacattattggaaagttaagggttctccatctcactgcctgc

SEQ ID NO: 456 - DNA, 466 bp, Homo sapiens
  CDS 268..465
  sig_peptide 268..372: score 7.3 seq LDLLGSSSPPTSA/SQ
  misc_feature 20: k=g or t
  misc_feature 21: k=g or t
  misc_feature 131: w=a or t
  misc_feature 136: k=g or t
  misc_feature 430: k=g or t
  misc_feature 436: w=a or t
  UNSURE 20: Xaa=Phe or Val
  UNSURE 22: Xaa= *  or Arg
cttaaactttattatgttgkkttcacaaagagcagcctttgttgactttgaaatcattgcttcagtattctagaaaatcttgtttttgttaaacatgggcagtaacttactatttttgtatagttgttgtwcatcktacccccaccctgttttaaaaataaaaagtagttgtcagattactttggctttagaagtaccttttcacttgccttagaatcttcattactttgagcctacactccacctcttattggaacttcatgaagaatgatgttggatttcgctctgtcgcccaggctagagcgcagtggtctgatcatggcttgctgtacccttgacctcctgggttcaagcagtcctcccacctcagcctcccaggtggctgggactgggcatgtgccaccacacccagctagttttttttactttkttgtawgacaggtctactatgtttcgcagctgatct

SEQ ID NO: 457 - DNA, 188 bp, Homo sapiens
  CDS 24..188
  sig_peptide 24..86: score 9.5 seq LLVLFVLLANVQG/PG
agaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccga

SEQ ID NO: 458 - DNA, 269 bp, Homo sapiens
  CDS 4..267
  sig_peptide 4..138: score 4.2 seq FLIFYLFIFETES/HS
cacatggccgtatctgttgtattggagactggcaagccccagctctcaatatacacagcgttaacagttactaggttgctgattttctttcattttttttttcttattttttatttatttattttcgagacagagtctcactccctcacccaggctgcagtgcagtggtgcgatctcggctcactgcggcctctgcctcccggcttgagcgattcttctgtctcggcctcccgagtagctggaattacgggtgtgtgccgccatgcctc

SEQ ID NO: 459 - DNA, 313 bp, Homo sapiens
  CDS 161..313
  sig_peptide 161..289: score 6.8 seq ALSAXTFVSFLHA/AP
  misc_feature 263: s=g or c
  UNSURE -9: Xaa=Ala or Pro
gtacggatctctttaatattctgtgtaacaaaatagaaatgctcataaagtacttctgcggcaaaccaaagtatagcacctgactcaaggaaaagcaaggaaaagcacatgtgggatcccttgaatggcaagtgaaactagccactagtttcatttttacatgaaacaatggctgtgttgggtgctgaggctggaaggtagacaggggcttggggttggagagcctcgtgggctgcgtttgtgcttgggggccttgagcgcasccacctttgtcagctttctacacgctgctccccactcccatccagccctt

SEQ ID NO: 460 - DNA, 293 bp, Homo sapiens
  CDS 48..293
  sig_peptide 48..95: score 10.1 seq LVLTLCTLPLAVA/SA
aagatccctgcagcccggcaggagagaaggctgagccttctggcgtcatggagaggctcgtcctaaccctgtgcaccctcccgctggctgtggcgtctgctggctgcgccacgacgccagctcgcaacctgagctgctaccagtgcttcaaggtcagcagctggacggagtgcccgcccacctggtgcagcccgctggaccaagtctgcatctccaacgaggtggtcgtctcttttaaatggagtgtacgcgtcctgctcagcaaacgctgtgctcccagatgtcccaactca

SEQ ID NO: 461 - DNA, 380 bp, Homo sapiens
  CDS 226..378
  sig_peptide 226..315: score 4.8 seq CLFLNARLAGTLC/QL
acagacatcagctcgggtcaaccgcgggcctcgagcccgagtggctgagggctgttaccttcaaacctttgaatcccacgttttccccttgacttcctgtcaccgttagagaaaagtggacagcgtctcggtcacagagttggagaaatagtgcagggactcttcagggagagcgttttcctcatcaaagcaaactgcaaaatcgcttctgccggcgtggacctgatgagagtcggtcgtcgtgagggacaccctctgttccctaacgtcccccgctgcttatttttaaacgctcggttggcgggaaccctgtgccagctgaaactccttcagtttggccgcctaggaaacaccgagagtcacctacatgggctggctgg

SEQ ID NO: 462 - DNA, 198 bp, Homo sapiens
  CDS 7..198
  sig_peptide 7..63: score 3.9 seq SVCLCPCLNKGQS/EN
  misc_feature 87: w=a or t
  misc_feature 174: r=a or g
  UNSURE 37: Xaa= *  or Trp
agcaagatgttctcctgctgtatctcagtttgtctatgtccttgtctcaacaaaggccaaagtgagaatctttccagagactgcggwcattggctgaaccctcaccatcgacgcctctggccatttggcagaaggcacccacaggattgtggactcttccaagattcacaatgrtatggtgaatccaaagactggaac

SEQ ID NO: 463 - DNA, 196 bp, Homo sapiens
  CDS 42..194
  sig_peptide 42..152: score 5.6 seq LVASFLMSSVVRT/SS
attccctactaatcctcagtggacatgcacagtgtttgtaaatgactaatacagttaagacatttgtacatcatcatcttctcatggaagatcctagactttccttacagaaactggtggcttcttttcttatgtcctcagtggtaagaacatcatctcttgaggagaatgtcaaggttcatcctatcccaacata

SEQ ID NO: 464 - DNA, 417 bp, Homo sapiens
  CDS 198..416
  sig_peptide 198..251: score 3.7 seq VCWGHLLPARVST/RS
  misc_feature 5: y=c or t
  misc_feature 23: s=g or c
  misc_feature 27: k=g or t
  misc_feature 413: n=a, g, c or t
  UNSURE 54: Xaa=His or Gln
gagaycaactctatttgagcaasagtkaggaagatttccctgtctcccagctgagtaaccactcaggtttatttaaatccagtttaaatatggtttcagtaatgattttccaatggtctacagcaaagaatggtgctccaagcctgaacattgagcacgacccaggtcatatgcacaacacgacaggttgagcgtccatgtgtggctactgggtttgctggggacacctcttgcctgccagggtgagcacacgcagcagtgagcagccccgtgtgaccccacgggatgaggatgccatgatgtcagcatcccttctgacttggaggtatgtgacattcatggtgccaatgccactgtcaccttgcagatcagtctgggtttgcttcagacagaagatcctggaatatgttcangcat

SEQ ID NO: 465 - DNA, 464 bp, Homo sapiens
  CDS 89..463
  sig_peptide 89..178: score 13.2 seq LLLLSTLVIPSAA/AP
  misc_feature 395: m=a or c
  misc_feature 410: n=a, g, c or t
  misc_feature 411: n=a, g, c or t
  UNSURE 73: Xaa=His or Asn
  UNSURE 78: Xaa= *  or Ala or Glu or Gly or Lys or Leu or Met or Pro or Gln or Arg or Ser or Thr or Val or Trp
aaacagtacgtgggcggccggaatccgggagtccggtgacccgggctgtggtctagcataaaggcggagccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagcmacctccagatcgacnngatgaccgacaacaagacaggagaggtgctgatctccgagaatgtggtggcat

SEQ ID NO: 466 - DNA, 248 bp, Homo sapiens
  CDS 13..246
  sig_peptide 13..81: score 11.8 seq CLFVCLFLSQSFA/FV
  misc_feature 27: r=a or g
aaaagtattgggatgcctagttacaargtgtgtggggttttttgtttgtttgtttgtttgtttttgagccagagttttgcttttgtcctccaggctggagtgcagtggcgcgatctctgctcactgcaacctcagcttcccaggttcgggccatcctcctgcctcagcctcccaagtggctgggactgcaggcgcccaccaccacgcctggctaattcttgtgttttcggtggagacggggtttcacc

SEQ ID NO: 467 - DNA, 349 bp, Homo sapiens
  CDS 46..348
  sig_peptide 46..102: score 11 seq SLVLLLCLTCSYA/FM
  misc_feature 238: k=g or t
  UNSURE 46: Xaa=Phe or Val
aagcaaacccgtcatgagcaactcccttccccatctctgttcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttcttkttgttgttgtgccgtttgtgatactgcagtgtcaaagagacagtgagaagaataaggagcagagtcctcctggccttcgaggcggccaacttcactctccattaaagaaaa

SEQ ID NO: 468 - DNA, 347 bp, Homo sapiens
  CDS 106..345
  sig_peptide 106..237: score 3.7 seq RFLLFCVHGDGHA/EN
  misc_feature 312: n=a, g, c or t
  misc_feature 338: s=g or c
  UNSURE 34: Xaa=Arg or Thr
tatgagaggaacgggagatatgagggctcaagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcgnatatcggggacatccatagccttcasaaatattgc

SEQ ID NO: 469 - DNA, 269 bp, Homo sapiens
  CDS 105..269
  sig_peptide 105..194: score 4.3 seq LLPTLPWLPSTRL/LS
  misc_feature 12: r=a or g
  misc_feature 13: r=a or g
  misc_feature 46: r=a or g
  misc_feature 47: m=a or c
  misc_feature 48: n=a, g, c or t
  misc_feature 49: r=a or g
  misc_feature 75: v=a or c or g
  misc_feature 237: d=a or g or t
  UNSURE 15: Xaa=Ala or Ser or Thr
gcacagcgctgrratgccaggttcgggtaggaggccccttgggggrmnrattctttaggaaattcctttagaagvaaacaacttgggactggatagcgtgcgatatgcagagaaatgcaactttcattcatttgcagttagcgatccgcccttccctgctccccacccttccgtggctccccagtacccgcctgctgtcgcccacacccttaggacagcttcgtggccccccgggadcgcagagggccatgcctaccgctcatttaaga

SEQ ID NO: 470 - DNA, 230 bp, Homo sapiens
  CDS 16..228
  sig_peptide 16..96: score 8.8 seq VLLLLPFTTTSLC/EL
  misc_feature 127: m=a or c
  misc_feature 134: m=a or c
  misc_feature 138: m=a or c
  misc_feature 142: m=a or c
  misc_feature 209: n=a, g, c or t
  UNSURE 11: Xaa=Lys or Gln
  UNSURE 13: Xaa=Lys or Thr
  UNSURE 14: Xaa=Asp or Glu
  UNSURE 16: Xaa=His or Asn
  UNSURE 38: Xaa=His or Leu or Pro or Arg
ttatcagcattttggatgaaggtaaaggaagactttccattgttaagtagaaagagtgtcctgctattgctaccattcacaacaactagtttgtgtgaactagggttttccatcttaacgcagttamaaacaamggamagamatgggctgaattgtgcagcagttatgcgggtagcattatcttcctgtgttccagactggaatgaacntatgaacaggcaagcacacaa

SEQ ID NO: 471 - DNA, 359 bp, Homo sapiens
  CDS 179..358
  sig_peptide 179..307: score 4.7 seq GIFLVIFCSESFS/LL
  misc_feature 6: m=a or c
  misc_feature 20: r=a or g
  misc_feature 44: w=a or t
  misc_feature 111: r=a or g
  misc_feature 112: w=a or t
  misc_feature 119: n=a, g, c or t
  misc_feature 120: n=a, g, c or t
  misc_feature 137: r=a or g
  misc_feature 148: k=g or t
  misc_feature 249: k=g or t
  misc_feature 250: b=c or g or t
  UNSURE -20: Xaa=Cys or Phe or Leu or Trp
atggamttctgggttgacaratgttttgttgtgttttgtttatwcctcatctgttctctattgtttctagtttgtagtcagcattcataggtgtacttgattcctcctatrwtattagnntctagctgttttcaggratttctctttkatttttgagttccagtagtttgactataatatgataaacctacttgtgggtaactgcatttatctgcttggagctattagagcttcttgcatgtgtagatkbatgtctttcgccaaatttgggatttttcttgtaatattttgttctgaatcattttctcttctcctctggaacttcagttcaatatatgttaagaccttttggccagtgg

SEQ ID NO: 472 - DNA, 246 bp, Homo sapiens
  CDS 55..246
  sig_peptide 55..126: score 7.8 seq FLLCLCIAYWAST/AV
attctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagccccgccat

SEQ ID NO: 473 - DNA, 408 bp, Homo sapiens
  CDS 105..407
  sig_peptide 105..242: score 7.8 seq LVLLGTRVPLSGG/GP
  misc_feature 125: s=g or c
  misc_feature 306: m=a or c
  UNSURE -40: Xaa=Asp or Glu
  UNSURE 22: Xaa=His or Asn
aaacagggccattggcaaagctggggtaccagtcacccagccacgctctagggtggtagccaagaagacggaccccgagtgggaggcagagagacaagaggtggatgaagcagagcaagcgtgasatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatmatcattcccggccggcagcaggggcgacgccagcaaggcctgcgactcagagccagcttggcccgttcgccccgccccttcccggtgtccgccccgccccat

SEQ ID NO: 474 - DNA, 335 bp, Homo sapiens
  CDS 169..333
  sig_peptide 169..267: score 5.4 seq AACHTLSLSLTTA/HN
  misc_feature 14: k=g or t
  misc_feature 15: n=a, g, c or t
  misc_feature 127: m=a or c
  misc_feature 131: y=c or t
  misc_feature 135: m=a or c
  misc_feature 138: w=a or t
  misc_feature 141: k=g or t
ttaaaaatgcaackngttttatcttccttggtttttctcaacaatttccaaagaaaattctggcttcaaatactggaatatgttcatccgactgaggtctgagaaagaagaaaattaaaaattgaamcaayttgmttwttkcttccttgatttttctgaacagcttccatggaaacttttgcctcatacagtggaattgggttcatccaactgaggggtggtggaaaagctgcatgtcacacgctgtcactcagtctgaccacagcacataatttcaaggatggagggccacattcagacacatggccttgcaaagagaaaactgggccttgtca

SEQ ID NO: 475 - DNA, 209 bp, Homo sapiens
  CDS 36..209
  sig_peptide 36..86: score 7.5 seq FLFLFLLXXLIVA/VT
  misc_feature 8: d=a or g or t
  misc_feature 12: k=g or t
  misc_feature 69: d=a or g or t
  misc_feature 72: k=g or t
  misc_feature 157: d=a or g or t
  UNSURE -6: Xaa=Asp or Asn or Tyr
  UNSURE -5: Xaa=Cys or Gly
  UNSURE 24: Xaa=Asp or Gly or Val
cttttttdtcckgcacaagggatttccgggtcaggatgaacaaacacttcttgttcctcttcctccttdackgcctcattgtggcagtgacatcacttcagtgcataacatgccaccttcgcacacggacagaccgctgtagaagaggctttggtgdctgtactgctcagaagggcgaggcatgcatgctcttaaggattcaccagcgc

SEQ ID NO: 476 - DNA, 328 bp, Homo sapiens
  CDS 79..327
  sig_peptide 79..201: score 3.6 seq LHTSVTLFLLSYC/DC
  misc_feature 257: v=a or c or g
  misc_feature 258: n=a, g, c or t
  UNSURE 19: Xaa=Lys or Asn or Arg or Ser or Thr
agatgattccctgattctccagagagattacacacttcgtttgtggctaaggttactgtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatavntcactactaagagatgacctgatccaggatgttgaaatacagattatttcaaggcaggagctcccaccaa

SEQ ID NO: 477 - DNA, 470 bp, Homo sapiens
  CDS 268..468
  sig_peptide 268..375: score 5.6 seq SFLLFXXVLKTES/CS
  misc_feature 219: h=a or c or t
  misc_feature 220: v=a or c or g
  misc_feature 329: s=g or c
  misc_feature 330: m=a or c
  misc_feature 332: n=a, g, c or t
  misc_feature 354: w=a or t
  misc_feature 355: y=c or t
  misc_feature 356: n=a, g, c or t
  misc_feature 436: y=c or t
  UNSURE -16: Xaa=Pro or Arg
  UNSURE -15: Xaa=Cys or Phe or Ser or Tyr
  UNSURE -8: Xaa= *  or Cys
  UNSURE -7: Xaa=Cys or Phe or His or Leu or Pro or Arg or Ser or Tyr
  UNSURE 21: Xaa=Pro or Ser
tgacactgtggaatggatggggacatgggggttcatcctgatattttcaacactgttttatatgtttgaaaaaatttaagtacttgggaagtgaaagtgctcagagataccagaatcaaagtgggatgagattaactttgtttgagtgttgctgggaagactgcatggaggaggtgggaactggtataagatgggaagaaacggtattcccctaggcahvgaggccactgcttcctgagagtcagcgccatctgaagaggaagggagatgaagctgggtgccgaggaggaggaaaggttagaaagtggcctgagcagctctataaaacsmtncacttcatttcttttgttttgwyntgttttaaagacagagtcttgctctgtggcccaggctggactgcaatggtgcgatctcagctcactgcaacttccagccycctgggttcaaagcgattctcctgcctcagcctc

SEQ ID NO: 478 - DNA, 172 bp, Homo sapiens
  CDS 14..172
  sig_peptide 14..58: score 10.9 seq LSVCLLLVTLALC/CY
aaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctcga

SEQ ID NO: 479 - DNA, 270 bp, Homo sapiens
  CDS 87..269
  sig_peptide 87..194: score 4.7 seq SCFVPSLVTGALQ/QS
agcagtccagagaagtgaaatgacttgcctgaagccacagagcctgcaagtgcgagggctgggattccaatccaagctctgggccaatggctttgcatatcctagaatgcgagaggaacgtttgttttgtagcagttagacagcctgctcatgaaagctgctttgtgcccagccttgtgacaggtgctttacaacaatcccagacacagcacccaccttgggtttgccctcaggtacagggctcctatccatcctggaagaacagaggga

SEQ ID NO: 480 - DNA, 267 bp, Homo sapiens
  CDS 113..265
  sig_peptide 113..181: score 6.9 seq SLILVCLPIYCRS/LF
  misc_feature 127: d=a or g or t
  misc_feature 128: r=a or g
  UNSURE -19: Xaa=Phe or Leu
  UNSURE -18: Xaa=Gly or Arg
tgagctgcaagatcttagtgagagtgaatgtttgagacacaaatgctgtttttcatcatcggggaccacgagcttcaaatgttttgctccatttagagatgtgcctaaacagatgatgcaaatgttdrggcttggtgcgatcagccttatcctggtatgtctgcccatttattgccgctctcttttctggaggagcgaaccggccgatgatttacaaaggcaggacaacagagttgtaacgggtttgaagaaacaaagaaggaatca

SEQ ID NO: 481 - DNA, 257 bp, Homo sapiens
  CDS 65..256
  sig_peptide 65..109: score 3.9 seq ILVFLCRRLLLEA/SI
atagattctctctttgtgccacaagactgctgcagaaggatgggggcagtggttgtatagataaatgttcattttggtgttcctgtgcagaagattattactagaggcttctattcagctattttgctctacctcctcttccagaacaaggtttcttgagatggaatctatttctgatgaagatgctatgagtattgttgaaatgacaacaaaggatctagaatattacataaacttagttgataaaatggcagcca

SEQ ID NO: 482 - DNA, 299 bp, Homo sapiens
  CDS 22..297
  sig_peptide 22..153: score 4.8 seq SGLMQMLLLKVSA/HI
  misc_feature 100: m=a or c
  misc_feature 161: s=g or c
  misc_feature 203: s=g or c
  misc_feature 239: d=a or g or t
  misc_feature 255: r=a or g
  misc_feature 292: b=c or g or t
  UNSURE -18: Xaa=Lys or Gln
  UNSURE 3: Xaa=Ser or Thr
  UNSURE 17: Xaa=Ala or Gly
  UNSURE 29: Xaa=Cys or Phe or Tyr
  UNSURE 47: Xaa=Phe or Leu or Val
ctctgccaatatcgtgtgtccatgctgaagatggacgagagcacgctgctgcgggaggcccaggagctcagcctggagaagctgcagcaggccgtgaggmagaacgggctcatgtcggggctgatgcagatgctgctgctgaaggtgtctgcacacatcascgagcagctgggcatggccccaggtggcgagttcagggaggscttcaaggaggccagcaaggtgcctttctgcaagtdccacctgggtgaccgrcccatccccgtcaccttcaagagggccatcgcagcgbtctcctt

SEQ ID NO: 483 - DNA, 195 bp, Homo sapiens
  CDS 20..193
  sig_peptide 20..91: score 7.5 seq LISELLLLRSVTS/HN
ttctgattatgatggtaatatggtattctgggaaatatctgtccaaattatcctgatctctgaactcctgctgttgaggtcagtcacttcacacaataccatgatgagagctttatcaagccagatgcttagtcagagctttccaagacccagctttggttttatcagcaaaatccatccttcccacccccccaa

SEQ ID NO: 484 - DNA, 436 bp, Homo sapiens
  CDS 271..435
  sig_peptide 271..390: score 9.1 seq RLMLSLCLPPILS/GT
  misc_feature 27: d=a or g or t
  misc_feature 28: n=a, g, c or t
  misc_feature 29: b=c or g or t
  misc_feature 115: r=a or g
  misc_feature 134: d=a or g or t
  misc_feature 135: k=g or t
  misc_feature 156: w=a or t
  misc_feature 166: m=a or c
  misc_feature 415: w=a or t
  UNSURE 9: Xaa=Cys or Ser
tatcctcacgacaagcctgtgaggcadnbgctcattgttcccatcttgatgaaacttgagtctcagggaagtgaagtgacttgcccagggtcactcaggtagagttgagattcaracccacatgtggctccaadktctgcatctggatttgggggwgttttttggmatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtcccatcccccatgccccttatggggagggagggcgtctgatgctctctctctgcctcccccccatcctgtcaggcacaggtgacgggggcagcccawgcgagcccttctcctgctgct

SEQ ID NO: 485 - DNA, 304 bp, Homo sapiens
  CDS 106..303
  sig_peptide 106..210: score 8.5 seq FVLFCSVLRRSLA/RS
  misc_feature 123: d=a or g or t
  misc_feature 304: y=c or t
  UNSURE -30: Xaa=His or Gln
tcctcactgtgcccaccaggtaacgcttgtggtccttctcctgtgtagcagcatcctctgaaaggatggagactctacaaagagggaccggtgcctgggcctaggatggaagctggcaaacadtggcccatgggcaaatcctgcccaccacatttttttgttttgttttgttttgttttattctgttctgttttgagacggagtcttgctcggtcgcccaggctggagtgcagtggcgcgatcttggctcactgcaacctctgcaccctgggttcaagtgattatcctgcctcagcctccctay

SEQ ID NO: 486 - DNA, 185 bp, Homo sapiens
  CDS 32..184
  sig_peptide 32..133: score 3.8 seq FHQMALXPGTSRA/QA
  misc_feature 114: y=c or t
  UNSURE -7: Xaa=Phe or Ser
acgcggcacacagtcccagtgctcagtcaccatgtgtcctgcatggctcccatgttggacggcacagacggaacatctcgatcgttacaggaagttccaccagatggcgctgtytccagggacatctagggcacaggccttactttataacgaagtcctagagagatttatgttcacccggctgc

SEQ ID NO: 487 - DNA, 194 bp, Homo sapiens
  CDS 30..194
  sig_peptide 30..134: score 4.8 seq PWVLDIFLTLVFA/LG
agttgctagaaagcaatgcgcctattcacatggagaatcttccctttcctctaaaattacttagtgcctcatcactaaacacccccagctccacaccatgggtgttggatatcttcctcaccttggtgtttgccctggggttcttcttcctattactcccctacttctcttacctccgttgtgacaacccacca

SEQ ID NO: 488 - DNA, 352 bp, Homo sapiens
  CDS 158..352
  sig_peptide 158..214: score 6.6 seq MLMVVLLCQVLLG/GA
  misc_feature 118: w=a or t
  misc_feature 122: h=a or c or t
  misc_feature 123: m=a or c
  misc_feature 130: d=a or g or t
  misc_feature 132: w=a or t
  misc_feature 137: h=a or c or t
  misc_feature 321: r=a or g
  misc_feature 323: r=a or g
  UNSURE 36: Xaa=Gln or Arg
  UNSURE 37: Xaa=Asp or Asn
attatattcaaatattccttttaggagccattccgtagtgccatcccgagcaacgcactgctgcagcttccctgagcctttccagcaagtttgttcaagattggctgtcaagaatcawggghmtgttatdawatgchttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcrgracttcgaggcgacacttctgcagatgttt

SEQ ID NO: 489 - DNA, 361 bp, Homo sapiens
  CDS 189..359
  sig_peptide 189..275: score 6 seq LFMALPPVLSSHG/SR
acttgcacttgcttgttggtgtcagagcccgtccctaaaccagggctccatatgggctgcctgtctgccgcaacacagcctagcggggaaacagtagaaatgccacttctatgtatttatcatatttattttgagataattaacgaagacgttaaataaagccagactgcactgacccctggggcgccatgcgagaccccctcgcggacatggtacacagttatttatcatcgtctttgttcatggcccttccaccagtgctgagctcacatggcagcaggaacctgagaatctgggggagtccatttggtggagcgctgactaagggcaaagcacccccaaccccagcacaaccagccct

SEQ ID NO: 490 - DNA, 346 bp, Homo sapiens
  CDS 183..344
  sig_peptide 183..239: score 6.2 seq FLFLIIPISRSHG/KV
  misc_feature 15: d=a or g or t
  misc_feature 126: r=a or g
  misc_feature 128: r=a or g
  misc_feature 131: r=a or g
  misc_feature 136: r=a or g
tatactttctagaadacatttcaatttattatgacaaattacgtcagtaaattcatttaacctttttgtctttttaagaaacttttatgacctctatttacttaacttcatatataatcaaataararcaraagargtgaaaagagaagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaaagtggatggcttgagtccaggagtttt

SEQ ID NO: 491 - DNA, 190 bp, Homo sapiens
  CDS 18..188
  sig_peptide 18..62: score 4.7 seq RCACFPFFPFAFC/HD
  misc_feature 135: k=g or t
  UNSURE 25: Xaa= *  or Gly
ctctctcctgttcggtcatggtgagatgtgcttgcttccccttcttccccttcgccttctgccatgactgtaagtttcttggggcctcccagtcatgcttcttgttaagccggcaaaactgtgtaagcacaggakgaccttcatccaaatctgatatcaactcaaggtctggatcttgttcactggcaag

SEQ ID NO: 492 - DNA, 421 bp, Homo sapiens
  CDS 108..419
  sig_peptide 108..161: score 3.5 seq ALEVIVTLSETAA/AM
aatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcgtaagctgtgtccttcaatgctaga

SEQ ID NO: 493 - DNA, 291 bp, Homo sapiens
  CDS 79..291
  sig_peptide 79..207: score 6.2 seq LALGIPSITQAWG/LW
aagtattggggatgctgagctgcggggtacgggcctgaggagggatgggagtaagaagtgctgtggaaaccgtcagccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggtcggagc

SEQ ID NO: 494 - DNA, 237 bp, Homo sapiens
  CDS 49..237
  sig_peptide 49..180: score 5.2 seq XIYXFNFLRWSLA/LS
  misc_feature 143: k=g or t
  misc_feature 151: k=g or t
  UNSURE -13: Xaa=Cys or Phe
  UNSURE -10: Xaa=Leu or Val
cataccagctctctttcctttttacatcctttcacttttaatctatttatgtctctgtatttaaacttgggttcttgtagacagcatttatgtggttcttgctttcatatccaatctgaaaatctctgccttttatgttattktatttatktatttaattttttgagatggagtcttgctctgtcactcaggctggagtgcagtggcacgatcccgtctcactgcaacctccgcctc

SEQ ID NO: 495 - DNA, 284 bp, Homo sapiens
  CDS 29..283
  sig_peptide 29..106: score 4.9 seq FYLFFVVVHFILC/HD
gtcacctttactagctgtgcagaacctgatggtacatttttgtgtattggttccactgatgacttcgttttaccttttttttgttgttgttcactttattctctgtcatgattttacattgttagtgtttcatttcagttccctcaaatactttctagaacgagtcagttttttgttttgttttgtttcggagacggagtctcgctctgttgttcaggctagagtgcagtggtgcaatctcggctcactgcaacctctgcctcttgggttcaagcaattctcct

SEQ ID NO: 496 - DNA, 195 bp, Homo sapiens
  CDS 26..193
  sig_peptide 26..163: score 6.5 seq WLFFLMLSLCTPP/DR
acttttgctttatgttcaggggtccatgtgtaggatgtgcaggtttgttacatggataaacgtgtgccatggtgatttgctgcacagatcatcccgtcgcctgggtgtgaagccgagcacgcattggctattcttcctgatgctctccctttgcacccctcctgacagaccctggtgtgtgttgttccccccgct

SEQ ID NO: 497 - DNA, 370 bp, Homo sapiens
  CDS 209..370
  sig_peptide 209..289: score 6.6 seq LAFSFSFFPSSFS/SF
  misc_feature 302: k=g or t
  misc_feature 370: r=a or g
  UNSURE 5: Xaa=Phe or Val
ttttggatacatatgactcatgtgacattagatcacagcatttttgtttttattattaatatattgccttagaactacattgctaaacctggtctttgtatctgcgaagttctaacatcttgccacagcttagttagctttgagagggaaagggtagaatccatttaaggagacaggttaaaaaatgatatatttaagcatataggcaatggtagcacatgattaccaaaacataattagccttttctttcttgctttttcattttctttctttccttcttcattttcttctttctttcttktctttctttcttttttctcttctttctttctctctcttctttctttcccttccttcctcccccccggr

SEQ ID NO: 498 - DNA, 401 bp, Homo sapiens
  CDS 200..400
  sig_peptide 200..286: score 8.8 seq VLFCFVFLRQSLA/LS
tcatgattcatgggaggaggtcaaaatatcaacattatcaggagtatggaaagagttgattccaaccctcttcagtgacttcaggggtttaaaacttcagtggaggaaataactgcacatgcggtggaaaaagcaagagaactcaaattagaagtaaagcctgaagatgggactgaattgctaaaatctcctaactttaatggatgaggagttggttcttatgaatgagcaaagaaactgtttttctgttttgttttgttttgtttttttgagacagagtcttgctctgtcagccaggctgaagcgcagtggcacagtctcggctcactgcaacctccgcctcccgggctcaagcatttcttctgcctcagcctccctagtagctgggattacaggcgtgt

SEQ ID NO: 499 - DNA, 215 bp, Homo sapiens
  CDS 23..214
  sig_peptide 23..121: score 6 seq LHQACLLLAPSHP/QC
cgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatc

SEQ ID NO: 500 - DNA, 298 bp, Homo sapiens
  CDS 57..296
  sig_peptide 57..146: score 5.4 seq GLCWACXSSLGSC/EY
  misc_feature 7: n=a, g, c or t
  misc_feature 128: s=g or c
  UNSURE -7: Xaa=Cys or Trp
cattttncagaccaggcctctcacaaagccagggaaagggggttaataaatccgtaatgacgaccttcgtgggcctgcgacctcagccggggggaaggggcaggagtgggctctgctgggcctgctgsagctctcttgggagttgtgaatatgcttgcttccctgggatgagcttttccatcttcaacacacaagccggcctatccacagggaaagaaagtggaaccgaggcttcgcggctgcgggaggagggaggcagagtcactatttaccgggcacggagtttctgtggcgagta

SEQ ID NO: 501 - DNA, 248 bp, Homo sapiens
  CDS 63..248
  sig_peptide 63..143: score 5 seq LSCFYLLAIVSNA/VM
atgttgtagcttctgtcataatttccttcccttttaaggctgaataattttccattgtgtatatgtaccatattttgttcatccattcattcattgatagatacttgagttgcttctaccttttggcaattgtgagtaatgctgttatgaacatgggtgtacaaatgtctgttttgagtccttgttttgctttcgtgcattctattaaaaatgttaaggttctttgctttttacttttttttctcttt

SEQ ID NO: 502 - DNA, 344 bp, Homo sapiens
  CDS 173..343
  sig_peptide 173..253: score 7.6 seq LLFLGFLIIAIQT/DV
  misc_feature 263: w=a or t
  UNSURE 4: Xaa=Arg or Trp
tgagaatctgtttaagaagcagttggaatccctgattccttcttatataactaagctaatgattcttccttttctactttaggagaaaactataatttttaacccctccacccccaacggaggtggtaagaaagaagctctctggactgcttcataacaggcacacttaaagatgtatgtgggtgttcctgtttctccacagcctcgtcagcatctattgtttcttggctttttaataattgccattcagactgatgtgagawggtatctcattgtggttttgatttgcatttatctaatgatcagtgatgttgagttttttttcatacgttttttggccacaa

SEQ ID NO: 503 - DNA, 354 bp, Homo sapiens
  CDS 8..352
  sig_peptide 8..145: score 9.8 seq LLALLQGLSWSFS/LF
  misc_feature 95: b=c or g or t
  misc_feature 154: w=a or t
  UNSURE -17: Xaa=Phe or Leu or Val
gtctgtaatggtgtccaaaattgtgcatacccttgggatgaaaatcattgtaaagaaaagaaaaaagcaggagtatttgaacaaatcactaagabtcatggaacaattattggcattacttcagggattgtcttggtccttctcattattttcwattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctc

SEQ ID NO: 504 - DNA, 282 bp, Homo sapiens
  CDS 98..280
  sig_peptide 98..145: score 7.5 seq LFCLSVCLFEVES/HS
cattacacttacgttactagttgggcctcgaggaagcaacttaatcactttaaggttcagtttcctcatctgtgaaacaactgataatttatatgacatggaacttcttttttgtttgtctgtttgtttgtttgaggtagagtctcactctgtcacccaggctggagtgcagtggcacagtcttggcccactgaactctctgcctcctggattcaagcgattttcctgcctcagcctttcaagtagctgggattacaggcatgcaccaccacctccagcata

SEQ ID NO: 505 - DNA, 369 bp, Homo sapiens
  CDS 43..369
  sig_peptide 43..111: score 6.6 seq VRLLLXLXLLLIA/LE
  misc_feature 89: d=a or g or t
  misc_feature 95: w=a or t
  misc_feature 99: r=a or g
  UNSURE -8: Xaa=Cys or Phe or Tyr
  UNSURE -6: Xaa=Leu or Gln
aatgtgtacacgcccagcttcctgcctgttactctccacagtatgcgaagaatatccctgacttctagccctgtgcgccttcttttgtdtctgcwgttrctactaatagccttggagatcatggttggtggtcactctctttgcttcaacttcactataaaatcattgtccagacctggacagccctggtgtgaagcgcatgtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaa

SEQ ID NO: 506 - DNA, 403 bp, Homo sapiens
  CDS 246..401
  sig_peptide 246..389: score 7.4 seq SLMFLPIFFPSFS/SY
  misc_feature 107: k=g or t
  misc_feature 110: r=a or g
  misc_feature 111: m=a or c
tcttgctctgtggcccagactagattgcagtggcgtgatctcagctcactgcaagctctacctctccggttcacgccattctcccgcttcagcctcccgagtagctkggrmctacaggccgcctgccaccatgcctggctaattttgtttttgtatttttaatagagacagggtttcaccatgttagccaggatggtcttgatctcctgacctcgtaatctgcccaaagtgctgggattacaggcatgagccactgtgcctggccctctgtgtactttttaaaaggcctttcttgtttgttttggacatctgataggctctttcaatatgggaaattttcttgtattctttctttgatgtttcttcccatcttttttccctccttctcttcctacaacataac

SEQ ID NO: 507 - DNA, 290 bp, Homo sapiens
  CDS 106..288
  sig_peptide 106..189: score 4.5 seq RFLSLSAADGXDX/SX
  misc_feature 74: m=a or c
  misc_feature 75: s=g or c
  misc_feature 78: m=a or c
  misc_feature 102: r=a or g
  misc_feature 182: s=g or c
  misc_feature 188: s=g or c
  misc_feature 195: m=a or c
  UNSURE -3: Xaa=Ser or Thr
  UNSURE -1: Xaa=Ala or Gly
  UNSURE 2: Xaa=His or Gln
aagtcagcgctggagtcggctaggcggctggaaacggcggctgccgccggtgactcagggaggcgggaggccgmsggmggagctcttcctgcaggcgtggaraccatggtgctcacgctcggagaaagttggccggtattggtggggaggaggtttctcagtctgtccgcagccgacggcascgatgscagccamgacagctgggacgtggagcgcgtcgccgagtggccctggctctccgggaccattcgagctgtttcccacaccgacgttaccaagaaggatctgaa

SEQ ID NO: 508 - DNA, 250 bp, Homo sapiens
  CDS 75..248
  sig_peptide 75..221: score 7 seq FGLFVSLVFLGQA/FT
aactctttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggag

SEQ ID NO: 509 - DNA, 361 bp, Homo sapiens
  CDS 60..359
  sig_peptide 60..113: score 15.9 seq LLCCLVLLTGVRA/SP
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgcccaagctgagaaccaa

SEQ ID NO: 510 - DNA, 184 bp, Homo sapiens
  CDS 13..183
  sig_peptide 13..156: score 8.5 seq FSVLSGLVLNSWA/QT
cctaatctgttgatggatggatcgatggatggatggatgacagggtgtcactctgtcacccaagctggagtgcagtggtgtgatcacagatcactgcagctgcaaccccctgcagatttctctgtgttgtctgggctggtcttgaactcctgggctcaaacaatcatcttgcttcggcctccct

SEQ ID NO: 511 - DNA, 414 bp, Homo sapiens
  CDS 253..414
  sig_peptide 253..360: score 5 seq SFSIXTLLWGLNC/KR
  misc_feature 102: r=a or g
  misc_feature 319: w=a or t
  misc_feature 320: n=a, g, c or t
  misc_feature 321: k=g or t
  misc_feature 335: k=g or t
  misc_feature 336: d=a or g or t
  misc_feature 342: k=g or t
  misc_feature 395: s=g or c
  UNSURE -14: Xaa= *  or Cys or Phe or Ile or Lys or Leu or Met or Asn or Arg or Ser or Thr or Trp or Tyr
  UNSURE -9: Xaa= *  or Cys or Phe or Leu or Trp
  UNSURE 12: Xaa=Ala or Gly
ctgttttagtgttttgaatatcttcttccagagtttgatgtatatgtatcttggaggtatatgtatttctaattatataaatatttgaccctctttgcctartttgttttattcacttcaactttgaccctttatacttctttttaaatttcactttcttatggttgtttttctacttttcctcaatgccctttgtaaaattttcatttgaatctattattctcccttggacgtcttaattccttctctactatgactttttctttcttttgtttctttcctgggttcaagccactcctgtttcattactttctttttwnktccttttctatttkdactctkctttggggcttgaactgtaagaggtcctggaacataaatttgagaattgttgsatcatacagtagtggttac

SEQ ID NO: 512 - DNA, 328 bp, Homo sapiens
  CDS 113..328
  sig_peptide 113..184: score 7.8 seq LMAGSSLSAGVSG/ED
  misc_feature 218: s=g or c
  UNSURE 12: Xaa=Ala or Pro
tacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccascgatggccaaatctctgaccatagactgtctggaattggcattaccccctgaactggcttttcaacttaatgaattatttggtcctgttggtattgattcagggtctcta

SEQ ID NO: 513 - DNA, 351 bp, Homo sapiens
  CDS 27..350
  sig_peptide 27..95: score 10 seq PLLGLLLSLPAGA/DV
  misc_feature 186: k=g or t
  misc_feature 242: r=a or g
  UNSURE 31: Xaa=Gly or Trp
accgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcakgggaacacttaagaatctgtcctcaggaatatacatgctgcaccacagaaatggargacaagttaagccaacaaagcaaactcgaatttgaaaaccttgtggaagagacaagccattttgtgcgcaccacttttgtgtccaggcataagaaatttgacggtaggt

SEQ ID NO: 514 - DNA, 221 bp, Homo sapiens
  CDS 12..221
  sig_peptide 12..86: score 4.6 seq LPTLLLLPVGAPG/KK
  misc_feature 86: r=a or g
tcgaatgcagaatggttttgggagccctgaaccttccctcccaggaactccccactctcctgctcctcccagtgggggcacctggraagaaaaaaggcatggaaggcaaaactcccttggacctgtttgctcattttggccctgagccaggggaccactcagatccgctgcctccctctgcaccctctcccactcgggagggggctctgaccccgccccca

SEQ ID NO: 515 - DNA, 305 bp, Homo sapiens
  CDS 18..305
  sig_peptide 18..131: score 4.8 seq MLMLAQSNPQLFA/LM
  misc_feature 181: n=a, g, c or t
  misc_feature 182: d=a or g or t
  misc_feature 303: k=g or t
  UNSURE 17: Xaa=His or Leu or Pro or Gln or Arg
  UNSURE 58: Xaa=Asp or Tyr
aattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcndcagtctcggctggagcagctgagtgcggcagagctgcagagcaggaaccagggccactgggctgactggctacaggcgtacagagcccggctggacaaggacctggaaggcgctggggackac

SEQ ID NO: 516 - DNA, 367 bp, Homo sapiens
  CDS 67..366
  sig_peptide 67..183: score 5.4 seq ILLTSCFYTLVSS/TF
  misc_feature 240: y=c or t
  misc_feature 277: w=a or t
  misc_feature 320: k=g or t
  misc_feature 334: k=g or t
  UNSURE 32: Xaa= *  or Lys
  UNSURE 46: Xaa=Leu or Arg
  UNSURE 51: Xaa=Cys or Gly
tggctaacatattcttttttttttctctgtagtagttttttgaaagaagaaataggctattctagcatgatctcatcctgtggagttaaatacttgttttcacatgcctccttattttttatggtagggagtacaggaagtttaatactcttaacttcttgtttctatacccttgtttcatcaacctttcttcaaaaactctcttctttgctcttgatattatttaccgaaacaagtgtycttatgttaaaaacatttgtagctaattcttgctgtwaattgtggtctcacaattgtattaatttcttcaaaaaggtcckgccttcttattgckgcagcagtctactcttcctggccgtacctaggt

SEQ ID NO: 517 - DNA, 233 bp, Homo sapiens
  CDS 58..231
  sig_peptide 58..102: score 4.5 seq LLGAAAVAALGRG/RA
accggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaa

SEQ ID NO: 518 - DNA, 434 bp, Homo sapiens
  CDS 57..434
  sig_peptide 57..101: score 4 seq PTCATCAHPVTLA/QR
  misc_feature 2: n=a, g, c or t
  misc_feature 3: b=c or g or t
  misc_feature 4: k=g or t
  misc_feature 28: b=c or g or t
  misc_feature 286: h=a or c or t
  misc_feature 287: v=a or c or g
  UNSURE 62: Xaa=His or Leu or Pro or Gln
anbkgccgcgtctgcaacggagtcttcbttctccaattgccttctgccccatcaccatgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccctgtttccgccggcgccctgggagaggcctcaccactcggctgggctccctggcccctcccttcccctggcctgagcacccctgcggcchvccgctcctcctgagaaggcgacaatctctttgcaccttagtgtttcgaggacagaaagggcagaagggtcacttcggagccactcgcgccgttttcacgtgtgtgtgtaatggggggaggggggctcccggctttccccttttcagc

SEQ ID NO: 519 - DNA, 379 bp, Homo sapiens
  CDS 190..378
  sig_peptide 190..306: score 4.6 seq AFLSCLAFLVLDT/QE
  misc_feature 187: k=g or t
  misc_feature 361: h=a or c or t
  misc_feature 362: k=g or t
  UNSURE 19: Xaa=Cys or Phe or Ile or Leu or Arg or Ser
actctgcagggcctccaaggccaggcttcagggctgggactcagtcctgaggcactggggagccatgaggggctgtggcagggaggggcagggtgtggaaagactcccctggggccatggtggagatgtgctgaggtcttctccctgatcgtcttctcctccctgctgaccgacggctaccagaackagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggachkcatcctggctgttctct

SEQ ID NO: 520 - DNA, 369 bp, Homo sapiens
  CDS 210..368
  sig_peptide 210..287: score 6.3 seq RQLLLPLPPFSFP/AP
  misc_feature 53: s=g or c
  misc_feature 365: s=g or c
gtcaattctaggagccatcaagcatgaaagtggttctgtctcctgagcgcaasctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggscact

SEQ ID NO: 521 - DNA, 257 bp, Homo sapiens
  CDS 54..257
  sig_peptide 54..173: score 3.9 seq CVYVCVCISVCAC/VY
  misc_feature 92: r=a or g
  misc_feature 108: s=g or c
  UNSURE -28: Xaa=Ile or Met
  UNSURE -22: Xaa=Leu or Val
catctgtgtgtgcgtgtgtatgcgtgtgtgtatgcgtctgtgtgcatgtgtgtatgcgtgtgtgtgcgcatcagtgtctgcatgtgtgtatrtgtgtgtatgtatgtstgtgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgc

SEQ ID NO: 522 - DNA, 231 bp, Homo sapiens
  CDS 62..229
  sig_peptide 62..109: score 11.3 seq PLLLSSLLGGSQA/MD
  misc_feature 85: m=a or c
  misc_feature 178: n=a, g, c or t
  misc_feature 179: k=g or t
  UNSURE 24: Xaa=Ala or Ser
actcacagcacgaccagagaacaggcctgtctcaggcaggccctgcgcctcctatgcggagatgctactgccactgctgctgtcmtcgctgctgggcgggtcccaggctatggatgggagattctggatacgagtgcaggagtcagtgatggtgccggagggcctgtgcatctctgtnkccctgctctttctcctacccccgacaagactggacagggtctaccccagccg

SEQ ID NO: 523 - DNA, 257 bp, Homo sapiens
  CDS 60..257
  sig_peptide 60..170: score 4.5 seq CTTLLVYVRYAWQ/DD
  misc_feature 74: k=g or t
tacctaatgataacacagtatctcttcgaatttgtactattgcagaacatttagaaacaatgcttattactcgkttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgc

SEQ ID NO: 524 - DNA, 354 bp, Homo sapiens
  CDS 79..354
  sig_peptide 79..180: score 5.2 seq LWSSCWLAPLADG/ML
  misc_feature 16: d=a or g or t
  misc_feature 203: v=a or c or g
  misc_feature 211: n=a, g, c or t
  misc_feature 263: r=a or g
  misc_feature 287: k=g or t
  misc_feature 288: h=a or c or t
  misc_feature 289: m=a or c
  misc_feature 344: r=a or g
  UNSURE 8: Xaa=Pro or Gln or Arg
  UNSURE 11: Xaa=Gly or Arg or Trp
  UNSURE 28: Xaa= *  or Trp
  UNSURE 36: Xaa=Ile or Arg or Ser
  UNSURE 37: Xaa=Ile or Leu
  UNSURE 55: Xaa=His or Arg
agatgaagaggaggcdgtggcagtggtggaagaagaggcgcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcvgcagcgangggcatccaatccagaggggtccactctagaggccaggccaccagcaccatrggccagtgtgtcaccaagtgtaakhmtccctcatcgaccctgggcagcaaaaatggagaccgtgagcccagcaacaagtcrcatagcaggc

SEQ ID NO: 525 - DNA, 173 bp, Homo sapiens
  CDS 16..171
  sig_peptide 16..156: score 3.6 seq FLCLSLPRTGITG/MC
agttgtgttgtgccaatggtggagaagaaaacttcggggtctctctctgttgcccaggctggaatgcaatggcgcgatctcagctcgctgcaacctccacctcccgggttcaagcgattcttgtgcctcagcctcccgcgtactgggattacaggcatgtgccaccacaccct

SEQ ID NO: 526 - DNA, 427 bp, Homo sapiens
  CDS 275..427
  sig_peptide 275..394: score 4.2 seq LLSGLCVAVCAQX/GH
  misc_feature 331: w=a or t
  misc_feature 392: y=c or t
  UNSURE -1: Xaa= *  or Gln
catttcctaatctctgcattttccagcaagtaagtggtggtgacttgttgctttcaagtatgttttgtctaaaattcatagatgctgaactgtgtatatttgttgtcaagtttgaaaggtacttgggtttttgggggtgttaggaggtagggtggatgttactattaaatacatttagactttttaaaataagtgtaactgatcatttccaacaaatatttactatgtccatacttgtgctccaaaagacaattctgtcttcctcttgagatacatgtctcggggcccctgtaggtctggtctgagagggtccccatgggtggctgtgtcwgctggcgctttcttggacactcctctgctctcaggactgtgtgtagcagtctgcgctcagyaaggccatgttggtgtgatgggcttcggctcagat

SEQ ID NO: 527 - DNA, 251 bp, Homo sapiens
  CDS 79..249
  sig_peptide 79..210: score 4 seq XLMVAMRCLGASP/XP
  misc_feature 97: s=g or c
  misc_feature 98: v=a or c or g
  misc_feature 143: r=a or g
  misc_feature 173: m=a or c
  misc_feature 190: m=a or c
  misc_feature 212: s=g or c
  misc_feature 233: n=a, g, c or t
  misc_feature 234: s=g or c
  UNSURE -38: Xaa=Ala or Glu or Gly or Pro or Gln or Arg
  UNSURE -23: Xaa=Lys or Arg
  UNSURE -13: Xaa=Ala or Asp
  UNSURE 1: Xaa=Arg or Thr
  UNSURE 8: Xaa=His or Leu or Pro or Gln or Arg
agacttgaggctggaggaaagggaactgaacgcggttctgggagcagcaagcccacgggtagcagccgaggccccagaatggccaagtttctttccsvagaccaaattaatgagtacaaggaatgcttctccctgtatgacargcagcagagggggaagataaaagccaccgmcctcatggtggccatgmggtgcctgggggccagcccgasgccaggggaggtgcagcggcnstgcagacccacgggata

SEQ ID NO: 528 - DNA, 247 bp, Homo sapiens
  CDS 28..246
  sig_peptide 28..69: score 3.8 seq LDSLLALGGLVLL/RD
  misc_feature 116: k=g or t
  misc_feature 117: s=g or c
  misc_feature 171: y=c or t
  misc_feature 174: b=c or g or t
  misc_feature 190: r=a or g
  misc_feature 202: s=g or c
  misc_feature 209: r=a or g
  misc_feature 230: r=a or g
  UNSURE 16: Xaa=Gly or Val
  UNSURE 35: Xaa=Asp or Glu
  UNSURE 41: Xaa=Gly or Ser
  UNSURE 45: Xaa=Asp or His
  UNSURE 47: Xaa=Asn or Ser
  UNSURE 54: Xaa=Asp or Gly
agagcagggaccggacgcgagttggagatgttggactcgctgttggccttgggcggcctggtgctgcttcgggattccgtggagtgggaggggcgcagtctcttgaaggcgcttgksaagaaatctgcactgtgtggggagcaagtgcatatcctgggctgtgaagtgagygabgaagagtttcgtgaargttttgactctsatatcarcaatcggctggtttaccatgrcttcttcagagaccctc

SEQ ID NO: 529 - DNA, 467 bp, Homo sapiens
  CDS 285..467
  sig_peptide 285..350: score 3.8 seq FGLLLGNLCSVKS/TE
  misc_feature 43: s=g or c
  misc_feature 45: h=a or c or t
  misc_feature 358: n=a, g, c or t
  misc_feature 359: n=a, g, c or t
  UNSURE 3: Xaa=Ile or Lys or Met or Asn or Arg or Ser or Thr
aaaaaagttagttcggcttacacccaggaatgagcaaggacaschtggaggttaaaagcaagatacagtcagtcatcttcttcagggtaacctcaaatgttccaaggtcttacacctactcatcatattcagggaactgagactccacacacctcactttgaggctggaatatgctgaaactgcctccacaaactcattattctggaccaagacttacagcctaaagtgaaggacatttccaaagaaattttctcctcactgatgcctctcctgctgcaatgcaatgaccctggctatgtacaagacatactttggcttgctcctgggaaacctttgctctgtaaagagcactgagannttgctaccattgctggcttcaagcactttgtccccattcatttccaagatggagtcttgctcttgttacccaggttggagtgcaatggcacaatctcggctcactgca

SEQ ID NO: 530 - DNA, 359 bp, Homo sapiens
  CDS 17..358
  sig_peptide 17..130: score 3.5 seq LAMMNSILRGLNS/KQ
taaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccac

SEQ ID NO: 531 - DNA, 205 bp, Homo sapiens
  CDS 41..205
  sig_peptide 41..175: score 5 seq FSMLARLVLNSWP/QV
gcggttatccagcgagtcacgtagcaagactacaattcccatgaggctcagcaagggcgatttagggtccagggaagcaatgagacgtgttctttgttttcctatgggtgaggaatggttgtatgagcagtggggtttttctatgttggccaggctggtcttgaactcctggcctcaagttatctgccctcctctgcctcccagc

SEQ ID NO: 532 - DNA, 457 bp, Homo sapiens
  CDS 139..456
  sig_peptide 139..240: score 3.6 seq XLALSLRLXCXGX/IS
  misc_feature 145: s=g or c
  misc_feature 167: k=g or t
  misc_feature 197: r=a or g
  misc_feature 202: r=a or g
  misc_feature 228: k=g or t
  misc_feature 233: k=g or t
  misc_feature 238: r=a or g
  misc_feature 317: m=a or c
  misc_feature 341: w=a or t
  misc_feature 356: w=a or t
  misc_feature 363: s=g or c
  misc_feature 384: w=a or t
  misc_feature 385: m=a or c
  misc_feature 398: r=a or g
  misc_feature 404: h=a or c or t
  misc_feature 412: r=a or g
  UNSURE -32: Xaa=Ala or Pro
  UNSURE -25: Xaa=Gly or Val
  UNSURE -15: Xaa=Lys or Arg
  UNSURE -13: Xaa=Gly or Ser
  UNSURE -5: Xaa=Asp or Glu
  UNSURE -3: Xaa=Ile or Ser
  UNSURE -1: Xaa=Ala or Thr
  UNSURE 26: Xaa=Lys or Thr
  UNSURE 34: Xaa=Leu or Gln
  UNSURE 39: Xaa= *  or Leu
  UNSURE 41: Xaa=Asp or Glu
  UNSURE 49: Xaa=Lys or Gln
  UNSURE 53: Xaa=Glu or Gly
  UNSURE 55: Xaa=His or Leu or Pro
  UNSURE 58: Xaa=Met or Val
tcttcatgatgttaatgggttcttttgctgtgcagtagctttttagtttaatataatcccatttgtttatttttgcttttgatgcctgtgtttttgaggttttacccataaaatattttcccagaccagtgtcctaaaatgtttsccctatgttttcttacagtggkttttatcatttcaaatcttttttttttgaracggrgtcttgctctgtcgctcaggctggaktgcaktggcrcgatctcggctcactgcaacctccgcctcccaggttcaagcaattctcctgcctcagcctcccgagtagctgggattamaggcgtgcaccaccacgcccggcwaatttttgtattttwagtggasacggggtttcaccatgttggwmaggctggtctcgragttchtgacctcrtgatcctcctgcctccgcctcccaaagtgctgggattacaggcgt

SEQ ID NO: 533 - DNA, 447 bp, Homo sapiens
  CDS 273..446
  sig_peptide 273..329: score 5.9 seq PXXLLILAHITQS/CP
  misc_feature 117: k=g or t
  misc_feature 120: r=a or g
  misc_feature 295: r=a or g
  misc_feature 296: m=a or c
  misc_feature 297: r=a or g
  misc_feature 386: r=a or g
  UNSURE -12: Xaa= *  or Cys or Tyr
  UNSURE -11: Xaa=Met or Val
gtatttgttaaatgctacaagagtgactgggatcataagtgttacgggagtttggcaaagaagcaggaggtagttagtgtaactgttaatgtgattataagactaatacattttgtkggragataacttaccaagtttggtttgtggaaaatttggattgagaaggaaattgtatgtttccgttagaagtagaacaacaacaacaaaatatctcccatcatttgtttggtactatctggcctccccagtgctgcttgggagaatcatgaaacatgatgaatcaaacacatccttrmrtgttgctcatcctggcacatattacacagagttgcccatgggcccatgtaggagcagctccatctgcccttctaatacataggtgggarctgagggggtgctcgtatttgaaactgtttttggttatggtgctcatatttgaaatgcttt

SEQ ID NO: 534 - DNA, 420 bp, Homo sapiens
  CDS 230..418
  sig_peptide 230..307: score 5.6 seq LWCLLPPASFTHS/LG
  misc_feature 120: k=g or t
  misc_feature 122: k=g or t
  misc_feature 134: k=g or t
  misc_feature 324: n=a, g, c or t
  UNSURE 6: Xaa=Ala or Asp or Gly or Val
gatgtctgaggtggcatgacaacacatggcaggattaatatcatttgcacttattttggtatttatattaaatataatgcagtatttaaattcgcagacaagtcagctcccccattatckakgttttaatattkatttgtgtccactttcgaggtgaaactgactgtattcagcatttcagcccgtgtttaaggtggcttgtccctgaaaggtggagtgttggggattcatgcaaacatttgaggaagggcacctcccagaaaactttctttggtgccttttacctcctgcttcttttactcactcattggggttttgccaggncttacactgctctttcctcaacttctttccctctttgccgcttttctattttgtcgttccatgcttgagcatggccttcccctccctctcctgtca

SEQ ID NO: 535 - DNA, 318 bp, Homo sapiens
  CDS 153..317
  sig_peptide 153..257: score 4.9 seq LFIFIGSLQPVPT/RF
  misc_feature 117: r=a or g
  misc_feature 124: r=a or g
  misc_feature 132: w=a or t
  misc_feature 134: w=a or t
  misc_feature 135: m=a or c
  misc_feature 283: d=a or g or t
  UNSURE 9: Xaa=Asp or Gly or Val
cacacacaaactctcaagtggcctaattccctctcaccaaaccaatcacaatacagataaaagagaataacttgtgttcatttttgtacaaacaaaaaagatataaattgtgaatgrtgcatgrtttttaawtwmccaagtaaactgggcaaatgcttctgcattatttaaagctaaaaggtgatcagtggaaactttcctctgttagtactctaatactttttatatttatcggctcactacaacctgtgcctaccaggttcaagcgattctcctgtctcgdccacctgagtagccgagaccacaggcaagcactac

SEQ ID NO: 536 - DNA, 471 bp, Homo sapiens
  CDS 114..470
  sig_peptide 114..167: score 11 seq LLLWASLLTGAWP/SF
  misc_feature 54: s=g or c
  misc_feature 55: s=g or c
  misc_feature 56: n=a, g, c or t
gcgagaccagagcgagcgaacgaaccgcggcggtccggagagccccgagcgcassnaggacctgggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtca

SEQ ID NO: 537 - DNA, 344 bp, Homo sapiens
  CDS 149..343
  sig_peptide 149..214: score 4.2 seq TAYWLSFMSWAQS/SS
  misc_feature 233: h=a or c or t
  UNSURE 7: Xaa=Phe or Ile or Leu
tgtatactgaggttcaggaactgctggagagatgactgggcaccaagaggatgacagtgactcagctggcatcccttagctggttcatggcagagctgagtggccactcctgtctctgaccccagcttcagtgctctttatctcctccatgcctcctcagtcgtgctgctctaagactgcttactggctttccttcatgtcctgggcacagagcagttcttttggtagcagahttgagtccacttccccctgcacagatcactgctcaggacccagagaggagcagctctgctccagcagggttttccattgcatcacacacccaaacggtaggatccaccggt

SEQ ID NO: 538 - DNA, 221 bp, Homo sapiens
  CDS 1..219
  sig_peptide 1..66: score 6.2 seq ILVLTLNVNGLNA/SN
atgacagaatcaaattcacacatatcaatattagtactaaccttgaatgtaaatgggcttaatgcatcaaataaaaggcacagagtggcaagttggataatgaagcaaaacacaatggtatgctgtattcaagagacccatcccccatgcaatgatgcccataggctcaaagtaaaggaatggagaaaaatctgccaagcaaacagaaaacagaagaaaga

SEQ ID NO: 539 - DNA, 431 bp, Homo sapiens
  CDS 171..431
  sig_peptide 171..314: score 3.8 seq NSLLLLLCLYIYP/HS
  misc_feature 335: w=a or t
  misc_feature 337: d=a or g or t
  misc_feature 338: d=a or g or t
  misc_feature 375: r=a or g
  misc_feature 376: n=a, g, c or t
  misc_feature 377: n=a, g, c or t
  misc_feature 379: k=g or t
  UNSURE 7: Xaa=Asp or Glu
  UNSURE 8: Xaa= *  or Cys or Phe or Leu or Trp or Tyr
  UNSURE 21: Xaa=Ala or Asp or Glu or Gly or Ile or Lys or Met or Asn or Arg or Ser or Thr or Val
  UNSURE 22: Xaa=Cys or Phe
actctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgawtddtcttcactgcttaccatggacctgggacgggtagatrnntktaatgaatccagattttctgttgtatacacacctgtcaccaacacgacccct

SEQ ID NO: 540 - DNA, 343 bp, Homo sapiens
  CDS 42..341
  sig_peptide 42..161: score 5.9 seq VVLAWGLLNVSMA/GM
  misc_feature 238: d=a or g or t
  misc_feature 239: y=c or t
  UNSURE 26: Xaa=Ile or Asn or Ser
ccagagagagtggcgcgagctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatadygagcttgcccttgcatctctcttcagccttaatgccttatttgatttttggagatatttcaaatatactgtggcaccaacaagtctggttgttagtcctggacg

SEQ ID NO: 541 - DNA, 286 bp, Homo sapiens
  CDS 121..285
  sig_peptide 121..222: score 7.2 seq LLLFSLLVSPPTC/KV
  misc_feature 269: h=a or c or t
  UNSURE 16: Xaa=His or Leu or Pro
aaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggchcactccacctacccgat

SEQ ID NO: 542 - DNA, 300 bp, Homo sapiens
  CDS 104..298
  sig_peptide 104..175: score 4.8 seq ILSLFCWDTESLA/PS
  misc_feature 136: s=g or c
actctcacgagaacagcatgtgggaaaccagggaaactgtccccatgatccagtgacctcccaccaggtccctcccttgacacaacagagattacaatttgagatgagatttggatggagacacagagccaaaacsatattaagcctgttctgctgggacacagaatcacttgctccatctcatacattgatgatgattaatttgtatgtgtaccttccaaaaaagatggttgtgtttgaatggaggccttctggacaggaaaataatcacatccttcctgagataatgagcacactcgt

SEQ ID NO: 543 - DNA, 404 bp, Homo sapiens
  CDS 147..404
  sig_peptide 147..278: score 3.5 seq AVVMLMVAIFAGT/MQ
  misc_feature 341: v=a or c or g
  misc_feature 342: k=g or t
  UNSURE 21: Xaa=Lys or Asn
  UNSURE 22: Xaa=Ala or Ser
agtctggaaagccgctgcctaaggaagaggtggcagtgctgattcaggtggtcctttgccattccaaaagaaagctggattgccttaccaaatctccaggtttttcgttatacctcttcactcaggctctgcccagaactcaaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaavkcacatacaccaccaggaaatgccgaggtcaccaccaacatcccaaagatggaagcagccact

SEQ ID NO: 544 - DNA, 330 bp, Homo sapiens
  CDS 150..329
  sig_peptide 150..248: score 3.8 seq WSLALSSRLECNG/AI
  misc_feature 138: s=g or c
agagccaccgggctggggaccggggagcggaggctgaaatccccagacgccggttttctgggctgggctttctgccttactcactccttctccctctttctggattttaccgaccgttcgcgaaacagctttccacasaatggagcttcatgtcctcgtgcaggaagtactcatcgactgatgtggcagactttgctccctggcaaaaatggagtctcgctctgtcatccaggctggagtgcaatggcgccatctctgcttactgcaacctctgcttcccgggttcaagcgaatctgcttcccgagttcaagcgattctcctgcctcagc

SEQ ID NO: 545 - DNA, 420 bp, Homo sapiens
  CDS 253..420
  sig_peptide 253..321: score 6.2 seq LCNLSIFFCCSVS/QP
  misc_feature 133: b=c or g or t
catatattaagacatatcagaattttagaactctcatacaatcctggaacacatattaacaacaaatctctatcagtataacccaaaggaagctaaacaccacctcacacttgacaatgtttcctgtataatbcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtaatcccaacactttgggaagccaaggtgggagaattgcttgaa

SEQ ID NO: 546 - DNA, 327 bp, Homo sapiens
  CDS 87..326
  sig_peptide 87..128: score 5.7 seq NVLIIVFVAFAFG/FL
  misc_feature 132: y=c or t
tatcttctctccagtctaaagcctcactgaacaaactgtccttgactgtcagtgctcagggaactgctctgccacccttctcctcaatgaatgtgttaatcattgtttttgttgcatttgcttttgggttcytggtcatgaagtctttgcttaagccaatgtcgagaagggtttttctgatgttatcttctaggatttttatggtttcaggtcttagatttaagtccttgatccatcttgagttgatttttgtatataagttgagagatgaggatccagtttcattcttctacatgtggcttgccaattatcccagcaccatttgtt

SEQ ID NO: 547 - DNA, 338 bp, Homo sapiens
  CDS 166..336
  sig_peptide 166..222: score 4.2 seq LLSLAAYLSGPHQ/EP
  misc_feature 129: m=a or c
  misc_feature 306: h=a or c or t
aaatgtcctccacagctttgcccagtgggacacatggctcctgacatacgtaacccaggatgggatgccttgttggagtctctcagatatggagcaaaatgggccatgtgcagtcaagacgccatctamcctgggcagcttgcctaagcctcgagggacctgccaatgatggatctgagacctcttctgtccctggctgcctatctgtctggtcctcatcaagaacccagtgttcccacccgagatggagacgtgaataatcttcctaagcctaatcctgccagaagcgtgaagcaagggggaathtggaaggcggaacaggaaagagtggaagtgga

SEQ ID NO: 548 - DNA, 381 bp, Homo sapiens
  CDS 88..381
  sig_peptide 88..174: score 5.8 seq LHAXAGAAASVIA/AD
  misc_feature 145: y=c or t
  misc_feature 156: k=g or t
  UNSURE -10: Xaa=Phe or Leu
acttatctgcagacttgtaggcagcaactcaccctcactcagaggtcttctggttctggaaacaactctagctcagccttctccaccatgagcctcagacttgataccaccccttcctgtaacagtgcgagaccacttcatgccyttgcaggtgckgctgcttctgtcattgctgctgactgctctggcttcctccaccaaaggacaactaagagaaacttggcgaaaggcaaagaggaaagtctagacagtgacttgtatgctgaactccgctgcatgtgtataaagacaacctctggaattcatcccaaaaacatccaaagtttggaagtgatcgggaaaggaacccattgcaaccaagtcgaagtgatagccacactc

SEQ ID NO: 549 - DNA, 357 bp, Homo sapiens
  CDS 54..356
  sig_peptide 54..134: score 5.9 seq ALALAXAPDLAQA/PL
  misc_feature 111: h=a or c or t
  misc_feature 332: r=a or g
  misc_feature 333: n=a, g, c or t
  UNSURE -8: Xaa=Ile or Leu
  UNSURE 66: Xaa=Ile or Met
  UNSURE 67: Xaa=Phe or Ile or Leu or Val
agtgcagaaggttctgggaagtaggagaccccactggctttggtcccctaagaatggactctgctgcctgtgctgctgctgccacccctgttccagccctggctttggcchtagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccatrntccatcaccctgtcaggctcttct

SEQ ID NO: 550 - DNA, 448 bp, Homo sapiens
  CDS 150..446
  sig_peptide 150..272: score 6.5 seq IAVLVLYFLFVLA/VG
  misc_feature 298: s=g or c
  misc_feature 363: r=a or g
  UNSURE 9: Xaa=Ser or Thr
  UNSURE 31: Xaa=Ala or Thr
ggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagascaaaagagacacagtgaaaggctacttcctggctggaggggacatggtgtggtggccagtgggtrcatccttgtttgccagcaatgttggaagtggacatttcattggcctggcagggtcaggtgctgctacgggcatttctgtatcagc

SEQ ID NO: 551 - DNA, 363 bp, Homo sapiens
  CDS 139..363
  sig_peptide 139..213: score 4.8 seq LWFPSMLFSLSLL/SN
  misc_feature 345: v=a or c or g
  misc_feature 353: n=a, g, c or t
  UNSURE 47: Xaa=His or Leu or Pro or Arg
taataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggvaaaatccntaacacccca

SEQ ID NO: 552 - DNA, 263 bp, Homo sapiens
  CDS 11..262
  sig_peptide 11..103: score 3.6 seq LFIYLVFVECLLC/TR
  misc_feature 115: r=a or g
  misc_feature 118: w=a or t
  misc_feature 121: k=g or t
  misc_feature 128: k=g or t
  UNSURE 4: Xaa= *  or Trp
  UNSURE 5: Xaa=Asp or Glu
  UNSURE 6: Xaa=Arg or Ser
  UNSURE 9: Xaa= *  or Gly
agggtaatggatgggaattgatattttctatccttcacacatcccagactttcatcctattcatttattcatttatctagtgtttgtagagtgccttctgtgtaccaggaactgrgawagkttgtcckgattcaactgtgataacgctcaaataatcttcacaacaggctcatcctctagtggaggaaataaaccatttaaaagtagtttatgtacagtacatagaggccaagaaagggaaagaatagagtgccaagggaatg

SEQ ID NO: 553 - DNA, 362 bp, Homo sapiens
  CDS 192..362
  sig_peptide 192..323: score 6.9 seq LNLLSSWSSMAQS/RL
gagctggatgcctcccacgagagcgtcccttccaagcggccccggagtggagtggagtggagtggataggggtagacttttcacacggggacaaattattacaggatatctgcgccccctgttccgagtcactcggggccatcgggttacttcagcaggttctctgcatcacggacccttttgaggctcagatggagccttgctctgtcacccaggctggtgtgcaatggcacaatctcgactcactgcaacctccatctccaaggttcaagttattctcctgcctcaacctcctgagtagctggagttcaatggcacagtctcgactcactgcaacctccatctccaagccgccgccgccc

SEQ ID NO: 554 - DNA, 385 bp, Homo sapiens
  CDS 194..385
  sig_peptide 194..334: score 7.6 seq LXLGEGLTFLCLC/QV
  misc_feature 141: m=a or c
  misc_feature 142: s=g or c
  misc_feature 145: s=g or c
  misc_feature 151: k=g or t
  misc_feature 298: h=a or c or t
  misc_feature 299: m=a or c
  misc_feature 352: n=a, g, c or t
  UNSURE -12: Xaa=Ile or Leu
  UNSURE 6: Xaa=Lys or Asn
agtgagagcttagtcttggtactatttgtttttgtttcttactgtttgtctgtttatggttggttgcaagaaaattgtgttgtaaattatcccttgctttctctattagttaatagccttccccttctgtagtaaagtaamsagscttttkcctgttcaaatattttaggcttgttttttgttttgattgtacatgcctgtgtgtttttattccttaatttgtttctttatttatttctgtttgttatctccaagagaaacaatagaagaggtggccctcttccagttttctctgcthmtcttgggagagggtctcacctttctttgcctctgccaggtaatgacgaataanatgcaactgctgttcttgagtggggtagtctgt

SEQ ID NO: 555 - DNA, 411 bp, Homo sapiens
  CDS 126..410
  sig_peptide 126..176: score 4.6 seq ILLWEACTGRCQA/SL
tattcagttgggggcaagccagccatgatgtggacctttcattgggtagggcaagtccccaaagttggaaaaatggaaagtgggagctgtgaggcacgtgttacacccacactttcctcctacagatgcagtgttggattttgttgtgggaggcatgcacaggtaggtgccaggcctccctactctctccctggcccagaggtggcaggggcaagttagtggcagtggtggctgcaaaatggttggcagcaatctgtgggatttgggctatcaaagaaatgccaagccatggccacagtcttcaagcaggggcaggggaaggtgcactggtgacctggagcctgcaaacctcatttggtgtgaagcagtataagtggggagttgtgtggcatgaagcaaacctgttgcttc

SEQ ID NO: 556 - DNA, 472 bp, Homo sapiens
  CDS 289..471
  sig_peptide 289..402: score 4.4 seq LELLTSGDPLASA/SQ
cataacaccaggttaaatgattttttatatctcccaaagaagtatttttcaatctgcagatcatgaccccttagtagattgtgaaacacattagtggattatgacaagcatttttagaaaaatgaaaaaggattaggaagtgttaggatgcattgcattattgaaataattgtttttgagatggagtttcgctcttggttgccgaggctggagtgcaatggcccgatctgcctcccgggttcgggtgattctcctgcctcagcctcctgagtagctgggattacagacatgctccaccatgcctggctaattttgtatttagttttagtagagatggggtttctccatgttggtcaggctggtcttgaactcctgacctcaggtgatccacttgcctcggcctcccaaagtgctggggatacaggcatgaacccctgtgcccggcctaatttttgtatttttagtagagatg

SEQ ID NO: 557 - DNA, 419 bp, Homo sapiens
  CDS 114..419
  sig_peptide 114..188: score 4.4 seq VVSWLVSAEGSHP/DP
  misc_feature 147: s=g or c
  misc_feature 206: d=a or g or t
  misc_feature 302: s=g or c
  UNSURE -14: Xaa=Gly or Arg
  UNSURE 6: Xaa= *  or Cys or Trp
attccactcttcctggactgcagaggagtcgccgatcccacttgggtccggagtcagggccttcaggggtccgggaacgccgccatcccgagtggtgaaggaggagatctcggatgacaatgccaagctaccatgcttcaatggccsgggtggtgtcctggctggtgtcagctgagggctcacacccagacccagcccccttctgdgctgataacccatcggagctgccaccacctatggagcgcacgggaggcatcggggactcccgacccccatccttccaccctcatgctggtgggggsagccaggagaacctggacaatgacacagagacggactctttggtgtctgcccagcgagagcggccacgccggagggatggcccagagcatgcaacccggctaaatggaactgcgaag

SEQ ID NO: 558 - DNA, 397 bp, Homo sapiens
  CDS 53..397
  sig_peptide 53..121: score 5.9 seq TLKFLTLLQKSNA/KR
  misc_feature 128: s=g or c
  misc_feature 325: m=a or c
  UNSURE 3: Xaa=Ala or Pro
gacgaagctcgatgaagatttagagagttccagtgaatccgatgtgagtctgatgatgacagcacctgttctagcagctcagactctgaagtttttgacgttattgcagaaatcaaacgcaaaaaggsccaaccttgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtmtccccgcctacgaactttttaactgacaggccaactgttatagaatacgatgatcacgagtatatctttgaa

SEQ ID NO: 559 - DNA, 385 bp, Homo sapiens
  CDS 204..383
  sig_peptide 204..287: score 7.7 seq LVMCFLSYFGTFA/VE
  misc_feature 122: s=g or c
ttggtaattttcagctcacaaatgatgaagaaatccataacgtcggaacttccttgacctttggatttggcacattgacctgctggatccaggctgcgctgacactcaaggtcaacatcaasaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatca

SEQ ID NO: 560 - DNA, 452 bp, Homo sapiens
  CDS 47..451
  sig_peptide 47..106: score 10.6 seq LLTLLALLAHTSA/VA
  misc_feature 27: s=g or c
  misc_feature 120: v=a or c or g
  misc_feature 320: h=a or c or t
  misc_feature 321: n=a, g, c or t
  misc_feature 322: n=a, g, c or t
  misc_feature 330: s=g or c
  misc_feature 378: m=a or c
  misc_feature 396: s=g or c
  UNSURE 5: Xaa=Lys or Arg or Thr
  UNSURE 72: Xaa= *  or Cys or Phe or His or Ile or Lys or Leu or Met or Asn or Pro or Gln or Arg or Ser or Thr or Trp or Tyr
  UNSURE 75: Xaa=Arg or Thr
  UNSURE 91: Xaa=Ala or Glu
  UNSURE 97: Xaa=Cys or Ser
acgggcccggcgcgggagggagcgaasagcgcgggcagcgagcgagatgcagcaccgaggcttcctcctcctcaccctcctcgccctgctggcgcacacctccgcggtcgccaaaaagavagataaggtgaagaagggcggcccggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcacchnnggtggaasagacgctgcatgcctgccagcggctgcaccaggagggaagttcgtggmgcttggcctctccaaatstgctagctgggaagtggccgagatctgtacctctgcaagagcaatggctggatcct

SEQ ID NO: 561 - DNA, 478 bp, Homo sapiens
  CDS 325..477
  sig_peptide 325..444: score 3.9 seq CVNLLLGFEPVIS/RS
  misc_feature 144: k=g or t
  misc_feature 148: r=a or g
  misc_feature 157: r=a or g
  misc_feature 158: k=g or t
  misc_feature 160: r=a or g
  misc_feature 453: r=a or g
  misc_feature 454: m=a or c
  UNSURE 4: Xaa=Arg or Ser
taaaacttagggggaagatttgcctctcactttttttcttggaaaatgtgggcagcaattttaaagagaacatgaaaatggagtaggttgaaaccaacattcagaacttcctttcatggattgaaacttaaagctgagggaggktttragggtggarktraggaagggctagaagatagcaaatttcagagtcatatcagagaatatgaactgtcagtgtttccaatgtttctcttggctctgcacagcacttccaagcccttttgctcactgttttgcttctgccacacctaggagaagattcagagcttgctgaggcaaaacatgcgatatttccaagggccttccccctattctgaaatagaaattgagctttgtgatcatgtgtattcattccaaggtctatgtgttaaccttttgctaggatttgaacctgttattagtaggagccgrmgcagttcacttgctgttgagtcta

SEQ ID NO: 562 - DNA, 412 bp, Homo sapiens
  CDS 5..412
  sig_peptide 5..91: score 11.4 seq LCLLGCLLSHAAA/AP
  misc_feature 138: m=a or c
  misc_feature 141: w=a or t
  misc_feature 146: r=a or g
  misc_feature 155: s=g or c
  misc_feature 169: s=g or c
  misc_feature 171: n=a, g, c or t
  misc_feature 190: k=g or t
  misc_feature 191: r=a or g
  misc_feature 289: n=a, g, c or t
  misc_feature 290: n=a, g, c or t
  misc_feature 316: s=g or c
  misc_feature 330: r=a or g
  misc_feature 331: s=g or c
  misc_feature 353: n=a, g, c or t
  misc_feature 354: n=a, g, c or t
  misc_feature 401: s=g or c
  UNSURE 16: Xaa=Lys or Thr
  UNSURE 17: Xaa=Asp or Val
  UNSURE 19: Xaa=Glu or Lys
  UNSURE 22: Xaa=Leu or Val
  UNSURE 26: Xaa=Lys or Asn
  UNSURE 27: Xaa=Ile or Asn or Ser or Thr
  UNSURE 33: Xaa=Lys or Asn
  UNSURE 34: Xaa=Glu or Lys
  UNSURE 66: Xaa=Asp or Glu
  UNSURE 67: Xaa=Ala or Pro or Ser or Thr
  UNSURE 75: Xaa=Lys or Asn
  UNSURE 80: Xaa=Lys or Asn or Arg or Ser
  UNSURE 88: Xaa=Ala or Cys or Asp or Phe or Gly or His or Ile or Leu or Asn or Pro or Arg or Ser or Thr or Val or Tyr
  UNSURE 104: Xaa=Ala or Pro
tacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaamggwcaaaragttggcastgcaatacctgaasancttctatggctgccccaakragagctgcaacctgtttgtgctgaaggacacactaaagaagatgcagaagttctttggactgccccagacaggtgatcttgaccagaataccatcgannccatgcggaagccacgctgcggcaasccagatgtggccarstacaacttcttccctcgcaagnncaagtgggacaagaaccagatcacatacaggatcattggctacacasctgatctggac

SEQ ID NO: 563 - DNA, 458 bp, Homo sapiens
  CDS 185..457
  sig_peptide 185..298: score 6.3 seq PCVSLLWAPRXFA/SS
  misc_feature 126: s=g or c
  misc_feature 128: w=a or t
  misc_feature 291: s=g or c
  misc_feature 331: n=a, g, c or t
  misc_feature 332: k=g or t
  UNSURE -3: Xaa=Ala or Gly
  UNSURE 11: Xaa=His or Gln
  UNSURE 12: Xaa=Cys or Gly
taacccatatagtagttaagccattgtggtgagggtgtttgaaacccagctatcctatgtaatgctatttccaggggaaaaatattcccaattccaggtaaaagatcagaaacagatatcacctgsawtttgttccaccttcaccccaggcttcagctatacttaggtattactctctggtcccatgaaccatctcatgcctttgactgtgctgcactcagtgcttgaaatgctccgcacaccccgcacacctccctggccctgtgtatcccttctatgggcgcccagagsatttgcttcctcttgctctcaagcatttaccactctgcankgcaattgcttgcttactaatccatctcccacactagattgtgacctccctgagggctcagaaatattaaattcttctctgtatcctcattgcctactcagtgcttggaacacacgacactcaacaa

SEQ ID NO: 564 - DNA, 502 bp, Homo sapiens
  CDS 324..500
  sig_peptide 324..398: score 4.3 seq ALYLSLNLYFANS/LY
  misc_feature 153: m=a or c
  misc_feature 160: r=a or g
  misc_feature 284: n=a, g, c or t
  misc_feature 337: r=a or g
  misc_feature 442: k=g or t
  misc_feature 450: k=g or t
  misc_feature 452: k=g or t
  misc_feature 456: k=g or t
  misc_feature 457: k=g or t
  misc_feature 469: n=a, g, c or t
  misc_feature 470: n=a, g, c or t
  misc_feature 471: d=a or g or t
  misc_feature 472: n=a, g, c or t
  UNSURE -21: Xaa=Lys or Arg
  UNSURE 15: Xaa=Cys or Phe
  UNSURE 18: Xaa=Phe or Leu or Val
  UNSURE 20: Xaa=Cys or Phe or Gly or Val
  UNSURE 24: Xaa=Ile or Lys or Met or Asn or Arg or Ser or Thr
  UNSURE 25: Xaa= *  or Ala or Glu or Gly or Lys or Leu or Met or Arg or Ser or Thr or Val or Trp
gtctaggctcttcaagttaggattcatatctatgacatgtgctgtacagtgcttctactgtgaggtagtctcccagacagaaaccacatgggccttcaggcatagatggtcagtaaataattactttacagtggtgtcatttcttaggagacmcagagtragaccttaagtgagatcttacctacctcctcccatccaatctatccatacaaggttggacctaaagcagccttgagcttaataatgatgtgtgttagaacaaggatactgagattagactaagntggttctttaagtcagccgtctctgacaaagggcacacaatgtactgtctgargtgtgtggagaaaatagcaaaagctctttatctcagccttaatttatattttgcaaattcactttattatatgtgtgtgtgttcatacatatacttttatttatktatttatktktatkktttaataaaaanndngtcttattatgttgcccagactggtctcaa

SEQ ID NO: 565 - DNA, 218 bp, Homo sapiens
  CDS 7..216
  sig_peptide 7..120: score 7.9 seq LPFLSLFWPWAPG/AV
  misc_feature 163: k=g or t
  misc_feature 164: s=g or c
  UNSURE 15: Xaa= *  or Ala or Gly or Ser
aggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacaksagcgccctcagcaagcgttccctggccgcgcgcgggtacgtgcaggacccctac

SEQ ID NO: 566 - DNA, 271 bp, Homo sapiens
  CDS 63..269
  sig_peptide 63..122: score 7.2 seq LALWLGAVGVGVA/EP
  misc_feature 16: s=g or c
  misc_feature 60: d=a or g or t
  misc_feature 125: r=a or g
  misc_feature 132: s=g or c
  misc_feature 133: s=g or c
  misc_feature 153: h=a or c or t
  misc_feature 242: w=a or t
  misc_feature 243: n=a, g, c or t
  UNSURE 4: Xaa=Ala or Gly or Pro or Arg
  UNSURE 11: Xaa=Leu or Met
  UNSURE 41: Xaa=Phe or Ile or Leu or Val
gggctggctcggagasctgaggggcgcacacccgcttcgcagggccagggtgacacggadgcatgcgacggctgctgatccctctggccctgtggctgggtgcggtgggcgtgggcgtcgccgarcctccassggaagcccagcgccggggchtgcaggtggccctggaggaatttcacaagcacccgcccgtgcagtgggccttccaggagaccagtgtggagagcgccgtggacacgccwntcccagctggaatatttgtgaggccggt

SEQ ID NO: 567 - DNA, 295 bp, Homo sapiens
  CDS 60..293
  sig_peptide 60..140: score 3.6 seq RVLAGXSLRRCEA/AG
  misc_feature 45: r=a or g
  misc_feature 46: v=a or c or g
  misc_feature 118: y=c or t
  misc_feature 191: r=a or g
  misc_feature 192: n=a, g, c or t
  misc_feature 194: r=a or g
  misc_feature 233: s=g or c
  misc_feature 234: n=a, g, c or t
  UNSURE -8: Xaa=Leu or Pro
  UNSURE 18: Xaa=Ala or Pro or Ser or Thr
  UNSURE 32: Xaa=Leu or Met or Val
gaggagaccgcaagttgagtggaggaggcggcggtggggccccgrvaccaggtgcctccatggcaggctctgaagagctggggctccgggaagacacgctgagggtcctagctggccyttcccttaggcgttgtgaggctgccgggtctcctgttccaactccacctagaagccctgcccaagaagagccrncrgacttcctgagccgccttcgaagatgtcttccctgctcsntggggcgaggagcagccccctctgagtcccctcggccttgctctctgcccatccgcccctc

SEQ ID NO: 568 - DNA, 369 bp, Homo sapiens
  CDS 139..369
  sig_peptide 139..261: score 9.5 seq LIIFLSFLPFINS/SF
  misc_feature 338: r=a or g
  misc_feature 341: s=g or c
  UNSURE 26: Xaa=Glu or Gly
  UNSURE 27: Xaa=Ser or Thr
caagtgggataggtcctgtgacagaattgtgtgatacaggtcaaacaggagttgggttatggggaaaatgccagttgaaatatgttttgatctttggagaaacctattttttcatttaacctgttctttaaatccagtatgttccagaacatacaaaaatgtttaaatgttccatttgtaagaggatatcatgtattttatatcaatttaaatgcagttatcctaatcatttttctttcatttttaccctttattaactcttcatttgtttacaaaacaaatccactctatgacgcaatctctaattatgtgttttctttcaggtatccaaaccttgraasctttgctctagatgtcaggcttgttttt

SEQ ID NO: 569 - DNA, 269 bp, Homo sapiens
  CDS 46..267
  sig_peptide 46..111: score 10.3 seq FLLLLLLLLLTRW/AP
  misc_feature 150: s=g or c
  misc_feature 192: r=a or g
  UNSURE 13: Xaa=His or Gln
  UNSURE 27: Xaa= *  or Trp
agtccccgggcgcctcctggagagcaaggacgcgggggagcagagatgatccgagccgcgccgccgccgctgttcctgctgctgctgctgctgctgctgctcactagatgggctcctcacagagcaatggccccttcctggtccagccasatggtgtcaccctggagtacaacccctattcttggaatctgrttgccaatgtgttatacctggagtccccagctggggtgggcttctcctactccgatgacaagttttatgcaacttgt

SEQ ID NO: 570 - DNA, 257 bp, Homo sapiens
  CDS 37..255
  sig_peptide 37..168: score 4.8 seq LTFCLVDLSNVDS/GM
caattttggaataagtgtgatgtggtggtgagaagaatgtatattttgttgatttggggtggagagttctgtagatgtctattaggtctgcttggtgcagagctgagttcaattccctggatatccttgttaactttctgtcttgttgatctgtctaatgttgacagtgggatgttaaagtctcccattattattgtgtgggagtctaagtctctttgtaggtctctaaggacttgccttatgaatctgggtgcagt

SEQ ID NO: 571 - DNA, 249 bp, Homo sapiens
  CDS 53..247
  sig_peptide 53..190: score 3.5 seq RWLCLQAYLASFS/LE
  misc_feature 217: k=g or t
cgtgtcctcaggattttcctcttgggctggacagtttgctcccctggagggtatgagcctgactgctagtgggccaagagctgcctgggaggaaagggtggggggtctccacacttggggtgccaacattcctaccgcccctgattcccagcggtggctctgtcttcaggcgtacctggcatccttcagtcttgagagcccccacagaatctacctkgaatctcctcccacgctccttttccccccgcc

SEQ ID NO: 572 - DNA, 350 bp, Homo sapiens
  CDS 194..349
  sig_peptide 194..316: score 9.9 seq ILPFLLFPFPVNA/RS
  misc_feature 327: y=c or t
  UNSURE 4: Xaa=Leu or Ser
tagtgatccttttccttctcccactccgtaagtttctatccttggcctcctattctttttactacatatatactttatatatacatatatacttggaacaggcttaatgagttccaaggtttcaagtataatagaaggatagtttccctaatatttcttcaaaacagatttctcttctgaaatccagagtcatatgtccagttggatgtatcttggataccccattgtcacctcaaacactacttgtctaaaactgatctcatcatcttttccccaaatccttccttttcttctatttcccttcccagtgaatgccagatctcactyagttgctcaaactaaaagcccga

SEQ ID NO: 573 - DNA, 201 bp, Homo sapiens
  CDS 10..201
  sig_peptide 10..132: score 5 seq RLLLILSGCLVYG/TA
gaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagcctc

SEQ ID NO: 574 - DNA, 236 bp, Homo sapiens
  CDS 60..236
  sig_peptide 60..101: score 5.4 seq FLSLSPLYSPCPC/DY
tagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagacgaggg

SEQ ID NO: 575 - DNA, 351 bp, Homo sapiens
  CDS 28..351
  sig_peptide 28..87: score 6.8 seq GLLWMLFVSELRA/AT
  misc_feature 2: v=a or c or g
  misc_feature 343: v=a or c or g
  UNSURE 86: Xaa=Glu or Lys or Gln
avcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtgvaagattct

SEQ ID NO: 576 - DNA, 314 bp, Homo sapiens
  CDS 86..313
  sig_peptide 86..160: score 3.5 seq IFLGKSLFSLLEA/MI
gagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggagggga

SEQ ID NO: 577 - DNA, 407 bp, Homo sapiens
  CDS 17..406
  sig_peptide 17..79: score 5.1 seq PLLLLLPLLNVEP/SG
  misc_feature 159: k=g or t
  misc_feature 349: y=c or t
  UNSURE 27: Xaa=Ile or Arg
acccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggakagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttyttcagtgtgccctgctggttacacaccgatttgatcccaaagcctctagctccttcca

SEQ ID NO: 578 - DNA, 356 bp, Homo sapiens
  CDS 17..355
  sig_peptide 17..70: score 10.4 seq LLQWLLLLLPTLC/GP
  misc_feature 93: m=a or c
  misc_feature 157: r=a or g
  misc_feature 158: m=a or c
  misc_feature 204: w=a or t
  misc_feature 274: b=c or g or t
  UNSURE 8: Xaa=Asn or Thr
  UNSURE 30: Xaa=Lys or Gln
  UNSURE 45: Xaa=Glu or Val
aggctgcagaggtgccatggctgagtcacacctgctgcagtggctgctgctgctgctgcccacgctctgtggcccaggcactgctgcctggamcacctcatccttggcctgtgcccagggccctgagttctggtgccaaagcctggagcaagcattrmagtgcagagccctagggcattgcctacaggaagtctggggacatgwgggagccgatgacctatgccaagagtgtgaggacatcgtccacatccttaacaagatggccaaggaggcbattttccaggacacgatgaggaagttcctggagcaggagtgcaacgtcctccccttgaagctgctcatgccccagtgcacca

SEQ ID NO: 579 - DNA, 314 bp, Homo sapiens
  CDS 111..314
  sig_peptide 111..236: score 7.2 seq ILFSLSFLLVIIT/FP
  misc_feature 277: m=a or c
  misc_feature 289: m=a or c
  UNSURE 14: Xaa=Ala or Glu
  UNSURE 18: Xaa=Ala or Asp
atactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggmgtatgaacgtgmtgttgtattccgtctgggacgacat

SEQ ID NO: 580 - DNA, 369 bp, Homo sapiens
  CDS 147..368
  sig_peptide 147..269: score 3.5 seq QLLGCLQCCWLQS/GR
  misc_feature 336: n=a, g, c or t
  UNSURE 23: Xaa=Cys or Gly or Arg or Ser
ccaattttgtagttatctgatctgaaggaagatgtgtgtggaggtgtttagtgatgttttccgatgacggtgattccccctaaatctacgtattaaatacaatggaacaggatccacagttcacccctaataatatagtttactgaatgttttatgtagctatgaccaaaactcacaaaaggatcagaagcctctgtaacatccaccatggtttgttccagtttactcagcagctcctgggctgtcttcagtgctgttggctgcaatcaggcagagccccagctacctattaccttgtggagagtattgaaaagtcagcacatggctctgtattangtacttatgatcaaactcagactcgcataggca

SEQ ID NO: 581 - DNA, 304 bp, Homo sapiens
  CDS 84..302
  sig_peptide 84..173: score 5.8 seq KLLFVLFLRQCLT/LL
  misc_feature 48: s=g or c
  misc_feature 49: r=a or g
  misc_feature 88: r=a or g
  misc_feature 94: k=g or t
  misc_feature 99: r=a or g
  UNSURE -29: Xaa=Lys or Arg
  UNSURE -27: Xaa=Gly or Val
  UNSURE -25: Xaa=Ala or Thr
cacatgtccaaaaagaaattcttgtttccagattcaataaccccatasraatctgcattcacttccttccccaagctttccctatgarggacgkggtarcatcatctatccaggcacttagacttaacattaagaagttgctctttgttttgtttttgagacagtgtctcactctgttgcccaggctggagtgtagtggcacggtctcggctcactgcaacctctgcctcctgggttcaagcaattctcctgcctcagcctcccaagtagctggattactgtcatgtgccactttgcccggctg

SEQ ID NO: 582 - DNA, 271 bp, Homo sapiens
  CDS 35..271
  sig_peptide 35..82: score 14.8 seq SLPLLLLLLGAWA/IP
acagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcacctgccctgctcacaccccttctcaagccagcccccacc

SEQ ID NO: 583 - DNA, 290 bp, Homo sapiens
  CDS 128..289
  sig_peptide 128..274: score 8.5 seq IVFLLLRVSPCLG/PS
  misc_feature 156: s=g or c
  misc_feature 283: b=c or g or t
  UNSURE -40: Xaa=Cys or Ser
  UNSURE 3: Xaa=His or Gln
agatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtsttcagaattacataagatgaaatccctttcattgcaacttgcaagtgagaaaagatccttagtggctctggtggaagaaatagtatttcttcttctcagggtgtctccctgccttggcccctcccabaagcccc

SEQ ID NO: 584 - DNA, 317 bp, Homo sapiens
  CDS 160..315
  sig_peptide 160..228: score 3.7 seq TNLLCLTFQRCQS/YN
  misc_feature 291: m=a or c
  UNSURE 21: Xaa=Lys or Asn
tacatcagaaaccagaggcggaaaactttccacggtgatatgcataaacaaatatttcatattttttacagaaagtctggctattgcctatagaaagacaaaaactggtaacagccttattccagctaaatttgaatgccaggttgacactaatcatggatgctttcccagagctttcagaaaaacaaaaccaacctgttgtgtttaactttccaaagatgtcagagttacaattggctgaatatttttgaagctacatatatgacgactctcttcatttcagtaattaamacaaattttttaaaaagatacctcct

SEQ ID NO: 585 - DNA, 252 bp, Homo sapiens
  CDS 45..251
  sig_peptide 45..89: score 3.6 seq VVEASSSVRLASS/EV
  misc_feature 42: w=a or t
gcagctgtttcggtaactgctttgcctcccggctcccgcagwggatgctggtggtggaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcc

SEQ ID NO: 586 - DNA, 196 bp, Homo sapiens
  CDS 31..195
  sig_peptide 31..135: score 5.4 seq LVVVCYLSWRVSS/RS
tactcaaaatctacatttcagttagttgatatgcctcttaagaatctgttctctgttggtctgtgggatccttacaatttactgaagaaacatgttttggttgttgtctgctatttatcctggagagtgtcttccagaagttggactttgctgattacacctgtaacacttcatgcttctctgtccacccaggccc

SEQ ID NO: 587 - DNA, 276 bp, Homo sapiens
  CDS 56..274
  sig_peptide 56..127: score 5.3 seq LFHLLFLPHYIET/FK
catttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttatgtgcacttcgatcccagcattttccatcgacttgtaattgtttctgctacct

SEQ ID NO: 588 - DNA, 273 bp, Homo sapiens
  CDS 106..273
  sig_peptide 106..156: score 3.8 seq TVLSGCASRGTTG/LP
gaaattcagacgtttgcatcctttctggcctaaaaatcaagtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaac

SEQ ID NO: 589 - DNA, 197 bp, Homo sapiens
  CDS 19..195
  sig_peptide 19..96: score 8.7 seq LLLLDVPTAAVQA/SP
  misc_feature 99: m=a or c
acctttgcccctgctgcgatgaccctgtcgccacttctgctgttcctgccaccgctgctgctgctgctggacgtccccacggcggcggtgcaggcgtcmcctctgcaagcgttagacttctttgggaatgggccaccagttaactacaagacaggcaatctatacctgcgggggcccctgaagaagtccaatgcaca

SEQ ID NO: 590 - DNA, 291 bp, Homo sapiens
  CDS 20..289
  sig_peptide 20..70: score 5.5 seq LHLPALSSSCLWT/FP
cctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgccc

SEQ ID NO: 591 - DNA, 328 bp, Homo sapiens
  CDS 114..326
  sig_peptide 114..236: score 3.9 seq CRCLITLPRSCRP/ST
  misc_feature 22: y=c or t
  misc_feature 79: k=g or t
  misc_feature 80: k=g or t
  misc_feature 93: s=g or c
  misc_feature 255: r=a or g
  misc_feature 285: s=g or c
  misc_feature 286: s=g or c
  misc_feature 300: m=a or c
  UNSURE 7: Xaa=Ala or Thr
  UNSURE 17: Xaa=Ala or Gly or Pro or Arg
tttgacgtgtctgtttcatgtytcctttgagtaaaacctaatctttctcaatagagaagtttattcttgaagtatgtgkkctcagttcattcscctgagtgacacaagctcccatgcttgggccacccttgcagcccggaagccatgggaaggtcctcgcccctcagggcagtagtggcctgacaccccccttcccgtgcaggtgtctgataactctgccgcggtcgtgccggcccagtacatctgtgccccggrcagcaagcacacgttcctcgcagcgcccgsscagctcctgctggmgaagttcctgcagcaccacagccaccat

SEQ ID NO: 592 - DNA, 218 bp, Homo sapiens
  CDS 2..217
  sig_peptide 2..85: score 8 seq IVFCFVFLRQSLA/LS
  misc_feature 123: s=g or c
  misc_feature 136: y=c or t
  misc_feature 138: s=g or c
  misc_feature 141: y=c or t
  misc_feature 145: s=g or c
  UNSURE 13: Xaa=Ala or Gly
  UNSURE 18: Xaa=Pro or Arg
  UNSURE 19: Xaa=Leu or Pro
tatgattcgtttttctttgatttggaagcttatgatagattttataatcgttttttgttttgtttttttgagacagagtcttgctctgtcacccaggctggagtgcagtggcgcgatctcagstcacagcaacctycsgcytccsgctttcaagcaattctcctgcctcagcctcctgagtagctgggactgcaggtgccccaccatgcccgactgtt

SEQ ID NO: 593 - DNA, 224 bp, Homo sapiens
  CDS 32..223
  sig_peptide 32..76: score 6.7 seq LFVLFLFLFFSFL/FF
  misc_feature 85: r=a or g
  misc_feature 86: r=a or g
  misc_feature 91: r=a or g
  misc_feature 193: w=a or t
  UNSURE 3: Xaa= *  or Trp
  UNSURE 4: Xaa=Glu or Lys
tgcccagcctagattttttgcccatttttaaatgagattatttgtcttatttctttttcttttcttttcttttctttttttttgrraaggragtctcgctctgttgcccaggctggagtgcagtggcatgatcttggctcactgcaagctccacctcccaggttcacgccattctcctgcctcagcctcccgwgtagctgcgactataggcacccgccaccaca

SEQ ID NO: 594 - DNA, 241 bp, Homo sapiens
  CDS 70..240
  sig_peptide 70..129: score 4.4 seq LHLLGSSDSXCXS/LP
  misc_feature 118: y=c or t
  misc_feature 124: y=c or t
  misc_feature 125: y=c or t
  misc_feature 126: m=a or c
  UNSURE -4: Xaa=Pro or Ser
  UNSURE -2: Xaa=Phe or Leu or Pro or Ser
aatataggtgcaattttatataattgaaattaatattcgctcttgttgcccaggctggagtgcaatggcatgatctcggctcaccacaacctccaccttctgggttcaagtgattctycttgcyymagcctcccaagtagctgggattacagccatgcgccgtcacgcccggctaattttgtatttttagtagagacggggtttctctatgttggtcaggctggtctcgaactcccgacca

SEQ ID NO: 595 - DNA, 233 bp, Homo sapiens
  CDS 51..233
  sig_peptide 51..131: score 5.9 seq ITLFICFFETGSC/SV
cccagaattcctgtatgttcaaaactatcgtttgtagcctttgtgtgtgaatgatggcttggcttgttttaaaacaaaaaaatcgctggctcataactttattcatttgtttttttgagacagggtcttgctctgttgctcaggctggagtgcagtggcatgatcacagctcactgcggcttccaccctggggctcaagctatcctcccaccttagcctcccaacaggtgcgc

SEQ ID NO: 596 - DNA, 314 bp, Homo sapiens
  CDS 159..314
  sig_peptide 159..215: score 7 seq STVVLQVLTQATS/QD
  misc_feature 8: r=a or g
  misc_feature 69: k=g or t
  misc_feature 84: m=a or c
  misc_feature 123: n=a, g, c or t
  misc_feature 124: r=a or g
  misc_feature 278: w=a or t
gacgccaracatggcgtgttcctagaagccgctttcggcatcagtaggcggcggcgtggggtctggcakcgtggggagagggamcaaccgacgccacttcgtgttgggaagtgggagcggganrgccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggwttctattcagtgttgctgaatattttcaccaaccac

SEQ ID NO: 597 - DNA, 325 bp, Homo sapiens
  CDS 133..324
  sig_peptide 133..189: score 7.9 seq LLLALLLPGGDNA/DA
  misc_feature 18: k=g or t
  misc_feature 286: k=g or t
  UNSURE 33: Xaa= *  or Glu
agttgctgtcagcggctkatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggaakagttgcagactcatggctgggacagtgaatcagacactg

SEQ ID NO: 598 - DNA, 232 bp, Homo sapiens
  CDS 50..232
  sig_peptide 50..97: score 3.5 seq LQALLVVALHSHP/AE
  misc_feature 11: k=g or t
gtactcggcakcgcgggaataaagtttgctgatttggtgtctagcctggatgcctgggttgcaggccctgcttgtggtggcgctccacagtcatccggctgaagaagacctgttggactggatcttctcgggacggagtctcactctgtcgcccaggctggagtgcagtggcacaatctcggctcactgcaagctccgcctcccagatattgttttgtatttacccatgcgt

SEQ ID NO: 599 - DNA, 394 bp, Homo sapiens
  CDS 122..394
  sig_peptide 122..268: score 6.4 seq AVSFAPLIQPCHS/ES
  misc_feature 220: d=a or g or t
  misc_feature 316: n=a, g, c or t
  UNSURE -17: Xaa=Lys or Asn
caagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaadaagattcttgctgtttcttttgctcctctgatccagccctgccattcagagtcaggaaaatcaagacttgtccagttaccaccagtggcagttcgnagcctccaggacttggctcgcatcgccatccggggcaccattaaaaagattattcatcaggaaactgtgagcaaaaac

SEQ ID NO: 600 - DNA, 232 bp, Homo sapiens
  CDS 64..231
  sig_peptide 64..171: score 4.6 seq TLLLWCFSALLPT/IV
atcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacct

SEQ ID NO: 601 - DNA, 278 bp, Homo sapiens
  CDS 56..277
  sig_peptide 56..184: score 3.5 seq QHWLLGGFPRTLG/QA
aggatccgggctggaagcctctcggagtgctgcctccagccaagaagttggtgagatggcaaagcagtatatagagaaaagtcttttggttccagaccatgtgatcacacgcctaatgatgtccgagttggagaacaggcgtggccagcactggctccttggtggttttcctaggacattaggacaagccgaagccctggacaaaatctgtgaagtggatctagtgatcagtttgaatattccatttgaaacacttaaagatcgtctcagccgccaga

SEQ ID NO: 602 - DNA, 206 bp, Homo sapiens
  CDS 9..206
  sig_peptide 9..143: score 3.6 seq ALLELIDSPECLS/KC
  misc_feature 45: r=a or g
  misc_feature 205: k=g or t
  misc_feature 206: v=a or c or g
  UNSURE -33: Xaa=Met or Val
  UNSURE 21: Xaa=Gly or Val
ctgggaagatggcgctgcacttccagagtttggctgaattggaartgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaaccgkv

SEQ ID NO: 603 - DNA, 205 bp, Homo sapiens
  CDS 24..203
  sig_peptide 24..110: score 7.6 seq PTLAIALAANAWA/FV
ccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccgggactt

SEQ ID NO: 604 - DNA, 319 bp, Homo sapiens
  CDS 150..317
  sig_peptide 150..278: score 6.1 seq SAATLASLGGTSS/RR
  misc_feature 90: w=a or t
actctcgtgccaagcatgtctctccaaatggctgctctctggcgttcctcacactccccctgaagttcatctaagatcttcattcttcawaggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgaccccga

SEQ ID NO: 605 - DNA, 284 bp, Homo sapiens
  CDS 65..283
  sig_peptide 65..172: score 5.3 seq ALYIMCVPHSVWG/CA
  misc_feature 90: r=a or g
  UNSURE -28: Xaa=Asn or Ser
agtccagaggcctggccctgccaagaaggcgctctccggaatcaacacctgggggcttggaaggatgtttcgctcagatcgaatgtggarctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagacccca

SEQ ID NO: 606 - DNA, 383 bp, Homo sapiens
  CDS 5..382
  sig_peptide 5..94: score 10.6 seq GLLCCAALSLLWA/GP
ttcaatgcacagatacagaagacccctccgtcatgcagcatctgccatgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagca

SEQ ID NO: 607 - DNA, 392 bp, Homo sapiens
  CDS 3..392
  sig_peptide 3..146: score 5.7 seq LLLFFGKLLVVGG/VG
  misc_feature 241: y=c or t
  misc_feature 278: y=c or t
  UNSURE 32: Xaa=Ile or Thr
tcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccaycatgacctccatcctgggggcctatgtcatcgccagyggcttcttcagcgttttcggcatgtgtgtggacacgctcttcctctgcttcctggaagacctggagcggacaacggctccctggacggccctactacatgtccaagagcttcta

SEQ ID NO: 608 - DNA, 245 bp, Homo sapiens
  CDS 18..245
  sig_peptide 18..86: score 6.2 seq PLPLLLLLQPGLP/LF
  misc_feature 33: w=a or t
  misc_feature 123: m=a or c
  misc_feature 129: w=a or t
  misc_feature 131: s=g or c
  misc_feature 132: m=a or c
  misc_feature 135: m=a or c
  UNSURE -18: Xaa=Phe or Ile
  UNSURE 13: Xaa=Ile or Leu
  UNSURE 15: Xaa= *  or Lys or Asn or Tyr
  UNSURE 16: Xaa=Lys or Gln
  UNSURE 17: Xaa=Pro or Thr
atctatatatagtactaatggatttggtgtgcwtcccccttagcgtccccctccctctgctcctcctccttcagcctggtctccccctcttctctgccctccacccccgtctctgcactgagmtacatwasmaamcaagggtagtttactgtctgttttgttttctgggttttcagtgtcctagcggaatgcaagtaggcagccagcccgtctgttccctctccgccccaccccgccccgcgccc

SEQ ID NO: 609 - DNA, 336 bp, Homo sapiens
  CDS 100..336
  sig_peptide 100..156: score 9.9 seq ILFLVFLLAGLRS/KA
  misc_feature 95: r=a or g
  misc_feature 99: w=a or t
ccagatctgttctgcaacattcaccgttctctgcatccagctctgcttatctgctgttaccttggacaccagagcagctataggtatctgccagragcwatgaaatcattcagccggatcctcttcctcgtcttcctcctcgccggcctgaggtccaaggccgctccctcagcccctctgcctttgggctgtggctttccggacatggcccacccctctgagacttcccctctgaagggtgcttctgaaaattccaaacgagatcgccttaacccagaatttcctgggactccttaccctgagccttccaagctacctcatacggtttccctggaa

SEQ ID NO: 610 - DNA, 373 bp, Homo sapiens
  CDS 109..372
  sig_peptide 109..153: score 7.5 seq AVLLALLMAGLAL/QP
  misc_feature 71: n=a, g, c or t
  misc_feature 72: n=a, g, c or t
  misc_feature 188: r=a or g
  misc_feature 189: r=a or g
  misc_feature 199: r=a or g
  misc_feature 325: s=g or c
  UNSURE 12: Xaa=Lys or Arg
  UNSURE 16: Xaa=Gly or Ser
  UNSURE 58: Xaa=Asp or His
actggctccaggaaacccgctggtgttgactgtgggcagtccagcctctccccatttgaggccatataaannacctgaggccctctccaccacagcccaccagtgaccatgaaggctgtgctgcttgccctgttgatggcaggcttggccctgcagccaggcactgccctgctgtgctactcctggarrgcccaggtgrgcaacgaggactgcctgcaggtggagaactgcacccagctgggggagcagtgctggaccgcgcgcatccgcgcagttggcctcctgaccgtcatcagcaaaggctgcagcttgaactgcgtggatsactcacaggactactacgtgggcaagaagaacatcacgtgctgtgaca

SEQ ID NO: 611 - DNA, 459 bp, Homo sapiens
  CDS 74..457
  sig_peptide 74..157: score 9.5 seq LVXFSLLATAILG/AV
  misc_feature 126: y=c or t
  UNSURE -11: Xaa=Phe or Ser
ccataccaaattaaatgactgccataaagtatattttactcacaggacagattacaatagccttgatagaatcatggcatccaaagggatgcgccatttttgcttgatttcagagcagttggtgtyctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggact

SEQ ID NO: 612 - DNA, 213 bp, Homo sapiens
  CDS 35..211
  sig_peptide 35..166: score 3.7 seq LAERLGLFEELWA/AQ
ctgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccagac

SEQ ID NO: 613 - DNA, 334 bp, Homo sapiens
  CDS 136..333
  sig_peptide 136..222: score 13 seq LLLVLLLVTRXRS/MP
  misc_feature 71: s=g or c
  misc_feature 72: n=a, g, c or t
  misc_feature 113: k=g or t
  misc_feature 215: s=g or c
  misc_feature 274: b=c or g or t
  UNSURE -3: Xaa=Ser or Thr
  UNSURE 18: Xaa=Leu or Val
atttgtgcggcgctggtcccctcagagggttcctgctgctgccggtgccttggaccctccccctcgcttcsngttctactgccccaggagcccggcgggtccgggactcccgkccgtgccggtgcgggcgccggcatgtggctgtgggaggaccagggcggcctcctgggccctttctccttcctgctgctagtgctgctgctggtgacgcggasccggtcaatgcctgcctcctcaccggcagcctcttcgttctactgcgcgtcttcagctbtgagccggtgccctcttgcagggccctgcaggtgctcaagccccgggaccgcatttctgc

SEQ ID NO: 614 - DNA, 307 bp, Homo sapiens
  CDS 43..306
  sig_peptide 43..186: score 5.4 seq ILLEVFVWNGLQG/LP
  misc_feature 2: s=g or c
  misc_feature 46: k=g or t
  UNSURE -47: Xaa=Phe or Val
asttcttcctgccaagagaacaatgccgagaaacagagcgaaatgkttccaaataatttttggcaaaaacttggaagaaaaaaaccccgcatatttacctgtacccagagctccacaggtgaggcggcagttaaagcagaaaatctaattcttctggaagtttttgtctggaacggactccagggtcttccttcggagctgtcagatacaagtggatcctctaagaaacttgggagccttgtgggctggtggagaactctcaagatggcaccagcctgtctatggtctatgtgggaatcaccgccac

SEQ ID NO: 615 - DNA, 344 bp, Homo sapiens
  CDS 133..342
  sig_peptide 133..246: score 3.6 seq LSWLITWFGHXLS/DF
  misc_feature 96: v=a or c or g
  misc_feature 103: r=a or g
  misc_feature 113: m=a or c
  misc_feature 239: w=a or t
  misc_feature 240: m=a or c
  misc_feature 285: r=a or g
  UNSURE -3: Xaa=Asp or Glu or Val
ttgtggtcacatttctgctggtggtaggcgagaggctggcaacatccctggtagaaaaattatctacccaccacctcagggattttatggatccavcaatggracaacaccamgcatatattaaactatctgatgcccatcattgaccaggtgaatccagagctccatgacttcatgcagagtgctgaggtagggaccatctttgccctcagctggctcatcacctggtttgggcatgwmctgtctgacttcaggcacgtcgtgcggttatatgacttcttcctrgcctgccacccactgatgccgatttactttgcagccgtgattgtgttgtatcgcgagca

SEQ ID NO: 616 - DNA, 390 bp, Homo sapiens
  CDS 83..388
  sig_peptide 83..142: score 3.9 seq FLAPSSGVQPTLA/MP
cactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattctta

SEQ ID NO: 617 - DNA, 233 bp, Homo sapiens
  CDS 46..231
  sig_peptide 46..180: score 3.9 seq SLLTESSASRVHA/IX
  misc_feature 96: r=a or g
  misc_feature 127: k=g or t
  misc_feature 129: s=g or c
  misc_feature 137: y=c or t
  misc_feature 185: y=c or t
  misc_feature 207: s=g or c
  misc_feature 230: k=g or t
  UNSURE -18: Xaa=Phe or Leu or Val
  UNSURE -15: Xaa=Leu or Pro
  UNSURE 2: Xaa=Leu or Pro
  UNSURE 9: Xaa= *  or Tyr
  UNSURE 17: Xaa=Ile or Ser
gatttattcctacattttctgttttctaatttgaccctaaaatctatgtgttttagacttagactttttattgccccccccccctttttttttgaracggagtctcgctctgacgcacaggctggaktscagtggcyccgatctctgctcactgaaagctccgcctcccgggttcatgccattcycctgcctcagcctcctgagtasctgggactacaggcgcccaccaktgc

SEQ ID NO: 618 - DNA, 260 bp, Homo sapiens
  CDS 103..258
  sig_peptide 103..156: score 7.2 seq LFFLLRIALASWA/LF
gggttatctaacctgttccattgttccgtgtatcagtttctgtaccgataccatgctgttttggttactgtagtcttgtagtatagtttaaagtcagatagcatgatgactctagctttgttctttttgcttaggattgctttggctagttgggctctcttttggatccatatgaattttagaagagcttttttccacttacggtggtttgatatcaatagcactgaatctgtaaattgctttgggcagtatggcctagc

SEQ ID NO: 619 - DNA, 326 bp, Homo sapiens
  CDS 72..326
  sig_peptide 72..206: score 6.7 seq PMLGLAAFRWIWS/RE
  misc_feature 311: m=a or c
  UNSURE 35: Xaa=Asp or Glu
aaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagamaatcggcgtgctgtc

SEQ ID NO: 620 - DNA, 316 bp, Homo sapiens
  CDS 62..316
  sig_peptide 62..121: score 9.6 seq LLALLLCGRPGRG/QT
  misc_feature 91: b=c or g or t
  misc_feature 264: n=a, g, c or t
  misc_feature 265: k=g or t
  misc_feature 266: n=a, g, c or t
  UNSURE 48: Xaa= *  or Cys or Phe or Leu or Ser or Trp or Tyr
  UNSURE 49: Xaa= *  or Glu or Lys or Gln
accgcagctccagagccctgcgggaggactcagagtcagggacacagcagcgtccggcgagatgaaggcgctcggggctgtcctgcttgcbctcttgctgtgcgggcggccagggagagggcagacacagcaggaggaagaggaagaggacgaggaccacgggccagatgactacgacgaggaagatgaggatgaggttgaagaggaggagaccaacaggctccctggtggcaggagcagagtgctgctgcggtgctacacctnknagtccctgcccagggacgagcgctgcaacctgacgcagaactgctcacat

SEQ ID NO: 621 - DNA, 308 bp, Homo sapiens
  CDS 67..306
  sig_peptide 67..123: score 7.2 seq VSIMLLLVTVSDC/AV
aaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaagatccccttcttcaggaaacgcaagcaccacacctgtccttgctt

SEQ ID NO: 622 - DNA, 408 bp, Homo sapiens
  CDS 93..407
  sig_peptide 93..152: score 10 seq SLLLXLLVASGDA/DM
  misc_feature 126: m=a or c
  misc_feature 180: d=a or g or t
  misc_feature 181: v=a or c or g
  misc_feature 270: m=a or c
  misc_feature 271: r=a or g
  misc_feature 272: m=a or c
  misc_feature 304: n=a, g, c or t
  misc_feature 305: n=a, g, c or t
  misc_feature 315: m=a or c
  misc_feature 323: n=a, g, c or t
  misc_feature 333: n=a, g, c or t
  misc_feature 334: d=a or g or t
  misc_feature 335: n=a, g, c or t
  UNSURE -9: Xaa=Leu or Met
  UNSURE 10: Xaa= *  or Ala or Glu or Gly or Lys or Arg or Ser or Thr or Trp
  UNSURE 40: Xaa=His or Lys or Asn or Gln or Arg or Ser
  UNSURE 51: Xaa=Ala or Asp or Glu or Gly or Val
  UNSURE 55: Xaa=Pro or Thr
  UNSURE 61: Xaa= *  or Cys or Asp or Glu or Phe or Gly or His or Ile or Lys or Leu or Met or Asn or Gln or Arg or Ser or Val or Trp or Tyr
aatccagcgtctcctgggcctagattccccagctgctgttctctggagggagatgctgcccccacccccttaggcccgagggatcaggagctatgggaccagaggccctgtcatctttactgctgmtgctcttggtggcaagtggagatgctgacatgaagggacattttgatcctgccdvgtgccgctatgccctgggcatgcaggaccggaccatcccagacagtgacatctctgcttccagctcctggtcagattccactgccgccmrmcacagcaggttggagagcagtgacggggatgnngcctggtgcmcgcaggtncggtgtttcndnggaggaggagtacttgcaggtggatctacaacgactgcacctggtggctctggtgggcacccagggacggcat

SEQ ID NO: 623 - DNA, 349 bp, Homo sapiens
  CDS 146..349
  sig_peptide 146..223: score 10 seq FFLMLLAMGLSSA/IG
gcctaacggtatcgagcgagccggttgtagacgtggtccaggtttctgcacaggaatatcgagagcgtcatgaacccgagctatagagaaaggagatgaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcga

SEQ ID NO: 624 - DNA, 379 bp, Homo sapiens
  CDS 188..379
  sig_peptide 188..229: score 3.7 seq VLLARCEGHCSQA/SR
  misc_feature 254: n=a, g, c or t
  misc_feature 255: s=g or c
  UNSURE 9: Xaa=Ala or Cys or Gly or Pro or Arg or Ser or Thr
cctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagatggtgctcctggccaggtgcgaggggcactgcagccaggcgtcacgctccgagcctttggtgtcgnscagcactgtcctcaagcaacccttccgttcctcctgtcactgctgccggccccagacttccaagctgaaggcactgcggctgcgatgctcagggggcatgcgactcactgccacctaccggtac

SEQ ID NO: 625 - DNA, 402 bp, Homo sapiens
  CDS 128..400
  sig_peptide 128..190: score 9.6 seq CLAFLCFLMHARG/QR
  misc_feature 321: k=g or t
  misc_feature 322: y=c or t
  misc_feature 383: w=a or t
  UNSURE 44: Xaa=Ile or Ser
  UNSURE 65: Xaa=Ser or Thr
gaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatakytacccaaggccaaagccacgccctcaaccccagcctggcaattccggcaacagtggaggtwcttcaatgatgtggaccgt

SEQ ID NO: 626 - DNA, 380 bp, Homo sapiens
  CDS 12..380
  sig_peptide 12..137: score 5.2 seq ILSILMGASAITG/IM
  misc_feature 296: d=a or g or t
  misc_feature 353: n=a, g, c or t
  misc_feature 365: b=c or g or t
  UNSURE 53: Xaa=Asp or Glu
  UNSURE 72: Xaa=Asp or Glu
  UNSURE 76: Xaa=Asp or Glu
ttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgadgatatccgatcaaggttcattcaaggagagtcaattacacctaccaagatacctganattacaactgabatatacatgtctaat

SEQ ID NO: 627 - DNA, 370 bp, Homo sapiens
  CDS 182..370
  sig_peptide 182..259: score 5.7 seq AGLALGMLCLGHG/SN
  misc_feature 312: w=a or t
  UNSURE 18: Xaa=Phe or Tyr
tactcggcttcttagcattcacattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagagagtcatactccttagctgctggcttggccctgggcatgctctgcttggggcatggcagcaatttgataggtatgtctgatctcaatgtgcctgagcagctctatcagtwcatggttggaggacataggcgctttcaaacaggaatgcatagggagaaacataaatca

SEQ ID NO: 628 - DNA, 347 bp, Homo sapiens
  CDS 24..347
  sig_peptide 24..71: score 8.5 seq ALLLLATLAVATG/PA
actgctcccagacgacatcagagatgaggacagcattgctgctccttgcaaccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccaa

SEQ ID NO: 629 - DNA, 288 bp, Homo sapiens
  CDS 133..288
  sig_peptide 133..273: score 5.9 seq TWLGLLSFQNLHC/FP
  misc_feature 127: v=a or c or g
tcattttcttatccctgctgatttcaaaccttcccatggtttagaagcataacctgtaatgtaatgcaagtcccctaactccctggttgctaacattaacttccttaagtaataatcaatgaaagavattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctcccc

SEQ ID NO: 630 - DNA, 227 bp, Homo sapiens
  CDS 31..225
  sig_peptide 31..126: score 5.4 seq SVFTLTLQAGLSA/IK
aaggaccttctggaccctgcacggtggcggatgctgatccagcagttccggtacgacaactaccgactacaccagctgggaaacaattctgtgttcaccctcaccctgcaggccggcctctcagccatcaagacaccacagtgctacaaggaggacggcagctccaagagccctgactgccctgtgtgcagccgctccctgaacaagctggcgcacccctgcccata

SEQ ID NO: 631 - DNA, 372 bp, Homo sapiens
  CDS 183..371
  sig_peptide 183..287: score 3.6 seq ITSVLLLFPRAGE/FP
accagagccccgtgggctggaacgcgccggaatctgaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccacct

SEQ ID NO: 632 - DNA, 300 bp, Homo sapiens
  CDS 12..299
  sig_peptide 12..74: score 5.8 seq SLLFFLLLEGGKT/EQ
aaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagagt

SEQ ID NO: 633 - DNA, 268 bp, Homo sapiens
  CDS 78..266
  sig_peptide 78..206: score 7 seq PWFLAPWCPGTQS/NR
  misc_feature 91: m=a or c
  UNSURE -39: Xaa=Asn or Thr
cccttcgttctggttctggttctagttctggttctaacaactcacaatccctttagctttctctcccctccctttgaatgagagaaactamcccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctt

SEQ ID NO: 634 - DNA, 381 bp, Homo sapiens
  CDS 99..380
  sig_peptide 99..236: score 7.8 seq LLYLSFAALGVVA/LR
ttttacacacacacatacatacacacacacagctaattgagttttaaagtaatattcttgctaatccctactgaattgtagcttggtgttgtttctgaatggtttttggatattggaagcagccgctgattacccttgcaaagaaatctgtaaaatgtgcacgtgaatgtctgagatgctctctcaggcctctagtccttctgtatctttcctttgcagccctgggtgtagtagcactcaggagtgttgaatcacccctggccgagacccactcctgctggctcagcctgggcatgtgtgtgctccagtgtgaacagcagtgggttccaaccccagtctcctttctctgtggcctctctggctccagcaccatcatcgtta

SEQ ID NO: 635 - DNA, 254 bp, Homo sapiens
  CDS 49..252
  sig_peptide 49..114: score 5.9 seq LLILWFHLDCVSS/IL
attttggctgcaaaacgtttttctgctgtgggtacgtgagcaggaaacatggagaagaatcctttggcagccccattactaatcctctggtttcatcttgactgcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccgt

SEQ ID NO: 636 - DNA, 297 bp, Homo sapiens
  CDS 22..297
  sig_peptide 22..75: score 5 seq SLSVFGSLPASLG/TW
  misc_feature 291: h=a or c or t
  misc_feature 294: s=g or c
  UNSURE 72: Xaa= *  or Tyr
agtgaggcttggaaaggcgtcatggacagacctgggtcgctttctgtcttcgggtccctcccggcttcgctcgggacctggctctcaagcccagcttggctggtggacagaccggtgcgctctgcacacccgagtgcgaattccaccggcgtgagaatgagcgtgctcgtggtcctggccctgaggtccctgggtcgcagctgttccctctcccaggctgccccctccaggtggacgcggtcaaacgatgccccgcagcctcctgggtctcagcacatattccacacctahgtsccc

SEQ ID NO: 637 - DNA, 280 bp, Homo sapiens
  CDS 72..278
  sig_peptide 72..158: score 4.4 seq IVLHLVLQGMVYT/EY
gctttaaaggcctggccaggggaggagcacagatattttcctgtataattccagaatgtcttcagagagccatgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaa

SEQ ID NO: 638 - DNA, 403 bp, Homo sapiens
  CDS 243..401
  sig_peptide 243..380: score 5.2 seq LLTFLVFTXKLSS/LN
  misc_feature 86: k=g or t
  misc_feature 118: w=a or t
  misc_feature 120: w=a or t
  misc_feature 121: k=g or t
  misc_feature 147: r=a or g
  misc_feature 293: r=a or g
  misc_feature 295: r=a or g
  misc_feature 367: r=a or g
  misc_feature 390: r=a or g
  UNSURE -30: Xaa=Ile or Met
  UNSURE -29: Xaa=Lys or Arg
  UNSURE -5: Xaa=Glu or Gly
  UNSURE 4: Xaa=Gly or Arg
cactgaaatcaatctgttcaatagcattataccatatttgacataccatagccatgttaatctgatattgtagaatagcatagtakaataataataactcctaactcaaggatgttgwgwkcctttataaccagcaatccatgttaratattagcacagtgcctaaaacatattaagcattcaataaatgatcgctactatttttactaacatcctacagatttggaaattgagtcttagaaatgttaatgtgtaaaatgctaaagagccaaaaaaactgccaggaaaatatraraattaaaatcattttatttctgaaacccatgtgttccccccaatatcttctaacatttctagtatttacagraaaactttcaagtctcaatatcrgaaagtttcataa

SEQ ID NO: 639 - DNA, 255 bp, Homo sapiens
  CDS 51..254
  sig_peptide 51..89: score 4.2 seq MTDLLSASPWALT/IV
  misc_feature 164: k=g or t
  misc_feature 254: y=c or t
  misc_feature 255: h=a or c or t
ccaagtttgagcacctggaaagggtttatgctgacatcccctttctgttgatgacggacctcttaagtgcctcaccctgggccctcactattgtttccagtgagctccaccttgctccatccatgaccacagtggaccagctcgagtctcaagtggacaatgtkatcttacagactggagagagtgctagtgaatgcttttgtcttcaatgcccatctcttggaaatattgaaggtggagtagcaaccgggcayh

SEQ ID NO: 640 - DNA, 325 bp, Homo sapiens
  CDS 2..325
  sig_peptide 2..127: score 5.5 seq ILGLLFYCFFLCC/FP
  misc_feature 219: h=a or c or t
  misc_feature 251: h=a or c or t
  UNSURE 31: Xaa=Ile or Asn or Thr
  UNSURE 42: Xaa=Leu or Met
tatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttahtgcctttcctttgtttccttgtaaaggcacchtgttctgttatggtttttcattatataaaattattatatcttatatgacatatgctaaaatttcttggagagtg

SEQ ID NO: 641 - DNA, 352 bp, Homo sapiens
  CDS 50..352
  sig_peptide 50..136: score 5.7 seq FIYYLFFLRWSLS/LS
  misc_feature 281: k=g or t
  misc_feature 283: w=a or t
  misc_feature 314: w=a or t
  misc_feature 346: r=a or g
  UNSURE 49: Xaa= *  or Cys or Gly
  UNSURE 60: Xaa= *  or Lys
acagttttgtgaaatccacgatgtatacaatgagaaaagtaatccttgtatgttaataattgacccacaaacttcaactttttgtcttttttatttatttatttattatttattttttttgagatggagtctctctttgtcgcccaggctggagtgcagtggcacaatcttggctcactgcaagctctgcctcccgagttcacaccattctcctacctcagcctcccaagtggctgggactacaggcgcccgccaccacgcctggctaatttttttttttkgwatttttagtagagacagggtttcaccgtgtwagccaggatggtctcgatgtcctgacctcgtratcccc

SEQ ID NO: 642 - DNA, 267 bp, Homo sapiens
  CDS 14..265
  sig_peptide 14..136: score 5.6 seq LFLFLTSIAEXCS/TP
  misc_feature 7: k=g or t
  misc_feature 11: k=g or t
  misc_feature 20: d=a or g or t
  misc_feature 59: k=g or t
  misc_feature 60: k=g or t
  misc_feature 61: y=c or t
  misc_feature 91: k=g or t
  misc_feature 129: r=a or g
  misc_feature 160: k=g or t
  UNSURE -39: Xaa=Phe or Ile or Val
  UNSURE -26: Xaa=Cys or Phe or Gly or Val
  UNSURE -16: Xaa=Asp or Glu
  UNSURE -3: Xaa=Cys or Tyr
  UNSURE 8: Xaa=Phe or Leu
ccctgtkcttktcatggttdtctggctcgtcttatttgctcttcagatttactcctatkkyagtactcgagatcagcctgcatcacgtgakaggcttcttttcctttttctgacaagtattgcggaatrctgcagcactccttactctcttttgggtttkgtcttcacggtttcttttgttgccttgggtgttctcacactctgcaagttttacttgcagggttatcgagctttcatgaatgatcctgccatgaatcggggaggtgc

SEQ ID NO: 643 - DNA, 241 bp, Homo sapiens
  CDS 65..241
  sig_peptide 65..148: score 6.1 seq LYLFSGFWTFXLG/KF
  misc_feature 8: r=a or g
  misc_feature 77: r=a or g
  misc_feature 88: n=a, g, c or t
  misc_feature 96: r=a or g
  misc_feature 140: k=g or t
  misc_feature 169: r=a or g
  misc_feature 178: k=g or t
  misc_feature 179: k=g or t
  misc_feature 216: w=a or t
  misc_feature 232: r=a or g
  UNSURE -24: Xaa=Glu or Lys
  UNSURE -21: Xaa=Phe or Leu
  UNSURE -18: Xaa=Lys or Arg
  UNSURE -3: Xaa=Leu or Val
  UNSURE 7: Xaa= *  or Trp
  UNSURE 10: Xaa=Ile or Met
  UNSURE 11: Xaa=Cys or Gly
  UNSURE 23: Xaa=Glu or Val
cacttgarttggggttaagttgaagaacagacaaacttagacacaaagctatgcaaaaattgtgatgaacaaggaaraagtaagtttngaaaggaragcacaggtcagattatatttattctcaggattttggacttttktattagggaaatttaaacaaggggaatgrtcttatatkkgtattctagaaagattactgtggcagcagcagtatgwaggatggcttgtaggrgataagaga

SEQ ID NO: 644 - DNA, 234 bp, Homo sapiens
  CDS 74..232
  sig_peptide 74..196: score 7.7 seq LLCLGQLHHPGLG/RV
  misc_feature 88: k=g or t
aagtttgttccccgagttcggagcctaggagccccccgcggctgcggcgcaggtgccctcggccttagtcgggatggagctgcctgckgtgaaccttgaaagtgattctcctaggtcactggctgctgacaacctggggctgcattgtattctcaggctcctatgcctgggccaacttcaccatcctggccttgggcgtgtgggctgtggctcagcgggactccatcgacgccg

SEQ ID NO: 645 - DNA, 253 bp, Homo sapiens
  CDS 40..252
  sig_peptide 40..111: score 4.4 seq FVFLFWGVFETRS/LS
  misc_feature 135: r=a or g
  misc_feature 137: k=g or t
  misc_feature 138: s=g or c
  misc_feature 151: k=g or t
  misc_feature 157: m=a or c
  UNSURE 9: Xaa=Cys or Phe or Leu or Trp
  UNSURE 14: Xaa=Phe or Val
  UNSURE 16: Xaa=Pro or Thr
acttgttctttttacttaacatgtcttgaacatctttgtatgacagtacatatagaactacctcttctttgttttgtttttttgttttggggggtttttgagacacggtctctctccctgtcacccaggctggartksaagttggtagaaktcatgmctcactgtagcatcaaactcctgggctcaagcgaccctcccgcctcagccttcttggtagctggtactacaggcacatgccacgacacccagccca

SEQ ID NO: 646 - DNA, 169 bp, Homo sapiens
  CDS 6..167
  sig_peptide 6..131: score 4.6 seq LLTCLCLHLKCVS/YR
tgggaatggggaatactaaaatgaaaagatatcctgactcccaaagtgctgggattacaggtgtgagccaccgtgcccggccattccatttacttttgacctgtttgtgtcttcacttaaagtgtgtttcttacagacaccttgtgtttacttttctatccgtgctaat

SEQ ID NO: 647 - DNA, 284 bp, Homo sapiens
  CDS 49..282
  sig_peptide 49..126: score 3.7 seq RLLEARSSRPAWA/XT
  misc_feature 128: w=a or t
  misc_feature 129: h=a or c or t
  misc_feature 137: r=a or g
  misc_feature 138: s=g or c
  misc_feature 152: d=a or g or t
  misc_feature 154: k=g or t
  misc_feature 158: d=a or g or t
  misc_feature 159: m=a or c
  misc_feature 165: s=g or c
  misc_feature 169: v=a or c or g
  misc_feature 170: h=a or c or t
  misc_feature 195: n=a, g, c or t
  misc_feature 196: m=a or c
  misc_feature 203: v=a or c or g
  misc_feature 279: m=a or c
  UNSURE 1: Xaa=Ile or Lys or Asn
  UNSURE 4: Xaa=Lys or Asn or Arg or Ser
  UNSURE 9: Xaa=Ile or Asn or Ser
  UNSURE 10: Xaa=Asp or Tyr
  UNSURE 11: Xaa= *  or Cys or Phe or Leu or Tyr
  UNSURE 13: Xaa=Lys or Asn
  UNSURE 15: Xaa=Ala or Glu or Ile or Lys or Leu or Pro or Gln or Thr or Val
  UNSURE 23: Xaa=Lys or Asn
  UNSURE 24: Xaa=Lys or Gln
  UNSURE 26: Xaa=Ala or Glu or Gly
  UNSURE 51: Xaa= *  or Cys
cattattttgctattcaaagacatttatatggccaggtgtggtggcttatgcctgtaatcctagcactttgggaggccaaggtgggcagattgcttgaggccaggagttcgagaccagcctgggcaawhacggtgarsccccaattttcaadtkattdmaaaaasatavhaataaaagaaatatatttagaaaanmaaaaagvaatatattcaggccgggcacggtggctcatgcctgtaatcccaacactgggacgccaaggcgggaggatcgcctgmggtca

SEQ ID NO: 648 - DNA, 441 bp, Homo sapiens
  CDS 159..440
  sig_peptide 159..221: score 5.3 seq ALTLVLLIKESGA/WS
  misc_feature 100: d=a or g or t
  misc_feature 358: b=c or g or t
  misc_feature 416: m=a or c
  UNSURE 46: Xaa=Ile or Ser or Thr
  UNSURE 65: Xaa=Lys or Asn
agctgttcttggctgacttcacatcaaaactcctatactgacctgagacagaggcagcagtgatacccacctgagagatcctgtgtttgaacaactgctdcccaaaacggaaagtattttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgaagctattcabcaagttattactggattggaatcagaaaagtcaacaatgtgtgggtctgggtaggaamccagaaacctctgacagaagaagcc

SEQ ID NO: 649 - DNA, 341 bp, Homo sapiens
  CDS 133..339
  sig_peptide 133..246: score 8.2 seq LLLIFLSFPYTLC/IL
  misc_feature 313: w=a or t
  misc_feature 330: w=a or t
  misc_feature 331: w=a or t
  misc_feature 336: w=a or t
  UNSURE 23: Xaa= *  or Arg
  UNSURE 28: Xaa= *  or Tyr
  UNSURE 29: Xaa=Phe or Ile
gcctttcacttgcacaaacactgttattatgatcacttatccaactgacatttttcagaccttttaacttcaactgttcttttttcctgtaaatcttaattttctttttttttctcccaatttttctcctacatgtctggactcttcccagttcctgtcagagtaaatgttgatattgcccagaacataacttgctcttccttttctctccttctcatttttctttctttcccctacaccctctgtatactctatagagtaaaatcatatacacccacggagtcaataactgcctttaatctaacaattgggwgattcccatatctttawwtttcwacccc

SEQ ID NO: 650 - DNA, 220 bp, Homo sapiens
  CDS 22..219
  sig_peptide 22..60: score 5.7 seq MIVLLVMLGDILA/GL
  misc_feature 129: m=a or c
  misc_feature 131: m=a or c
  misc_feature 132: m=a or c
  misc_feature 144: m=a or c
  misc_feature 151: k=g or t
  UNSURE 23: Xaa=His or Gln
  UNSURE 24: Xaa=His or Pro or Gln
  UNSURE 31: Xaa=Cys or Gly
taaagttgtattttcactgaaatgattgttttgctggttatgcttggtgatattttagcgggcttatttttgaaaggcatctgttacttcagtggcataaagtgccctcacactgctgtgagccatcamcmmcatttcatctcmagaattkgttctcagtcccaaactgaaactataccattcaaacaacagcgctccccatttccccctcccccgaagc

SEQ ID NO: 651 - DNA, 268 bp, Homo sapiens
  CDS 80..268
  sig_peptide 80..136: score 7.4 seq LGFLXXSLESTLS/IX
  misc_feature 110: m=a or c
  misc_feature 112: r=a or g
  misc_feature 113: r=a or g
  misc_feature 141: m=a or c
  UNSURE -9: Xaa=Ile or Leu or Met
  UNSURE -8: Xaa=Met or Val
  UNSURE 2: Xaa=Pro or Gln
aatctctatttccaagacctttggccagtcctattgatctggactcctggataggcagctggaccaacggacggacgccatgagggctctgctgctcctggggttcctgmtrrtgagcttggagtcaacactttcgattcmaccttgggaagcccccaaggagcataagtacaaagctgaagagcacacagtcgttctcactgtcaccggggagccctgccacttccccttccagtaccaccggcagctgtaccacaaatgtacccac

SEQ ID NO: 652 - DNA, 354 bp, Homo sapiens
  CDS 143..352
  sig_peptide 143..226: score 4.5 seq LRWSLTLLPRLEC/GF
  misc_feature 257: m=a or c
  misc_feature 261: h=a or c or t
  misc_feature 313: m=a or c
  misc_feature 335: b=c or g or t
  misc_feature 337: d=a or g or t
  UNSURE 11: Xaa=Pro or Thr
  UNSURE 12: Xaa=His or Leu or Pro
  UNSURE 29: Xaa= *  or Tyr
  UNSURE 37: Xaa= *  or Cys or Gly or Arg or Trp
cagttacatgttttttgttttgagacagggtcttgctctgtgccccaggctggcttgcactgatgcgatcgtggctcactgcagcctcgacctcccatgctcaagcgatcctcccatctcagcctcttgagtagctgggaccatggcatgcacgtcatgcctggctgatttaaaaaaaattttttttttgagatggagtctcactctgttgcccaggctggaatgcggtttcatgatcttggcctacttgcaacctmcgchtgctgggttcaagcaattcttctgcctcagcctcccgagtagctgggattamaggcgtggcccagctaattttbgdatttttagtagagacag

SEQ ID NO: 653 - DNA, 284 bp, Homo sapiens
  CDS 52..282
tctttgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcacctcctccaccatctccccagc

SEQ ID NO: 654 - DNA, 466 bp, Homo sapiens
  CDS 281..466
  misc_feature 131: w=a or t
  misc_feature 133: r=a or g
  misc_feature 137: m=a or c
  misc_feature 145: r=a or g
  misc_feature 146: m=a or c
  misc_feature 152: r=a or g
  misc_feature 156: m=a or c
  misc_feature 162: n=a, g, c or t
  misc_feature 163: n=a, g, c or t
  misc_feature 168: m=a or c
  misc_feature 295: n=a, g, c or t
  misc_feature 296: n=a, g, c or t
  misc_feature 297: n=a, g, c or t
  misc_feature 421: m=a or c
  UNSURE 5: Xaa=Lys or Asn
  UNSURE 6: Xaa= *  or Ala or Glu or Gly or Lys or Leu or Met or Pro or Gln or Arg or Ser or Thr or Val or Trp
  UNSURE 47: Xaa=Asp or Glu
agggagcgatctccgagcgaggcggcaagatggacgcgggatttttccgcggaacaagtgcagaacaggataatcggttcagcaacaaacagaagaaactactgaagcagctgaaatttgcagaatgcctwgraaamaaaggtgrmcatgargcamagtaannttggmggttataaagccttggataacaaaaagagtaacggaaatccttgggtttgaagatgatgttgtgattgagtttatattcaaccagctggaagtgaagaatccagactccaaaatgatgcaaatcaannngactggatttttgaatggaaaaaatgctcgagaatttatgggagaactgtggcccctgctgctaagtgcacaagaaaacatcgcgggaatcccttctgctttcctagaactgaagaaagaagamataaaacaaagacagattgaacaagaaaaactggcatctatgaaa

SEQ ID NO: 655 - DNA, 482 bp, Homo sapiens
  CDS 78..482
ctttttacagctagacctgtgtgctgcaaggagctaaggccttcagtgtccccttccttacccaggtttctcacagaatggattcccagcgggaacttgcagaggaactgcggctttaccaatccacccttcttcaggatggtctaaaagatctcctggatgagaaaaaattcatcgattgcaccctaaaagcaggtgacaaaagtcttccttgccacagattgattttgtcagcttgtagtccttacttccgtgagtactttttatctgaaattgatgaggcgaaaaaaaaggaggtagtgctagacaatgtggatcctgctatacttgatttaatcatcaaatacctgtactctgccagtattgatctcaatgacggaaatgtgcaagatatttttgcattggccagccgctttcagatcccctcagtgtttactgtctgcgtttcttatcttcagaaaagacttgctcctggtaactgt

SEQ ID NO: 656 - DNA, 788 bp, Homo sapiens
  CDS 126..788
  misc_feature 358: r=a or g
  UNSURE 78: Xaa=Gln or Arg
aagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacratgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtgga

SEQ ID NO: 657 - DNA, 348 bp, Homo sapiens
  CDS 35..346
aggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcctt

SEQ ID NO: 658 - DNA, 285 bp, Homo sapiens
  CDS 67..285
acagccagagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaacca

SEQ ID NO: 659 - DNA, 420 bp, Homo sapiens
  CDS 148..420
agagtagggaccatgctgtccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaag

SEQ ID NO: 660 - DNA, 468 bp, Homo sapiens
  CDS 267..467
  misc_feature 329: n=a, g, c or t
  misc_feature 330: k=g or t
  misc_feature 353: n=a, g, c or t
  UNSURE 21: Xaa=Ile or Met
  UNSURE 22: Xaa=Ala or Ser
gctgggacgtagtgagtgtgatggccgccgcgaggccgggaaggtgaagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaattgtgccagcagacgatccgtggatccattttattttccctgctaggagttgctgtacataacactggcgcaatgtccctgctcttcactcgatgcaactctatcgtcacagtcaagaaaaataagagacacatnkctgaggtgaatgcatccccactnaagcactttgtcactgccaagaagaagatcaatggcatttttgagcagctgggggcctacatccaggagagcgccaccttccttgaagacacgtacaggaatgcagaactggacc

SEQ ID NO: 661 - DNA, 544 bp, Homo sapiens
  CDS 321..542
  misc_feature 340: y=c or t
  misc_feature 521: w=a or t
  misc_feature 522: n=a, g, c or t
  misc_feature 523: w=a or t
  UNSURE 7: Xaa=Ala or Val
  UNSURE 68: Xaa=Asp or Phe or His or Ile or Leu or Asn or Val or Tyr
gcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgytactataaaacttcctgttgatcagtacagaaaacaaattggtaaacaggattataaaaaaactaaacctattttacgagcaaccaaattaaaagcagaagcaaagaaaacagcaataggcataaagttggccttgtacttgcagctatattggcactactactggctttctatgctttcwnwtatctcagactcaccacggat

SEQ ID NO: 662 - DNA, 386 bp, Homo sapiens
  CDS 159..386
  misc_feature 158: w=a or t
  misc_feature 194: w=a or t
  misc_feature 195: r=a or g
  misc_feature 363: w=a or t
  misc_feature 364: n=a, g, c or t
  misc_feature 365: w=a or t
  UNSURE 13: Xaa=Ile or Val
  UNSURE 69: Xaa= *  or Cys or Phe or Ile or Lys or Leu or Asn or Arg or Ser or Thr or Tyr
gcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgaggcattttggagatcaaawatgggtagaaaagatgctgctactataaaacttccwrttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcwnwtatctcagactcaccacggat

SEQ ID NO: 663 - DNA, 482 bp, Homo sapiens
  CDS 136..480
gtgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgac

SEQ ID NO: 664 - DNA, 426 bp, Homo sapiens
  CDS 60..425
  misc_feature 315: s=g or c
  misc_feature 366: k=g or t
  misc_feature 418: m=a or c
  UNSURE 86: Xaa=Ala or Pro
  UNSURE 103: Xaa=Gly or Trp
  UNSURE 120: Xaa=Asn or Thr
aagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaascccccagcgcaggtctgccaagccagaagcccaaggagcagcagcggacgkggcttcgcccggcagtgttacaagctccgcagccaaaggcgctgtcccagamtgtcccca

SEQ ID NO: 665 - DNA, 360 bp, Homo sapiens
  CDS 177..359
  misc_feature 307: w=a or t
  misc_feature 314: n=a, g, c or t
  misc_feature 318: n=a, g, c or t
  UNSURE 44: Xaa=Glu or Val
  UNSURE 48: Xaa=Ala or Pro or Ser or Thr
agggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggwaaatgtngtanctaatgaaaagatctccaagaggtttgtctcattctccttgg

SEQ ID NO: 666 - DNA, 501 bp, Homo sapiens
  CDS 321..500
  misc_feature 75: s=g or c
ctcatttttctactgctcgtggatttacgcgcacgttggaaccgaagagagctctgttgttgcaacatggcggastgacggtggaggttcgcggctctaacggggctttctacaagggatttatcaaagatgttcatgaagactcccttacagttgtttttgaaaataattggcaaccagaacgccaggttccatttaatgaagttagattaccaccaccacctgatataaaaaaagaaattagtgaaggagatgaagtagaggtatattcaagagcaaatgaccaagagccatgtgggtggtggttggctaaagttcggatgatgaaaggagaattttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgtgctaatgaaaatg

SEQ ID NO: 667 - DNA, 441 bp, Homo sapiens
  CDS 164..439
  misc_feature 73: n=a, g, c or t
  misc_feature 74: n=a, g, c or t
  misc_feature 367: r=a or g
acagtcgtgatgtctttcaagagggaaggagacgattggagtcaactcaatgtgctcaaagtaagcgtgaggnnagaggatctggagccgcttcagtcgctccctgaagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgargctcctctgctaactcagacacgacttatcacccagagtgctctgcacagagctccccactataacagttgctg

SEQ ID NO: 668 - DNA, 484 bp, Homo sapiens
  CDS 126..482
  misc_feature 464: y=c or t
aagtacggaggccgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatyacccagagtgctctgcacag

SEQ ID NO: 669 - DNA, 342 bp, Homo sapiens
  CDS 118..342
  misc_feature 153: k=g or t
agcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgkgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaag

SEQ ID NO: 670 - DNA, 454 bp, Homo sapiens
  CDS 115..453
gggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacg

SEQ ID NO: 671 - DNA, 485 bp, Homo sapiens
  CDS 44..484
agagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaatcaacaaccaggccttctcagtgggacaacagcttgtcttccagtccaagttctgaattttaccctttcc

SEQ ID NO: 672 - DNA, 487 bp, Homo sapiens
  CDS 44..487
  misc_feature 402: w=a or t
  UNSURE 120: Xaa=Glu or Val
agagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagwatttattcagcaattcaacaaccaggccttctcagtgggacaacagcttgtctttagcttcaatgaaaagctttttggcttactg

SEQ ID NO: 673 - DNA, 502 bp, Homo sapiens
  CDS 159..500
atagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagca

SEQ ID NO: 674 - DNA, 307 bp, Homo sapiens
  CDS 63..305
  misc_feature 178: r=a or g
  misc_feature 278: w=a or t
  misc_feature 286: w=a or t
  misc_feature 298: w=a or t
  UNSURE 39: Xaa=Gln or Arg
  UNSURE 72: Xaa=Asp or Glu
  UNSURE 75: Xaa=Ile or Lys
  UNSURE 79: Xaa=Ile or Lys
tcagttcacacgtggcgccacggaggcaggttgctgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcrgggtcacaagaagcctaggaaagacccaggagttccaaacagtgctccctttaaggaggctcttcttagggaagctgagctaaggaaacagaggcttgawgaactaawacagcagcagawacttgacag

SEQ ID NO: 675 - DNA, 404 bp, Homo sapiens
  CDS 104..403
  misc_feature 32: m=a or c
  misc_feature 33: m=a or c
cttaactggagttcatcaagttcccactgagmmtgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacgg

SEQ ID NO: 676 - DNA, 392 bp, Homo sapiens
  CDS 84..392
  misc_feature 381: n=a, g, c or t
  UNSURE 100: Xaa=Ala or Pro or Ser or Thr
agacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccanctggctccaca

SEQ ID NO: 677 - DNA, 446 bp, Homo sapiens
  CDS 10..444
  misc_feature 374: r=a or g
  misc_feature 419: m=a or c
  misc_feature 426: s=g or c
  UNSURE 122: Xaa=Gln or Arg
  UNSURE 137: Xaa=Ala or Glu
aacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaataagatcagctcttcctaccaaaaccgtaaagcctgtggaaaacaaagatgatgatgactctatagctgattttctcaatagtgatgaggaagaagacagagtttctttgcagaatttaaagaatttagatggactctcgtcctgtcacccaggctggagtgcagcggcgcaatctcggctcactgcaacctctccctcccagattcragcaattctcatgcctcagcctcccgagcagctgggactacaggmgcctgcsactacgcccaaccaattttt

SEQ ID NO: 678 - DNA, 619 bp, Homo sapiens
  CDS 326..619
gagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaagattcaaccctatgaaaagataaaggccaggggcttgcctgataatatatcttccgtgttgaacaaactagtggtggtgaaactcaatggtggtttgggaaccagcatggggctgcaaaggccctaaaagtctgattggtgtgaggaatgagaatacctttctggatctgactgttcagcaaattgaacatttgaataaaacctacaatacagatgttcctcttgttttaatgaactcttttaacacggatgaagataccaaaaaaatactacagaagtacaatcattgtcgtgtgaaaatctacactttcaatcaaagcaggtacccgaggattaataaagaatctttacttcctgtagcaaaggacgtgtcttactca

SEQ ID NO: 679 - DNA, 426 bp, Homo sapiens
  CDS 267..425
ataaaggcttctcaggtggtgggcaagagttgggcaaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatgg

SEQ ID NO: 680 - DNA, 359 bp, Homo sapiens
  CDS 159..359
  misc_feature 179: k=g or t
  UNSURE 7: Xaa=Cys or Trp
catagctgattgataaagattcaaatcttaagtggaaaatacagtttaaaaatgttaattggcatctttttgcgtactagtgttttgggtaataactacccagtggtgcctgggttctatttttaaagtcattggtagaaattcatctttacttgaacatggcagtaagacttttgtgktcactcataaaaaaatccaatcagagtgcttatctgaggtcacagagcagaacttcctctaacagctttcctcctgtatctcacctagttgtagcccttcatctgtctgggttttattgccgcatacacttatccagcagtttttcatttggcttgaactcaaaacagtcccccgatgct

SEQ ID NO: 681 - DNA, 316 bp, Homo sapiens
  CDS 61..315
actgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactggtgaatgaccacgcccgagagaacagaatcaaccccg

SEQ ID NO: 682 - DNA, 443 bp, Homo sapiens
  CDS 111..443
  misc_feature 15: s=g or c
  misc_feature 391: n=a, g, c or t
  misc_feature 416: m=a or c
  misc_feature 422: r=a or g
  misc_feature 429: w=a or t
  UNSURE 94: Xaa=Ile or Asn or Ser or Thr
  UNSURE 107: Xaa=Ser or Thr
gcgagagagcgagtsagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccantggctccaagcctgatgagcccggmaaagcrggaaaawctccttccgaggag

SEQ ID NO: 683 - DNA, 480 bp, Homo sapiens
  CDS 194..478
  misc_feature 259: m=a or c
  misc_feature 325: m=a or c
  UNSURE 22: Xaa=Lys or Asn
agaaaaatggtttcctaggactttgcaaacggatctgcctaagtgttggtgcaaaactttgtagatctcggctctggcttgctttatttatttattttttggtttgttttctttggtcttccctccttcccccctcggccaaaatgcagggggcaggagtgttgacaattaattggtgaactctcctaaaaaaatggaggcagagaaagactctggaagaagattgcgcccgattgaccgccagcgatacgacgagaamgaggacttgtcggacgtggaggagatcgtcagcgtccgcggcttcagcctggaggagaagcttcgmagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgaga

SEQ ID NO: 684 - DNA, 286 bp, Homo sapiens
  CDS 74..286
  misc_feature 152: y=c or t
  UNSURE 27: Xaa= *  or Gln
agagtgcattgcggggccgcttcctttccgctcggctgttttcctgcgcaggagccgcagggccgtaggagccatggcgcccagccggaatggcatggtcttgaagccccacggttcggtaccacacgaaggtgcgcgccggccgcggcttyagcctggaggagctcagggtggccggcattcacaagaaggtggcccggaccatcggcatttctgtggatccgaggaggcggaacaagtccacggagtccctgcaggccaacgtgcagcggctgaaggagtaccg

SEQ ID NO: 685 - DNA, 435 bp, Homo sapiens
  CDS 74..433
agagtgcattgcggggccgcttcctttccgctcggctgttttcctgcgcaggagccgcagggccgtaggagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccg

SEQ ID NO: 686 - DNA, 428 bp, Homo sapiens
  CDS 67..426
caaaaaagagtaccacctttccgctcggctgttttcctgcgcaggagccgcagggccgtaggagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgctccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccg

SEQ ID NO: 687 - DNA, 327 bp, Homo sapiens
  CDS 83..325
gaggagtgtcgggcggagtttccggctgagagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgac

SEQ ID NO: 688 - DNA, 403 bp, Homo sapiens
  CDS 102..401
atataagcgttggcggaggtcggttgtagcactctgcgcgcccgctcttctgctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactg

SEQ ID NO: 689 - DNA, 383 bp, Homo sapiens
  CDS 190..381
  misc_feature 146: r=a or g
  misc_feature 282: w=a or t
  misc_feature 306: y=c or t
  misc_feature 340: y=c or t
  misc_feature 346: m=a or c
  misc_feature 347: n=a, g, c or t
  misc_feature 365: r=a or g
  misc_feature 366: n=a, g, c or t
  misc_feature 367: m=a or c
  UNSURE 51: Xaa=Pro or Ser
  UNSURE 53: Xaa=Lys or Leu or Met or Pro or Gln or Arg or Thr
  UNSURE 59: Xaa=His or Gln or Arg
  UNSURE 60: Xaa=Ile or Leu
ctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagrtgcggcaaccagatcggcgccaagttttgggaggtcatcagtgatgagcatgggattgaccccactggcagttaccatggagacagtgatttgcagctggagagaatcaatgttttactacaatgaagccactggwaacaaatatgttcctcgggccaaycctcagtggatctggaagccaggcacgatggatycggttmngtctggaccattcggccrnmtcttcagaccaagaca

SEQ ID NO: 690 - DNA, 498 bp, Homo sapiens
  CDS 165..497
cctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggcactacacagagggcgcgagctg

SEQ ID NO: 691 - DNA, 392 bp, Homo sapiens
  CDS 92..391
  misc_feature 336: n=a, g, c or t
  misc_feature 337: w=a or t
  UNSURE 82: Xaa=Ala or Asp or Glu or Gly or Val
ggatgtgggggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggnwttcaaggcagtgcagcagacaggacttggccctgcagagcatctcccatgggcag

SEQ ID NO: 692 - DNA, 679 bp, Homo sapiens
  CDS 283..678
  misc_feature 366: n=a, g, c or t
  misc_feature 648: w=a or t
  misc_feature 667: n=a, g, c or t
  UNSURE 28: Xaa=Asp or Glu
  UNSURE 129: Xaa=Leu or Met or Val
aagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcataganaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggwgttttctatcccagttctntggcttttacta

SEQ ID NO: 693 - DNA, 406 bp, Homo sapiens
  CDS 115..405
  misc_feature 137: n=a, g, c or t
  misc_feature 358: s=g or c
  misc_feature 395: m=a or c
  UNSURE 8: Xaa=Ala or Glu or Gly or Val
  UNSURE 82: Xaa=Ala or Pro
  UNSURE 94: Xaa=Asn or Thr
ctataagagaaagaacgtggtatatagtttatgctttttaaaaaacaaagctcaaattataaactgaattccgatataaatttacttgtggttaaataaatcttctacctaattatgagtttcattttaataaatgnaccagtctttttatttttatttatttattttgagacagggtctcactttgtcacccaagctggagggaagtggcgtggtctgggctcgctgcaacctctgcctcccgggtttaggcgatcctcctgcctcagcctcctgagtggctgggattgcgggcttgcgccaccacgctcggctaatttttgtatttttagtggagatggggtttcgccgtgttggscagactggtcttcaactcctggcttcaggtggtccamcctcctcggcc

SEQ ID NO: 694 - DNA, 279 bp, Homo sapiens
  CDS 123..278
  misc_feature 274: r=a or g
  UNSURE 51: Xaa=His or Arg
acagtagaaacaggaagtgggaccaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacrcgccg

SEQ ID NO: 695 - DNA, 445 bp, Homo sapiens
  CDS 27..443
  misc_feature 97: r=a or g
  misc_feature 177: k=g or t
  UNSURE 24: Xaa=Asp or Gly
  UNSURE 51: Xaa=Ala or Ser
actaacaggtctgaaaattgaacaagatggacgggtccaggaaagaggaggaggaagacagcacattcaccaacatttctcttgcagatgacatagrccattcctcaagaattttgtatccaaggcccaaaagtttgttacccaagatgatgaatgctgacatggatgcagttgatkctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaagtaagggattgacacccttctgttttatggaattgctgctgatcattttttcttt

SEQ ID NO: 696 - DNA, 384 bp, Homo sapiens
  CDS 26..382
  misc_feature 131: m=a or c
  misc_feature 135: y=c or t
  misc_feature 141: r=a or g
  UNSURE 36: Xaa=Lys or Gln
  UNSURE 37: Xaa=Phe or Ser
  UNSURE 39: Xaa=Lys or Arg
aaattgtttggcagctttagcaaatatgtcggcacagtttcgttctctccatcagtatgctgcccagaggatcatcagtttattttctttgctgtctaaaaaacacaacaaagttctggaacaagccacamagtycttgaraggttcgctgagttctaatgatgttcctctaccagattatgcacaagacctaaatgtcattgaagaagtgattcgaatgatgttagagatcatcaactcctgcctgacaaattcccttcaccacaacccaaacttggtatacgccctgctttacaaacgcgatctctttgaacaatttcgaactcatccttcatttcaggatataatgcaaaatattgatctggtgatctccttctttagctc

SEQ ID NO: 697 - DNA, 366 bp, Homo sapiens
  CDS 30..365
  misc_feature 131: r=a or g
  misc_feature 133: m=a or c
  UNSURE 35: Xaa=Asn or Thr
aaatcgtggcagccgcctcggccgccgcaatgcagagagaggagaagcagcttgaggcatcattagatgcactgctgagtcaagtggctgatctgaagaactctctggggagtttcatttgcaagttggaramcgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagc

SEQ ID NO: 698 - DNA, 477 bp, Homo sapiens
  CDS 261..476
  misc_feature 36: s=g or c
ggctgtgctttggctcttcgggtaaagatggcggasgcgggtacagcttttcgctgactacattcagcccgtctggtaaacttgtccagattgaatatgctttggctgctgtagctggaggagccccgtccgtgggaattaaagctgcaaatggtgtggtattagcaactgagaaaaaacagaaatccattctgtatgatgagcgaagtgtacacaaagtagaaccaattaccaagcatataggtttggtgtacagtggcatgggccccgattacagagtgcttgtgcacagagctcgaaaactagctcaacaatactatcttgtgtaccaagaacccattcctacagctcagctggtacagagagtagcttctgtgatgcaagaatatactcagtcaggtggtgttcgtccatttggagtttctttacttatttgtggttggaatgagggacgaccatatttatttcagtcagatc

SEQ ID NO: 699 - DNA, 789 bp, Homo sapiens
  CDS 578..787
aactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatacctgcctttctttctaggttgtatctcccacttcacccttctagaccatcccagaagatctataagatttcatctgggaaatcactaggagttcttggaagggaaagaaggaagattgttggttggaataaaaacagggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatc

SEQ ID NO: 700 - DNA, 549 bp, Homo sapiens
  CDS 338..547
aactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatc

SEQ ID NO: 701 - DNA, 598 bp, Homo sapiens
  CDS 387..596
aactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatc

SEQ ID NO: 702 - DNA, 869 bp, Homo sapiens
  CDS 658..867
aactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatc

SEQ ID NO: 703 - DNA, 396 bp, Homo sapiens
  CDS 185..394
aactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatc

SEQ ID NO: 704 - DNA, 407 bp, Homo sapiens
  CDS 55..405
atctttccttggtgccaaccatgcctgcatatcagggcagcattctatgatcccatggctctcacatcgacagaccacaacactaagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgccaaaggcttctatgatcttgatgctttaaatgaagctgcttggacaagtgcccacagccagttggttccctgtaatgtttgtgggcgtaccttcctgccagacagactgattgttcaccaacaatcttgtaaacccaa

SEQ ID NO: 705 - DNA, 332 bp, Homo sapiens
  CDS 60..332
  misc_feature 46: k=g or t
acctcagttctcgggcgtacggcgcggcctgtcctactgctgccgkcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggac

SEQ ID NO: 706 - DNA, 204 bp, Homo sapiens
  CDS 29..202
  misc_feature 158: r=a or g
  misc_feature 177: w=a or t
  UNSURE 44: Xaa=Ala or Thr
  UNSURE 50: Xaa=Glu or Val
accttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccttrccttcatggacgactcagwggtggagtcgaccgccagcatcttggc

SEQ ID NO: 707 - DNA, 318 bp, Homo sapiens
  CDS 29..316
  misc_feature 267: r=a or g
  misc_feature 273: r=a or g
  misc_feature 291: y=c or t
  misc_feature 305: m=a or c
  misc_feature 306: m=a or c
  misc_feature 309: r=a or g
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly
accttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgaaagagaaagacagggaaaaggagagagagagggraaaggracgtgaaaaagaaaaggyacggggtaaaaacmmagrccgggacaa

SEQ ID NO: 708 - DNA, 316 bp, Homo sapiens
  CDS 29..316
  misc_feature 263: w=a or t
  misc_feature 264: w=a or t
  UNSURE 79: Xaa=Phe or Ile or Asn or Tyr
accttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagcagctcctgaagccaagawwcagaaagtggaaggcacagaaccgactacggctttcaatctctttgttggaa

SEQ ID NO: 709 - DNA, 398 bp, Homo sapiens
  CDS 223..396
  misc_feature 352: r=a or g
  misc_feature 371: w=a or t
  UNSURE 44: Xaa=Ala or Thr
  UNSURE 50: Xaa=Glu or Val
gtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccttrccttcatggacgactcagwggtggagtcgaccgccagcatcttggc

SEQ ID NO: 710 - DNA, 362 bp, Homo sapiens
  CDS 187..360
  misc_feature 110: n=a, g, c or t
  misc_feature 120: r=a or g
  misc_feature 316: r=a or g
  misc_feature 335: w=a or t
  UNSURE 44: Xaa=Ala or Thr
  UNSURE 50: Xaa=Glu or Val
atcttgcaaggtaagaatcgcgggcctgtctgcaagacttgagttcaggactcccaatccttcgccatccgaacctggagggcatccagtcgacacctacaggggtcggncatgtccaargctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccttrccttcatggacgactcagwggtggagtcgaccgccagcatcttggc

SEQ ID NO: 711 - DNA, 512 bp, Homo sapiens
  CDS 223..510
  misc_feature 461: r=a or g
  misc_feature 467: r=a or g
  misc_feature 485: y=c or t
  misc_feature 499: m=a or c
  misc_feature 500: m=a or c
  misc_feature 503: r=a or g
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly
gtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgaaagagaaagacagggaaaaggagagagagagggraaaggracgtgaaaaagaaaaggyacggggtaaaaacmmagrccgggacaa

SEQ ID NO: 712 - DNA, 510 bp, Homo sapiens
  CDS 223..510
  misc_feature 457: w=a or t
  misc_feature 458: w=a or t
  UNSURE 79: Xaa=Phe or Ile or Asn or Tyr
gtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagcagctcctgaagccaagawwcagaaagtggaaggcacagaaccgactacggctttcaatctctttgttggaa

SEQ ID NO: 713 - DNA, 891 bp, Homo sapiens
  CDS 223..891
gtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcgg

SEQ ID NO: 714 - DNA, 476 bp, Homo sapiens
  CDS 187..474
  misc_feature 110: n=a, g, c or t
  misc_feature 120: r=a or g
  misc_feature 425: r=a or g
  misc_feature 431: r=a or g
  misc_feature 449: y=c or t
  misc_feature 463: m=a or c
  misc_feature 464: m=a or c
  misc_feature 467: r=a or g
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly
atcttgcaaggtaagaatcgcgggcctgtctgcaagacttgagttcaggactcccaatccttcgccatccgaacctggagggcatccagtcgacacctacaggggtcggncatgtccaargctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgaaagagaaagacagggaaaaggagagagagagggraaaggracgtgaaaaagaaaaggyacggggtaaaaacmmagrccgggacaa

SEQ ID NO: 715 - DNA, 474 bp, Homo sapiens
  CDS 187..474
  misc_feature 110: n=a, g, c or t
  misc_feature 120: r=a or g
  misc_feature 421: w=a or t
  misc_feature 422: w=a or t
  UNSURE 79: Xaa=Phe or Ile or Asn or Tyr
atcttgcaaggtaagaatcgcgggcctgtctgcaagacttgagttcaggactcccaatccttcgccatccgaacctggagggcatccagtcgacacctacaggggtcggncatgtccaargctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagcagctcctgaagccaagawwcagaaagtggaaggcacagaaccgactacggctttcaatctctttgttggaa

SEQ ID NO: 716 - DNA, 855 bp, Homo sapiens
  CDS 187..855
  misc_feature 110: n=a, g, c or t
  misc_feature 120: r=a or g
atcttgcaaggtaagaatcgcgggcctgtctgcaagacttgagttcaggactcccaatccttcgccatccgaacctggagggcatccagtcgacacctacaggggtcggncatgtccaargctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcgg

SEQ ID NO: 717 - DNA, 402 bp, Homo sapiens
  CDS 199..402
  misc_feature 364: n=a, g, c or t
  UNSURE 56: Xaa=Ala or Pro or Ser or Thr
agtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctccatgtatccagaatcaacgacgggctccccggctcggctctcgctgcggcagacgggctcccccgggatgatctacagtactcggtatgggagtcccaaaagacagctccagttttacaggaacctgggcaagtctggcctgcgggtctcctgcctgggacttggancatgggtgaccttcggaggccagatcaccgatgagatg

SEQ ID NO: 718 - DNA, 332 bp, Homo sapiens
  CDS 14..331
gtttttgtccaatatggcggcgcccagtggcggtgtgaactgtgaggagttcgccgagttccaggaattactcaaggtgatgaggacaattgatgacagaatagtacatgaattaaacactacggttccaacagcttcctttgcagggaaaattgatgccagccaaacctgtaaacaactttatgagtctttgatggcagctcatgccagtagagacagagtcataaaaaactgtatagcccagacttcagcagtagtaaaaaacctccgagaagagagagaaaagaatttggacgatttaacgttattaaaacaacttagaaaagagcaga

SEQ ID NO: 719 - DNA, 445 bp, Homo sapiens
  CDS 107..445
  misc_feature 313: n=a, g, c or t
  misc_feature 314: n=a, g, c or t
  misc_feature 316: s=g or c
  UNSURE 69: Xaa=Asp or Glu
  UNSURE 70: Xaa=Ala or Pro or Ser or Thr
acagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtgganncscctggacaacaggtgggggcgtcgcagtttcctcaggggtaccagttcccctccatggagcagctggctgccatgctccccagcgtggtgcagcatttcgggttcaagtatgtgattggcatcggagtg

SEQ ID NO: 720 - DNA, 401 bp, Homo sapiens
  CDS 141..401
aaaaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccag

SEQ ID NO: 721 - DNA, 372 bp, Homo sapiens
  CDS 62..370
  misc_feature 192: r=a or g
  UNSURE 44: Xaa=Glu or Gly
aaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggrgatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgccttggcttcccaaagtgtttggattacagg

SEQ ID NO: 722 - DNA, 217 bp, Homo sapiens
  CDS 54..215
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggacatagcaggtgctttcaaccattccacca

SEQ ID NO: 723 - DNA, 827 bp, Homo sapiens
  CDS 54..827
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaacca

SEQ ID NO: 724 - DNA, 307 bp, Homo sapiens
  CDS 54..305
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgagaccatcagatgcaatttcgcttcacttttcctggctgtagagcgctttcc

SEQ ID NO: 725 - DNA, 535 bp, Homo sapiens
  CDS 119..535
  misc_feature 122: r=a or g
  UNSURE 2: Xaa=Ile or Val
ctaagttctcgcgcgactcccacttccgcccttttggctctctgaccagcaccatggcggttggcaagaacaagcgccttacgaaaggcggcaaaaagggagccaagaagaaagtacaatgrttgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaacca

SEQ ID NO: 726 - DNA, 278 bp, Homo sapiens
  CDS 36..278
  misc_feature 23: s=g or c
actccctgaggcagtggcgacasggcggcgagaggatgaacaacaagttcgacgctttgaaagatgatgacagtggggaccatgatcagaatgaagaaaacagcacacagaaagatggtgagaaggaaaaaacggaacgagacaagaatcagagcagtagcaagagaaaggtggagcagttctggaggttttatagccacatggtacgtcctggggacctgacaggccacagtgacttccatctcttcaaagaaggaattaaacccatgtgggaggat

SEQ ID NO: 727 - DNA, 397 bp, Homo sapiens
  CDS 209..397
  misc_feature 166: s=g or c
  misc_feature 274: n=a, g, c or t
  misc_feature 371: n=a, g, c or t
  UNSURE 55: Xaa= *  or Glu or Lys or Gln
gagagaaagacttctttaaaaaagcgtttttgttaaggagtctgggaatcatggaatcatagtgaccagtaactgttatggactggattgtatccccctccaattcagttatggtgctgcttcagaaagaaaagagatagtttcccttgcaaagttatcaaagtgstccccagaagacattaggtatttgctttctagtctacatacaatgaaaaggaaaaaacgtcagttcctgaagctctctcaaaacatcaacagatggaaagacgtgccnatgtcctcccctccctccactctgggggcttggaaatgctgcagcagggagcaggccccaggctggacctgccctgtcctcacgacgagtgtgtgcnaagtgaacaataaatcatttcaaaga

SEQ ID NO: 728 - DNA, 485 bp, Homo sapiens
  CDS 203..484
  misc_feature 92: y=c or t
  misc_feature 161: y=c or t
agctcccttcccggcggcctttgcgggaacaagatggcagcccccatacctcaagggttctcttgtttatcgaggtttttgggctggtggtytcggcagccagcttctggtgactcagtccgcagctatagttccagtaagaactaaaaaacgtttcacayctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcaccttt

SEQ ID NO: 729 - DNA, 516 bp, Homo sapiens
  CDS 219..515
  misc_feature 143: k=g or t
  misc_feature 434: w=a or t
ctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctggktgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggwaaagtcattgataaaaaactaccaaaacctcttgaaaaggtacctatgctggtgccagtgccagtgtctgagccagtgccag

SEQ ID NO: 730 - DNA, 615 bp, Homo sapiens
  CDS 262..615
  misc_feature 137: n=a, g, c or t
  misc_feature 299: r=a or g
  misc_feature 416: y=c or t
  UNSURE 13: Xaa=Lys or Arg
  UNSURE 52: Xaa=Phe or Ser
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaangccgcaagttcctggagacggtggagttgcagatcagcttgaagaactatgatccccagaaggacaagcgcttctcgggcaccgtcagcactgtgacgaggctaaggccgtggatatcccccacatggacatcgaggcgctgaaaaaactcaacaagaataraaaactggtcaagaagctggccaagaagtatgatgcgtttttggcctcagagtctctgatcaagcagattccacgaatcctcggcccaggtttaaataaggcaggaaagttcccttycctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 731 - DNA, 376 bp, Homo sapiens
  CDS 76..375
  misc_feature 64: s=g or c
tagtgggcgggtcgccgaggagcctgaggaagagggcggcgacggtggtggtgactgagcggasccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcagattctcatcgaaggctccttctcactcccctttctcaggccaggagg

SEQ ID NO: 732 - DNA, 517 bp, Homo sapiens
  CDS 76..516
  misc_feature 64: s=g or c
tagtgggcgggtcgccgaggagcctgaggaagagggcggcgacggtggtggtgactgagcggasccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgcactggggcatataatgcttggaaacaaacattattcca

SEQ ID NO: 733 - DNA, 409 bp, Homo sapiens
  CDS 76..408
  misc_feature 64: s=g or c
  misc_feature 113: m=a or c
  misc_feature 115: m=a or c
  misc_feature 297: n=a, g, c or t
  misc_feature 317: r=a or g
  UNSURE 13: Xaa= *  or Ser
  UNSURE 74: Xaa=Ile or Met
  UNSURE 81: Xaa=His or Arg
tagtgggcgggtcgccgaggagcctgaggaagagggcggcgacggtggtggtgactgagcggasccggtgacaggatggaaacctttgcaccaaagagagttatgactatctmamgaactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacatncttatctcgggacacacacrcaaatttgaagcatttgagcatgaaaataaattctacattaatccaggttctgcactggggcatataatgcttggaaacaaacattattcca

SEQ ID NO: 734 - DNA, 277 bp, Homo sapiens
  CDS 69..275
  misc_feature 213: k=g or t
  misc_feature 249: k=g or t
  misc_feature 250: n=a, g, c or t
  UNSURE 49: Xaa=Ala or Ser
  UNSURE 61: Xaa= *  or Ala or Glu or Gly or Leu or Ser or Val
tctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacccacccctgtgctcccctgccackctgatggctcaagacaaggctggcaaaccctcccaknaacatctctggcccagaaagcctctct

SEQ ID NO: 735 - DNA, 401 bp, Homo sapiens
  CDS 70..399
acagacggcgggtgaacatggcgtcctcgacttggtctgagacgtgataggcctgccttctggttgaagatgtggcgagtgaaaaaactgagcctcagcctgtcgccttcgccccagacgggaaaacgatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctac

SEQ ID NO: 736 - DNA, 471 bp, Homo sapiens
  CDS 25..471
  misc_feature 354: y=c or t
actagtggagtgaggggtaacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattyaatgtacctgtgagcttggagagtaagaaagctgctcgggcagctaggtttgggatttcttcagttccaacaaaaggtctgtcatctgataacaaacctatggttaacttggataag

SEQ ID NO: 737 - DNA, 421 bp, Homo sapiens
  CDS 82..420
gcgggccctagcaaccagagcagtgacagtagcaaccgccggaatggcgaaagcaacaacaatcaaagaagccttagcgagatgggaagagaaaactggccagaggcatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctgg

SEQ ID NO: 738 - DNA, 435 bp, Homo sapiens
  CDS 34..435
  misc_feature 338: r=a or g
  UNSURE 102: Xaa=Lys or Arg
gtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaargaaacatcagagaaacctgggcatgtctatgcgtgtggaacgttccaccctggatcaggtgaagaaacgttttgaggtcaacaagaagaagatggaa

SEQ ID NO: 739 - DNA, 428 bp, Homo sapiens
  CDS 34..426
gtttttcagctcgccattcacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtcccattgtctatctgaccatctttctcttactgtcctctttgtctagctatctggcctatctgtcgatccatcttcgtgtctgtcttcagcccccacctgtttgtccatctgtccaattacctgtgactctgtgcatctt

SEQ ID NO: 740 - DNA, 483 bp, Homo sapiens
  CDS 310..483
  misc_feature 149: r=a or g
  misc_feature 150: r=a or g
  misc_feature 386: r=a or g
  UNSURE 26: Xaa=Lys or Arg
aaaacgtcctgtagacacctggaccgcgagggcgcggttccctgcttctctaggggcccagacacggcgacggatcttgacgctttttcctccccacagacaaaaaacttggactttcgccgaaagtgggacaaagatgaatatgagarrctcgccgagaagaggctcacggaagagagagaaaagaaagatggaaaaccagtgcagcctgtcaagcgagagcttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaargaaacatcagagaaacctgggcatgtctatgcgtgtggaacgttccaccctggatcaggtgaagaaacgttttgaggtcaacaagaagaagatggaa

SEQ ID NO: 741 - DNA, 494 bp, Homo sapiens
  CDS 159..494
  misc_feature 49: s=g or c
  misc_feature 50: s=g or c
  misc_feature 51: m=a or c
accaacccctgccgcaggactttcctgggccggctcgcggagagcgtassmggccttggtggcggaatggcgttgagtgacggcccggccccgccatctggttaaagggactcgttcaacacggaagtgtcccggggctgcattgtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggaatgtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcac

SEQ ID NO: 742 - DNA, 481 bp, Homo sapiens
  CDS 23..481
atgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcatcatctttggaatctcgttcatttttactggcaaagaaatccggggagaatgtggccaagtttattattaattcataccccaaatattttcagaaggacatagctgaacctcatataccgtgtttaatgcctgagtactttgaacctcagatcaaagacataagt

SEQ ID NO: 743 - DNA, 255 bp, Homo sapiens
  CDS 72..254
tgaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatgactgcagaacactgccagg

SEQ ID NO: 744 - DNA, 287 bp, Homo sapiens
  CDS 123..287
agttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggac

SEQ ID NO: 745 - DNA, 393 bp, Homo sapiens
  CDS 105..392
  misc_feature 267: s=g or c
  misc_feature 298: s=g or c
  UNSURE 55: Xaa=Leu or Val
  UNSURE 65: Xaa=Pro or Arg
aactctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcastcaggccgcggcccagaccaactccaacgcsgcaggcaaacagctgcgcaaggagtcccagaaagaccgcaagaacccgctgccccccagcgttggcgtggttgacaagaaagaggagacgcagcc

SEQ ID NO: 746 - DNA, 470 bp, Homo sapiens
  CDS 124..468
  misc_feature 400: n=a, g, c or t
  misc_feature 454: m=a or c
  UNSURE 93: Xaa=Ala or Pro or Ser or Thr
  UNSURE 111: Xaa=Pro or Thr
accgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccanctccctcttggggtcgtcgccctcgagatgattatcgtaggaggagtcctccamctcgtcgcagatctcc

SEQ ID NO: 747 - DNA, 492 bp, Homo sapiens
  CDS 162..491
  misc_feature 433: r=a or g
  UNSURE 91: Xaa=Asp or Gly
gagagtaatgttacagagcggagagagtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggrtcccaatgcacccaagaggcctccttcggccttcttcctcttctgctctgagtatcgcc

SEQ ID NO: 748 - DNA, 713 bp, Homo sapiens
  CDS 383..712
  misc_feature 55: s=g or c
  misc_feature 56: s=g or c
  misc_feature 300: s=g or c
  misc_feature 320: s=g or c
  misc_feature 334: k=g or t
  misc_feature 361: k=g or t
  misc_feature 415: s=g or c
  misc_feature 416: r=a or g
  misc_feature 432: s=g or c
  misc_feature 433: r=a or g
  misc_feature 468: r=a or g
  misc_feature 654: r=a or g
  misc_feature 685: y=c or t
  UNSURE 12: Xaa=Glu or Lys
  UNSURE 17: Xaa=Ala or Gly
  UNSURE 29: Xaa=Lys or Arg
  UNSURE 91: Xaa=Asp or Gly
attacgctgacgaaagagacctgcttgcgcgtcgctgttccgtggtccgcgcgasstggtcgggagccgctggttcctggggtgacccgcggaggtgggagagggaagggcttccgaagccggcgggggtgccatggaccctctccgccggcgcggccttcacagctgggccgcgccgggcatccgtagtccgctctcccaaagcctcggtggagctgaagctgccacagagtgcatgttcacaaagggtcatcacacacggagctgcccctccctgtctccctagagcccatcttcgasgccaggggcttttctaccasgattctggggtgtktctcctcctttcctccctcccagatcktctcacgaaaaataactaaacatgggcaaaggagatcctaagaagccgagaggsraaatgtcatcatatgsrttttttgtgcaaacttgtcgggaggagcataagargaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggrtcccaatgcacccaagaggcctccttcggcyttcttcctcttctgctctgagtatcgcc

SEQ ID NO: 749 - DNA, 328 bp, Homo sapiens
  CDS 151..327
gagagtaatgttacagagcggagagagtgaggaggctgcgtctggctcccgctctcacagccattgcagtacattgagctccatagagacagcgccggggcaagtgagagccggacgggcactgggcgactctgtgcctcgctgaggaccatgtctgctaaagagaaaggaaaatttgaagatatggcaaaagcggacaaggcccgttatgaaagagaaatgaaaacctatatccctcccaaaggggagacaaaaaagaagttcaagggtcccaatgcacccaagaggcctccttcggccttcttcctcttctgctctgagtatcgcc

SEQ ID NO: 750 - DNA, 268 bp, Homo sapiens
  CDS 76..267
cttcacgagacgtcactgtcttcggtcgcggggcatcgtgggtaggagggagattcgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggaaacgttttgatggtaaattacaatcagaatcaactaataatggaaaaaataagagag

SEQ ID NO: 751 - DNA, 739 bp, Homo sapiens
  CDS 343..738
  misc_feature 18: s=g or c
  misc_feature 208: n=a, g, c or t
  misc_feature 209: k=g or t
  misc_feature 210: r=a or g
  misc_feature 290: k=g or t
  misc_feature 291: r=a or g
agtagctgtgctgcgcastccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaaggggcatttaaatcaaacggtattgagatggattgggttankraaacataatggtccaaatgacgctagtgatgggacagtacgacttcgtggactaccatttggttgcagcaaagaggaaakrgttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgaaagaaagaagacaaggaaaaggaggaggaggaagaggagaa

SEQ ID NO: 752 - DNA, 599 bp, Homo sapiens
  CDS 429..599
  misc_feature 18: s=g or c
  misc_feature 316: r=a or g
agtagctgtgctgcgcastccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaaggggcatttaaatcaaacggtattgagatggattgggttatgaaacataatggtccaaatgacgctagtgatgggacagtacgacttcgtggactaccatttggttgcagcaaagaggaaatagttcagttctttcaaggtatattgaratcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgaaagaaagaagacaaggaaaaggaggaggaggaagaggagaa

SEQ ID NO: 753 - DNA, 342 bp, Homo sapiens
  CDS 172..342
cactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgaaagaaagaagacaaggaaaaggaggaggaggaagaggagaa

SEQ ID NO: 754 - DNA, 721 bp, Homo sapiens
  CDS 325..720
agtagctgtgctgcgcagtccctaagcggttgtcaccgctggagacggttgggagaaccgttgtggcgagcgctacacgaggcaaacgacttctcccttctttgaactggaccccgcgagcaccagaagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgaaagaaagaagacaaggaaaaggaggaggaggaagaggagaa

SEQ ID NO: 755 - DNA, 1036 bp, Homo sapiens
  CDS 112..1035
  misc_feature 657: r=a or g
  misc_feature 663: y=c or t
  misc_feature 669: y=c or t
  misc_feature 672: y=c or t
  misc_feature 673: m=a or c
  misc_feature 685: m=a or c
  misc_feature 690: y=c or t
  misc_feature 693: y=c or t
  misc_feature 702: m=a or c
  misc_feature 705: w=a or t
  misc_feature 714: y=c or t
  misc_feature 720: y=c or t
  misc_feature 738: y=c or t
  misc_feature 1030: r=a or g
  UNSURE 307: Xaa=Asp or Asn
atttttttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaratcttyaagagyagymgagctgaagttmgaacycaytatgatccmccwcgaaagctyatggcyatgcagcggccaggtccytatgataggccgggggctggcagagggtataatagcattggcagaggagctgggtttgaaaggatgaggcgtggtgcctatggtggagggtatggaggctatgatgactatggtggctataatgatggatatggctttgggtctgatagatttggaagagacctcaattactgtttttcaggaatgtctgatcatagatacggagatggtgggtccagtttccagagcaccacagggcactgtgtacacatgagggggttaccttacagagccactgagaatgatatttatratttct

SEQ ID NO: 756 - DNA, 721 bp, Homo sapiens
  CDS 494..721
  misc_feature 146: s=g or c
  misc_feature 337: m=a or c
  misc_feature 346: s=g or c
actcgcttacgtgagcagaagtagttctggtcgtcgtctaccgtctcgctatagccgtttgagggaagaaggaggaaaattacccgctacaccaaaattgcattgagccaaacttgccaccaagagcccaacaatcaccatgatgstgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggamgtgaaattsgcttacgtgagcagaagtagttctggtcgtcgtctaccgtctcgctatagccgtttgagggaagaaggaggaaaattacccggtatcgttagagctacaccaaaattgcattgagccaaacttgccaccaagagcccaacaatcaccatgatgctgagcacggaaggcagggaggggttcgtggtgaaggtcaggggcctaccctggtcctgctcagccgatgaagtgatgcgcttcttctctgattgcaagatccaaaatggcacatcaggtattcgtttcatctacaccagagaaggcagaccaagtggtgaagcatttgttgaacttgaatctgaagaggaagtgaaattggctttgaagaaggacagagaa

SEQ ID NO: 757 - DNA, 360 bp, Homo sapiens
  CDS 78..359
  misc_feature 2: y=c or t
  misc_feature 16: s=g or c
  misc_feature 116: r=a or g
  misc_feature 117: r=a or g
  misc_feature 121: r=a or g
  misc_feature 126: r=a or g
  misc_feature 303: n=a, g, c or t
  misc_feature 339: n=a, g, c or t
  UNSURE 14: Xaa=Ile or Val
  UNSURE 15: Xaa=Lys or Arg
  UNSURE 17: Xaa=Glu or Lys
  UNSURE 76: Xaa=Ala or Pro or Ser or Thr
  UNSURE 88: Xaa=Phe or Ile or Leu or Val
cytagacctggaattsctgggaaactgaaacattctgtagacttacttgtttccaactgtatcgcagcaagaagtctatgtgccccaggatcctggattacctgaggaagaagagrrtcarggaaraaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtncccctccacctaaagtggtaaacccactgatcggcntcttgggtgaatatggaggag

SEQ ID NO: 758 - DNA, 459 bp, Homo sapiens
  CDS 103..459
  misc_feature 162: r=a or g
  misc_feature 438: s=g or c
  misc_feature 439: y=c or t
  UNSURE 112: Xaa= *  or Tyr
  UNSURE 113: Xaa=Pro or Ser
ctccccggcccggttgcgctgtagccgctgccgcctctgcctgggtcccttcggccgtacctctgcgtgggggctgcctccccggctcccggtgcagacaccatgtacggatttgtgaatcacgccctggagttgctggtgatccgcaattacggccccgargtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctasycaggaatgcgtgcaccttcc

SEQ ID NO: 759 - DNA, 709 bp, Homo sapiens
  CDS 55..708
  misc_feature 600: r=a or g
  misc_feature 644: n=a, g, c or t
  misc_feature 708: m=a or c
  UNSURE 197: Xaa=Leu or Pro or Gln or Arg
  UNSURE 218: Xaa=Lys or Asn
tacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaargttcctgcccagaaagccacaggccagaaagcagcgcctgctcnaaaagctcagaagggtcaaaaagctccagcccagaaagcacctgctccaaaggcatctggcaamg

SEQ ID NO: 760 - DNA, 360 bp, Homo sapiens
  CDS 55..360
  misc_feature 316: r=a or g
  misc_feature 324: m=a or c
  UNSURE 88: Xaa=Ala or Thr
tacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcarccacacgmtgggcacttctccatttcctactggaggatttattt

SEQ ID NO: 761 - DNA, 480 bp, Homo sapiens
  CDS 55..480
tacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctggaaataagattattccttttt

SEQ ID NO: 762 - DNA, 730 bp, Homo sapiens
  CDS 55..729
  misc_feature 621: r=a or g
  misc_feature 665: n=a, g, c or t
  misc_feature 729: m=a or c
  UNSURE 204: Xaa=Leu or Pro or Gln or Arg
  UNSURE 225: Xaa=Lys or Asn
tacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctgctgctgctgctgctgctgctaaagttccagcaaaaaagatcaccgccgcgagtaaaaaggctccagcccagaargttcctgcccagaaagccacaggccagaaagcagcgcctgctcnaaaagctcagaagggtcaaaaagctccagcccagaaagcacctgctccaaaggcatctggcaamg

SEQ ID NO: 763 - DNA, 820 bp, Homo sapiens
  CDS 166..819
  misc_feature 372: s=g or c
  misc_feature 478: m=a or c
  misc_feature 479: n=a, g, c or t
  misc_feature 480: k=g or t
  misc_feature 711: r=a or g
  misc_feature 755: n=a, g, c or t
  misc_feature 819: m=a or c
  UNSURE 69: Xaa=His or Gln
  UNSURE 105: Xaa=His or Ile or Lys or Leu or Met or Asn or Pro or Gln or Arg or Ser or Thr
  UNSURE 197: Xaa=Leu or Pro or Gln or Arg
  UNSURE 218: Xaa=Lys or Asn
tacacatgcgcagggttgggcgggtcttcttccttctcgcctaacgctgccaacatggtgagtcttactgttgcgggctccggggccgtcgaccatgccgctcgacctccacctccgctgggaagctgaggcgccgaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccascagaagtatgtccgacaagcctggcagaaggcagacatcaatacaaaatgggcagccacacgatgggccaagaagattgaagccagagaaaggaaagccaagatgmnkgattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaargttcctgcccagaaagccacaggccagaaagcagcgcctgctcnaaaagctcagaagggtcaaaaagctccagcccagaaagcacctgctccaaaggcatctggcaamg

SEQ ID NO: 764 - DNA, 450 bp, Homo sapiens
  CDS 129..449
cctaaaaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggacactttttgaactcattctggctgcaaa

SEQ ID NO: 765 - DNA, 518 bp, Homo sapiens
  CDS 198..518
ggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgg

SEQ ID NO: 766 - DNA, 470 bp, Homo sapiens
  CDS 166..468
  misc_feature 130: m=a or c
  misc_feature 134: y=c or t
  misc_feature 135: m=a or c
gggtcacgctaacgccgcggtttcctccgctcgattggttctactgtgggtctggactgatctccatgtcctgttgtggggcttttacagcctttggattgtgaaaactgctgagagagacttgcaatcmagtymcataagtataataaagaaatattggtcctcatggaagaagagcaagatttaccagagcaaccagtgaaaaaagccaagatgcaggaatcaggagagcaaactataagtcaagtaagcaatccagatgtcagtgatcagaagcctgaaacatcaagccttgcttcaaaccttcccatgtcagaggaaattatgacatgcaccgattacatccctcgctcatccaatgattatacctcacaaatgtattctgcaaaaccttatgcacatattctctcagttcctgtttcggaaactgcttaccctggacagactcaataccagacactacagcagac

SEQ ID NO: 767 - DNA, 381 bp, Homo sapiens
  CDS 83..379
  misc_feature 2: s=g or c
  misc_feature 241: r=a or g
asaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcaratgaggatagttaagcctaaagtggcctccatggaggagatggccaccttccacactgatgcttatctgcagcatctccagaaggtcagccaagagggcgatgatgatcatccggactccatagaatatgggctaggtta

SEQ ID NO: 768 - DNA, 454 bp, Homo sapiens
  CDS 262..453
  misc_feature 16: w=a or t
gatggctgcatacccwgaagggacagcagctgggcagtccgagtgggcttgggtaaatacaagtattggtgcacttagggtgcggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatgg

SEQ ID NO: 769 - DNA, 249 bp, Homo sapiens
  CDS 29..247
actttttttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcatcctccgcaagcggatgaacaccaacccttcccgaggcccctaccacttccgggcccccagccgcatcttctggcggaccgtgcgaggtatgctgcc

SEQ ID NO: 770 - DNA, 406 bp, Homo sapiens
  CDS 20..406
  misc_feature 44: w=a or t
  misc_feature 134: r=a or g
  UNSURE 9: Xaa= *  or Arg
  UNSURE 39: Xaa=Ile or Val
agcggtgggctgagctaaaatggctgaggagagagtcgcgacgwgaactcaatttcctgtatctactgagtctcaaaaaccccggcagaaaaaagctccagagtttcctattttggagaagcagaactggttgrttcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaa

SEQ ID NO: 771 - DNA, 276 bp, Homo sapiens
  CDS 86..274
attttttttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaaga

SEQ ID NO: 772 - DNA, 463 bp, Homo sapiens
  CDS 242..463
agggccctctttgtggctgcagttggcaagatggcgccggtgggggtggcagaagaagctgctgctaggtcccaacgggcccgcggtggcggccgccggcgacctgaccagtgaggaggaggaaggccagagcctatggtcctccattctgagcgaagtgtccacccgcgccaggtccaagctgccgtccggcaagaacatcctggtcttcggtgaagatggttctggtaaaacaaccctcatgactaaactacaaggagctgagcatggcaaaaaaggaagaggcctagaatatctctacctcagtgtccatgatgaggaccgagatgatcacacgcgctgcaacgtgtggattctggatggagacttgtaccacaaaggcctgctgaaatttgcagtttctgctgaatccttgccagagaccctcgtcatttttgttgcagacatgtctagaccttggact

SEQ ID NO: 773 - DNA, 295 bp, Homo sapiens
  CDS 98..295
agccacaaacggatgtgaggtgaggcaggagcggcgacctttgaaggaaaaaaggaagtgtttggacgacagcgagcgggagaagcggggtcaagaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccg

SEQ ID NO: 774 - DNA, 350 bp, Homo sapiens
  CDS 105..350
agccacaaacggatgtgaggtgaggcaggagcggcgacctttgaaggaaaaaaggaagtgtttggacgacagcgagcgggagaagcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccg

SEQ ID NO: 775 - DNA, 407 bp, Homo sapiens
  CDS 105..407
agccacaaacggatgtgaggtgaggcaggagcggcgacctttgaaggaaaaaaggaagtgtttggacgacagcgagcgggagaagcggggtcaaagggagcactatgtctgcggaagtccccgaggcagcctccgcggaggagcagaagagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccg

SEQ ID NO: 776 - DNA, 341 bp, Homo sapiens
  CDS 96..341
  misc_feature 7: k=g or t
  misc_feature 8: k=g or t
  misc_feature 51: k=g or t
gggccckkggagagctgggacgggcggcggccgggtggcctcggccaccckctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccg

SEQ ID NO: 777 - DNA, 520 bp, Homo sapiens
  CDS 365..520
  misc_feature 124: k=g or t
  misc_feature 125: n=a, g, c or t
  misc_feature 127: n=a, g, c or t
  misc_feature 128: n=a, g, c or t
aaccagactgcgagcggagaagcggagtttgcagcctcggaattggctagagcgccagagccgagtcagccataaagctacgcgctaggctcttggccctgacgtgaggcgcgcagagatggcknannggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaat

SEQ ID NO: 778 - DNA, 549 bp, Homo sapiens
  CDS 256..549
agccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattgga

SEQ ID NO: 779 - DNA, 484 bp, Homo sapiens
  CDS 177..482
gcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtccagacagcagtggccccgaagcgcatattgagtatcagtgctgatattgaaacaattggagaaattctgaagaa

SEQ ID NO: 780 - DNA, 457 bp, Homo sapiens
  CDS 25..456
aagatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcacctacttcctgcagcaacg

SEQ ID NO: 781 - DNA, 533 bp, Homo sapiens
  CDS 344..532
  misc_feature 192: r=a or g
gtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagarccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctg

SEQ ID NO: 782 - DNA, 330 bp, Homo sapiens
  CDS 83..328
agactccttgcggagtcgccgcctgattctaggctggtcactactccgagcctgtgacgtttgcggcagcaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctca

SEQ ID NO: 783 - DNA, 413 bp, Homo sapiens
  CDS 89..412
  misc_feature 16: n=a, g, c or t
  misc_feature 388: r=a or g
atgccccgccccctcnccagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagctgaagtcgcggcgtgtggactttgagactttcctgcccatgctccaggcagtggccaagaaccgaggccaaggcacatatgaggactacttggargggtttcgtgtgtttgacaaggaag

SEQ ID NO: 784 - DNA, 229 bp, Homo sapiens
  CDS 30..227
gttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcgcatg

SEQ ID NO: 785 - DNA, 473 bp, Homo sapiens
  CDS 99..473
  misc_feature 358: k=g or t
  misc_feature 359: n=a, g, c or t
  UNSURE 87: Xaa= *  or Cys or Phe or Leu or Trp
agcccctctacctccggaagagacgagtgcggtaacaccgttcacagagctagccggacgtcctccgactcaagatatttgtcaaatattttcagaagatggctgatccttggcaggaatgcatggattatgcagtaactctagcaagacaagctggagaggtagtttgtgaagctataaaaaatgaaatgaatgttatgctgaaaagttctccagttgatttggtaactgctacggaccaaaaagttgaaaaaatgcttatctcttccataaaggaaaagtatccatctcacagtttcattggtgaagaatctgtggcagctggggaaaaaagtatcttaaccgacaaccccacatknatcattgaccctattgatggaacaactaactttgtacatagatttccttttgtagctgtttcaattggctttgctgtaaataaaaagatagaatttggagttgtgtacagttgt

SEQ ID NO: 786 - DNA, 315 bp, Homo sapiens
  CDS 91..315
gctgctggaaacgcagttccggttaggcggctgagtttgtttacgttgctaacagatctagcccctgctttccctagttccagttccaagatggggaaatccttcgccaacttcatgtgcaagaaagactttcatcctgcctccaaatccaatatcaaaaaagtatggatggcagaacagaaaatatcatatgataagaagaaacaagaagaattgatgcagcaatatcttaaagaacaagaatcatatgataatagattgcttatgggagatgaacgtgtaaagaatggccttaatttcatgtatgaagccccc

SEQ ID NO: 787 - DNA, 244 bp, Homo sapiens
  CDS 55..243
  misc_feature 72: y=c or t
  misc_feature 73: r=a or g
  misc_feature 74: m=a or c
  misc_feature 75: s=g or c
  misc_feature 77: k=g or t
  UNSURE 7: Xaa=Ala or Asp or Glu or Lys or Asn or Thr
  UNSURE 8: Xaa=Leu or Arg
catagcgaccccggccgggcccgcggcgcgcgcagtgacggacattgaggctggatgctgcgatcccgcagyrmsckcagcttgcagaagcagccaccatgccagtctctaagtgcccaaaaaagtcggagtccctgtggaaggggtgggaccggaaggcccagaggaacggcctgcggagcaggtatacgctgtgaatggcgactactatgtgggcgagtggaaggacaacgtgaaacacggg

SEQ ID NO: 788 - DNA, 392 bp, Homo sapiens
  CDS 96..392
attgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatgga

SEQ ID NO: 789 - DNA, 508 bp, Homo sapiens
  CDS 165..506
  misc_feature 451: m=a or c
  misc_feature 486: m=a or c
  UNSURE 96: Xaa=Ala or Glu
  UNSURE 108: Xaa=Pro or Thr
actgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggmgacaagaccatcatgctgcgcggccttcccatcamcatcacagagagcgatattcga

SEQ ID NO: 790 - DNA, 415 bp, Homo sapiens
  CDS 42..413
accatttcagttgtgttcttggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagacc

SEQ ID NO: 791 - DNA, 431 bp, Homo sapiens
  CDS 151..429
tttttggcgtggggcgcactgttcagttgctctcctggatggctttatgtctccgcggtgtttcctagagtctcggcgtttctacctcttcgcaccctttcctgccaccctttgtcccctggaagcccggagacatcagcggctgcaattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagacc

SEQ ID NO: 792 - DNA, 261 bp, Homo sapiens
  CDS 102..260
  misc_feature 10: k=g or t
  misc_feature 12: y=c or t
  misc_feature 23: w=a or t
  misc_feature 158: n=a, g, c or t
  misc_feature 233: w=a or t
  UNSURE 44: Xaa= *  or Cys
ttttaacttkayttttatttgtwtagagattttaagttggaacagtattttcccattgactacttttcattcttcactgtagttttaaagaagaactgtaaatgacggtgctatacaagtcaaaaaatacatgcctgcctcgtagtgaagttgtagcnctccgtaatatgtatattttactcagttttcaacattttgtgaatgttgactacctgaagttcctttttagatgwgctattaacattctgttggattcagagg

SEQ ID NO: 793 - DNA, 214 bp, Homo sapiens
  CDS 3..212
  misc_feature 164: r=a or g
taatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgargataccagagaggcattggtcaaaaaatttggtgctcagaatgtagctcg

SEQ ID NO: 794 - DNA, 448 bp, Homo sapiens
  CDS 190..447
  misc_feature 353: n=a, g, c or t
  misc_feature 354: n=a, g, c or t
  misc_feature 355: k=g or t
  UNSURE 55: Xaa=Ile or Lys or Met or Asn or Arg or Ser or Thr
  UNSURE 56: Xaa=Ala or Ser
agaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagannkctaccaagaggaggagatgcccgaatcgggcgcgggcagtgagttcaaccgcaagcttcgggaggaggctcggaggaagaagtacggcatcgt

SEQ ID NO: 795 - DNA, 326 bp, Homo sapiens
  CDS 43..324
aagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaag

SEQ ID NO: 796 - DNA, 300 bp, Homo sapiens
  CDS 144..299
  misc_feature 32: s=g or c
gaagagcgagccagcgcccggagcaagcggastcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacg

SEQ ID NO: 797 - DNA, 503 bp, Homo sapiens
  CDS 99..503
  misc_feature 6: n=a, g, c or t
attttncgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacag

SEQ ID NO: 798 - DNA, 322 bp, Homo sapiens
  CDS 44..322
  misc_feature 104: n=a, g, c or t
  misc_feature 281: w=a or t
  misc_feature 300: w=a or t
  misc_feature 315: s=g or c
  UNSURE 21: Xaa=Ile or Leu or Val
  UNSURE 80: Xaa= *  or Lys
  UNSURE 86: Xaa=Lys or Met
  UNSURE 91: Xaa=Ser or Thr
cacaatccttcgcgctcttcctttccaacttggacgctgcagaatggctcccgcaaagaagggtggcgagaagaaaaagggccgttctgccatcaacgaagtgntaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggtgcwaaagttatctgtattcgawggtgaacttttgcastgacacc

SEQ ID NO: 799 - DNA, 380 bp, Homo sapiens
  CDS 44..379
  misc_feature 359: k=g or t
  misc_feature 370: w=a or t
  UNSURE 106: Xaa=Phe or Val
cacaatccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttgkttacctatacwgtcaatgtgg

SEQ ID NO: 800 - DNA, 326 bp, Homo sapiens
  CDS 3..326
  misc_feature 250: s=g or c
  UNSURE 83: Xaa=Arg or Thr
ggatgtgggtgagttcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgcgaasagaactacaggagctcatgaaacagattgacataatggtggctcataaaaaatctgaatgggaaggacggtacaca

SEQ ID NO: 801 - DNA, 497 bp, Homo sapiens
  CDS 194..496
ctcccccttcgtcgcctgtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtag

SEQ ID NO: 802 - DNA, 299 bp, Homo sapiens
  CDS 106..297
tatgcagcatgtgtgatttttaaaaaggtgcacattaataaaaaatgacttagtcattattaattcttaactcactggaatatctctcagaacttcttccttgacatggtcctttggaaagttgtgttcaaccgagacaaacaaggagagtatcggttcagcaccacacagccaccgcaggagtcagtggatcggtggggaaaatgctgcttaccctgggccctgggctgtagaaagaagacaccaaaggcaaagtacatgtatctggcgcaggagctcttggttgatccagaatggcc

SEQ ID NO: 803 - DNA, 488 bp, Homo sapiens
  CDS 214..486
  misc_feature 450: n=a, g, c or t
  misc_feature 452: k=g or t
  UNSURE 80: Xaa=Gly or Val
cttccacgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctngkattttgggaaattgttcctaaaacaactccagatgg

SEQ ID NO: 804 - DNA, 453 bp, Homo sapiens
  CDS 179..451
  misc_feature 415: n=a, g, c or t
  misc_feature 417: k=g or t
  UNSURE 80: Xaa=Gly or Val
cttccacgtcagccaaggactctggagccgccgccgccgctgctgcggttcatatccggagtagacggagccgcagtagacggatccgcggctgcaacaaaccactgcccctcggagcctgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctngkattttgggaaattgttcctaaaacaactccagatgg

SEQ ID NO: 805 - DNA, 445 bp, Homo sapiens
  CDS 70..444
agctttgtttcggagcgggagctcttccgagacgcactgggggccggatgaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaag

SEQ ID NO: 806 - DNA, 415 bp, Homo sapiens
  CDS 76..414
  misc_feature 379: r=a or g
  UNSURE 102: Xaa=Ala or Thr
ttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccrcccccgtccctgtggaagtggtccagaagttctgtc

SEQ ID NO: 807 - DNA, 478 bp, Homo sapiens
  CDS 149..478
  misc_feature 368: r=a or g
  UNSURE 74: Xaa=Ala or Thr
gattttcatttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaarctaaggatggtagtcagcgtggaggaatttttagccagtttgcaaatcagaatctgagcaagaaaatccctggagtgaaactctgtgaaagcattgtatatggagaagtc

SEQ ID NO: 808 - DNA, 495 bp, Homo sapiens
  CDS 166..495
  misc_feature 61: m=a or c
  misc_feature 161: r=a or g
  misc_feature 171: y=c or t
  misc_feature 174: r=a or g
  misc_feature 179: y=c or t
  misc_feature 180: m=a or c
  misc_feature 385: r=a or g
  UNSURE 5: Xaa=Ala or Val
  UNSURE 74: Xaa=Ala or Thr
gactcccaggcgtcttgcaccaaagggaggtcgggatctcggttttccggccccgagaggmaccaggtgcctccgccatagcttctgtcgctccatcgcccgcactgtgactggactgttagagggatccgtggagaggaggccaggacacctggaagccrggaaatggaytcrgtggymtttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaarctaaggatggtagtcagcgtggaggaatttttagccagtttgcaaatcagaatctgagcaagaaaatccctggagtgaaactctgtgaaagcattgtatatggagaagtc

SEQ ID NO: 809 - DNA, 499 bp, Homo sapiens
  CDS 170..499
  misc_feature 165: r=a or g
  misc_feature 178: r=a or g
  misc_feature 184: m=a or c
  misc_feature 196: r=a or g
  misc_feature 198: m=a or c
  misc_feature 214: k=g or t
  misc_feature 232: r=a or g
  misc_feature 234: r=a or g
  misc_feature 238: w=a or t
  misc_feature 241: m=a or c
  misc_feature 389: r=a or g
  UNSURE 10: Xaa=Ala or Asp
  UNSURE 15: Xaa=His or Gln
  UNSURE 22: Xaa=Asp or Gly
  UNSURE 74: Xaa=Ala or Thr
agaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccrggaaatggactcrgtggcmtttgaggatgtrgmtgtgaacttcacccakgaggagtgggctttgctrgrtccwtcmcagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaarctaaggatggtagtcagcgtggaggaatttttagccagtttgcaaatcagaatctgagcaagaaaatccctggagtgaaactctgtgaaagcattgtatatggagaagtc

SEQ ID NO: 810 - DNA, 370 bp, Homo sapiens
  CDS 163..369
  misc_feature 46: y=c or t
caaagcccgaagcggtctcatttcccgccggccccccattcgggtycgggttttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaagaccaggacattgagaatctgtaccaaaacctggggattaagctaagaagtctggtggagagac

SEQ ID NO: 811 - DNA, 431 bp, Homo sapiens
  CDS 162..431
  misc_feature 233: w=a or t
  misc_feature 234: y=c or t
  UNSURE 25: Xaa= *  or Gln
aaaatgcgtgctacgtcactgtgcgatcgggttgtgcttagcttggggtctcctggccccttgacgcgtcaggttgctgtacccctgcatcggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcwyagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtg

SEQ ID NO: 812 - DNA, 338 bp, Homo sapiens
  CDS 107..337
  misc_feature 141: m=a or c
  UNSURE 12: Xaa=Ala or Asp
acctcacctttgtccctgcgcgggctgcggctgggatccggtctttccagccccgagagggacctggttcctctgcccaggcttctgtcactctgtcacctacgctatgccctgctgtagtcacaggaggtgtagagaggmccccgggacatctgaaagccaggaaatggacccagtggcctttgatgatgttgctgtgaacttcacccaggaggagtgggctttgctggatatttcccagaggaaactctacaaggaagtgatgctggaaactttcaggaacctgacctctgtaggaaaaagttggaaagaccagaacattgaatatgagtaccaaa

SEQ ID NO: 813 - DNA, 411 bp, Homo sapiens
  CDS 84..410
  misc_feature 239: n=a, g, c or t
  misc_feature 309: r=a or g
  misc_feature 357: r=a or g
  misc_feature 362: r=a or g
  misc_feature 377: w=a or t
  UNSURE 52: Xaa=Asp or Glu
  UNSURE 76: Xaa=Glu or Lys
  UNSURE 92: Xaa=Glu or Lys
  UNSURE 98: Xaa=Asp or Glu
gcatctgcctggggccagtgaggagaatgcatctagacagagcttttcgtgctgctgagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgaganattacagaaaacctgatggctacaggtgatctggaccaagatggaaggatcagctttgatgagtttatcragattttccatggcctaaaaagcacagatgttgccaagacctttagaraagcratcaataagaaggawgggatttgtgcaatcggtggtacttcagagcagt

SEQ ID NO: 814 - DNA, 454 bp, Homo sapiens
  CDS 121..453
ctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctg

SEQ ID NO: 815 - DNA, 719 bp, Homo sapiens
  CDS 347..718
  misc_feature 556: n=a, g, c or t
  misc_feature 557: n=a, g, c or t
  misc_feature 705: w=a or t
  UNSURE 70: Xaa=Asp or Glu
  UNSURE 71: Xaa=Gly or Arg or Trp
  UNSURE 120: Xaa= *  or Leu
atcttatacatcctggttcgaacattttctccctgccattttgagttgtctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtgcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgannggtattatgccatgaagatcttagataagcagaaggttgttaaactgaagcaaatagagcatactttgaatgagaaaagaatattacaggcagtgaattttcctttccttgttcgactggagtatgcttttaaggataattctaattwatacatggttatgg

SEQ ID NO: 816 - DNA, 312 bp, Homo sapiens
  CDS 109..312
acacagcattttaatatcagtgaggtccacagctagcagtaagagctggtgtaattgaaagacgtttaggtgcaatcattctgctgtttgctccttgccaggttcaacatgggattgtcacgcaaatcatcagatgcatctgcttgctcctcttcagaaatatctgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaa

SEQ ID NO: 817 - DNA, 371 bp, Homo sapiens
  CDS 110..370
  misc_feature 57: k=g or t
  misc_feature 58: w=a or t
  misc_feature 98: k=g or t
  misc_feature 100: b=c or g or t
  misc_feature 144: k=g or t
  misc_feature 253: n=a, g, c or t
  misc_feature 321: k=g or t
  UNSURE 12: Xaa=Leu or Trp
  UNSURE 71: Xaa=Cys or Phe
tcccggaacgcgcgcaccgcatacggcgcggatcgcagggagccggtccgccgccgkwacgggagcctgggtgtgcgtgtggagtccggactcgtggkabacgatcgcgatgaacacggtcgggacctggagactgttgcagtkgaatagggcagctactgggaagatggagatggagatggagcaggtgtttgagatgaaggtcaaagaaaaagttcaaaaactgaaggactctgaagctgagctccagcgncgccatgagcaaatgaaaaagaatttggaagcacagcacaaagaattggaggaaaaacgtcgtcagtkcgaggatgagaaagcaaactgggaagctcaacaacgtattttagaacaac

SEQ ID NO: 818 - DNA, 568 bp, Homo sapiens
  CDS 28..567
  misc_feature 149: r=a or g
  misc_feature 254: r=a or g
  misc_feature 490: m=a or c
  misc_feature 554: r=a or g
  UNSURE 41: Xaa= *  or Trp
  UNSURE 76: Xaa=Cys or Tyr
  UNSURE 155: Xaa=Leu or Met
  UNSURE 176: Xaa=Glu or Gly
aaagtaaagcggaggcagcgggggaagatggcggcggccgttccacagcgggcgtggaccgtggagcagctgcgcagtgagcagctgcccaagaaggacattatcaagtttctgcaggaacacggttcagattcggctggagtgcagtrgcgcgatctcggctcactgcaacctccgcctcccgggttcaaacgattctcctgcctctgcctctcgagtagctgggactacaggcgcgtgccaccacgccagtrtcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttmtgaaaaagggagataaaccaactttcccaaaaagggagatgttgttcactgctggtatacaggracactacaagatgg

SEQ ID NO: 819 - DNA, 489 bp, Homo sapiens
  CDS 138..488
  misc_feature 28: k=g or t
  misc_feature 467: s=g or c
  misc_feature 475: n=a, g, c or t
  UNSURE 110: Xaa=Arg or Ser
  UNSURE 113: Xaa=Ala or Asp or Gly or Val
ggctggtttggatccgggtcagtcgggkgccgagatttgggagagacgctctgaactgactgccccgcatcaccggagcgtcccagctgcgaggagtgtaaacaggaacatcgataagtagtgtaaaaacttgcacaatgaaatccgaagccaaggatggagaggaggagagtctacagactgctttcaaaaaattaagagtggatgcatcagggtctgtagcatctctgtctgttggagaaggcacaggtgtcagagcaccagtcagaacagcaacagatgataccaaacctaaaaccacatgtgcatctaaagacagttggcacgggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagscagactgnctcacctgatggca

SEQ ID NO: 820 - DNA, 471 bp, Homo sapiens
  CDS 25..471
gaggggacggggtccgactcagaaatggcggcctccatgttctacggcaggctagtggccgtggccacccttcggaaccaccggcctcggacggcccagcgggctgctgctcaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggttcaaaagatgtcgtgataaaggcacaggttttagctggtggtagaggaaaaggaacatttgaaagtggcctcaaaggaggagtgaagatagttttctctccagaagaagcaaaagctgtttcttcacaaatgattgggaaaaaattgtttaccaagcaaacgggagaaagggca

SEQ ID NO: 821 - DNA, 504 bp, Homo sapiens
  CDS 163..504
  misc_feature 88: s=g or c
  misc_feature 414: w=a or t
  misc_feature 415: k=g or t
  UNSURE 85: Xaa=Ala or Ser
atacccctccgggttaggcggctgtagcggagctcgaaaagagtggcgcagggtcgcgcggccccgcctccttccccgcccagcgaastctctgaccaccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacwkctttcattgcaccgcagtgtgaaatgattccaattgaatgggtttgcagaagaatagcaactggttcttttctcaaaagaaatcctggt

SEQ ID NO: 822 - DNA, 381 bp, Homo sapiens
  CDS 42..380
aaacagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtg

SEQ ID NO: 823 - DNA, 661 bp, Homo sapiens
  CDS 381..659
  misc_feature 227: s=g or c
  misc_feature 514: n=a, g, c or t
  UNSURE 45: Xaa=Leu or Pro or Gln or Arg
aggcgtccgcgcggcggccattttgtcttgtcggctcctgtgtgtaggagggatttcggcctgagagcgggccgaggagattggcgacggtgtcgccgtgttttcgttggcgggtgcctgggctggtgggaacagccgcccgaaggaagcaccatgatttcggccgcgcagttgttggatgagttaatgggccgggaccgaaacctagccccggacgagaagcgcasaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgagtccatgctcgtttggcattatctcaaaaccagcagtcttctggggccgctggccnaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagaga

SEQ ID NO: 824 - DNA, 352 bp, Homo sapiens
  CDS 153..350
  misc_feature 226: s=g or c
  misc_feature 276: w=a or t
  misc_feature 290: n=a, g, c or t
  UNSURE 25: Xaa=Arg or Thr
  UNSURE 42: Xaa=Phe or Ile
  UNSURE 46: Xaa=Lys or Asn
aggcgtccgcgcggcggccattttgtcttgtcggctcctgtgtgtaggagggatttcggcctgagagcgggccgaggagattggcgacggtgtcgccgtgttttcgttggcgggtgcctgggctggtgggaacagccgcccgaagaagcaccatgatttcggccgcgcagttgttggatgagttaatgggccgggaccgaaacctagccccggacgagaagcgcasaacgtgcggtgggaccacgagagcgtttgtaaatattatctctgtggttwttgtcctgcggaantgttcacaaatacacgttctgatcttgatgtatttggaagaggagataaacattagagatgt

SEQ ID NO: 825 - DNA, 393 bp, Homo sapiens
  CDS 189..392
  misc_feature 80: s=g or c
  misc_feature 378: m=a or c
  misc_feature 379: m=a or c
  UNSURE 64: Xaa=His or Asn or Pro or Thr
agaccggaagcagcccgcgccgggggtttctgggaaaaggcttgtgaacggcgtttctgcgtctgccgtggacagcgaastgctgcggttcctgagccggagggcgagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcammtgggccccgtgagg

SEQ ID NO: 826 - DNA, 445 bp, Homo sapiens
  CDS 34..444
  misc_feature 282: n=a, g, c or t
  misc_feature 283: n=a, g, c or t
  misc_feature 381: w=a or t
  UNSURE 84: Xaa= *  or Glu or Lys or Gln
gcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggcnnaggtctgtctgccagtaattagtgccgaaaactggaagccagcaaccaaaaccgaccaaggtaagacatgtgcctgtgtcttcctcggaaggggtctwtgggggtgctgctctggggtgggggcttctggtaccagatcagacagaatccagagaatctttc

SEQ ID NO: 827 - DNA, 459 bp, Homo sapiens
  CDS 219..458
agccagctagtcaagtgactctaagaagggccattttcccttgttgtctttgaaaatacttcattttcttagcatttcaggagattataacatcctgtatttcagtttctgagagcttactgactgatttccctattcaaaacaatcctcatttcctacatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaag

SEQ ID NO: 828 - DNA, 504 bp, Homo sapiens
  CDS 264..503
attttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaag

SEQ ID NO: 829 - DNA, 640 bp, Homo sapiens
  CDS 400..639
atttatttgacatcctggggttacagcacgctaaagggcacccactgtccttaacagagaaaaatacactgctgagcagaggattaaacagactcctcacactaccggaagttcagtgcattttccaggattttcaaggcttcgatgctgtcatgttgagagtccactatccacgtttgtttatccaggaataatgcagaaaatctgagcattcgtgaatctaatcattgagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaag

SEQ ID NO: 830 - DNA, 283 bp, Homo sapiens
  CDS 10..282
gaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagc

SEQ ID NO: 831 - DNA, 430 bp, Homo sapiens
  CDS 125..430
  misc_feature 63: k=g or t
  misc_feature 92: r=a or g
  misc_feature 93: n=a, g, c or t
  misc_feature 94: s=g or c
  misc_feature 340: w=a or t
  misc_feature 371: n=a, g, c or t
  UNSURE 72: Xaa=Asp or Glu
  UNSURE 83: Xaa=Gly or Arg or Trp
atcatcacttccggtaaccccgccggccgccagctccaggagggagaatgggagaggggcaakgagggaacgagtggaagattgcgtcacgrnsgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgawattggactgcattacaagattccttacccanggccaattcatctgcctccaatgggccttaccccactccgaggccggggacttcgaagc

SEQ ID NO: 832 - DNA, 384 bp, Homo sapiens
  CDS 76..384
  misc_feature 102: y=c or t
tttacgagattggcttggattctgtcggatggacttggggctagctgcggcggggctggaggaggccagataaccatgtcagccacagttgtagatgcagtyaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaaagacatcaacccccatattcctcagtatatttcttcagtgccatggtatattgatccttcaaaaagacctactttaaaacaccagagaccacaaccagaaaaacaaaagcagttcagctcatctggagaatggtacaag

SEQ ID NO: 833 - DNA, 487 bp, Homo sapiens
  CDS 235..486
  misc_feature 50: s=g or c
attttttccgtttccgtacggaagcaaaggagccaagaccatggcgaaascggggataagagcggcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcag

SEQ ID NO: 834 - DNA, 389 bp, Homo sapiens
  CDS 59..388
  misc_feature 16: w=a or t
  misc_feature 32: k=g or t
  misc_feature 33: y=c or t
ttttttttttcctctwacccccccttctggakyggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggag

SEQ ID NO: 835 - DNA, 299 bp, Homo sapiens
  CDS 117..299
gatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttcc

SEQ ID NO: 836 - DNA, 407 bp, Homo sapiens
  CDS 124..405
  misc_feature 39: s=g or c
tagagagccccggagccgcggcgggagaggaacgcgcascagccttgggaagcccaggcccggcagccatggcggtggaaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggt

SEQ ID NO: 837 - DNA, 459 bp, Homo sapiens
  CDS 101..457
  misc_feature 330: w=a or t
  misc_feature 331: w=a or t
  UNSURE 77: Xaa=His or Leu or Gln
aaaaagaaaaaacggttacccagcaactagaaaaacaaccggaaccggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcwwgaaccacctgagaaaagtgatcctaaacaagaagagtctcagatatctgggaaggaggaagagacatcagtcaccatcttagactcttctgaggaagataaggaaaaagaagaggttgctgctgtcaa

SEQ ID NO: 838 - DNA, 316 bp, Homo sapiens
  CDS 8..316
attatacatgactggaaaagtaatggcaagcaagacttcagagctgagctatcttgatatttttatccagtgtgtggggtgttacacatgcatcacagctataatagagctatcacatggatcttttgaaaaacaagatagagatgttttaaaggcttctgggtttgatttcttagtcagatgctgtggtacttggcatttaacaactagaattgtggtctgcaaagaaaaaacttctagaaaaagacaacaaaaaaaaaaaaaaaaaaaaaaaaaaaaaaaaaaaaaaaaaaaaaaaaaaaaaaaaaaaaaaaaa

SEQ ID NO: 839 - DNA, 223 bp, Homo sapiens
  CDS 62..223
ttgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccgg

SEQ ID NO: 840 - DNA, 601 bp, Homo sapiens
  CDS 142..600
agtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcagg

SEQ ID NO: 841 - DNA, 361 bp, Homo sapiens
  CDS 44..361
ctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaac

SEQ ID NO: 842 - DNA, 637 bp, Homo sapiens
  CDS 32..637
attctcctgtggccactgtaacctccaaactatgagtaatctgaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaa

SEQ ID NO: 843 - DNA, 590 bp, Homo sapiens
  CDS 294..590
  misc_feature 519: k=g or t
  UNSURE 76: Xaa=Asp or Tyr
agactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtkaccatgccttgctgagcgaggtgatacaactgatgcagtatgtcatctatggaattgcgtctttttcttct

SEQ ID NO: 844 - DNA, 455 bp, Homo sapiens
  CDS 29..454
  misc_feature 14: s=g or c
acccgggaggcggsgccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatccaccttcaacacc

SEQ ID NO: 845 - DNA, 353 bp, Homo sapiens
  CDS 124..351
  misc_feature 342: s=g or c
cttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcsaagagccaggc

SEQ ID NO: 846 - DNA, 283 bp, Homo sapiens
  CDS 94..282
  misc_feature 275: w=a or t
  UNSURE 61: Xaa=Lys or Met
accttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgawgaacccgg

SEQ ID NO: 847 - DNA, 455 bp, Homo sapiens
  CDS 267..455
  misc_feature 29: n=a, g, c or t
  misc_feature 445: s=g or c
  UNSURE 60: Xaa=Arg or Thr
attgaaggcggggaaataccgcggcgcgnacggtagttgctgtggtttccgttctgagctcgcagcttaggagctgaagatcgcggacttagcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcasatgccctgca

SEQ ID NO: 848 - DNA, 351 bp, Homo sapiens
  CDS 22..351
gctcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacacctgtaggtctgcttcatgcccttttgatggcaggagggagctgtcctgat

SEQ ID NO: 849 - DNA, 463 bp, Homo sapiens
  CDS 115..462
  misc_feature 415: n=a, g, c or t
  misc_feature 442: r=a or g
  UNSURE 101: Xaa=Leu or Met or Val
  UNSURE 110: Xaa=Glu or Lys
atattaccgcgtaggctaaccagtgcgcttaatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggntgactatgatggtattggcaatcgtgraagacctggctttggcagatt

SEQ ID NO: 850 - DNA, 552 bp, Homo sapiens
  CDS 205..552
  misc_feature 165: s=g or c
gctacgttgcttccggtgcctggctccgtttcctgcttttggttcttacagtagtcggcgtaggccttaggtgggttcgtgcgccttctacctcgctgtttcggttttcctggctcctcggcccttttctcccctgttgcagctgggagcggacgaagcgcgaastgggattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagact

SEQ ID NO: 851 - DNA, 453 bp, Homo sapiens
  CDS 106..453
gctacgttgcttccggtgcctggctccgtttcctgcttttggttcttacagtagtcggcgtaggccttagattttttactgtctcctgaagaatttaacacaaacatggatatcagaccaaatcatacaatttatatcaacaatatgaatgacaaaattaaaaaggaagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatatcaaaaatgcgtggaacttttgctgacaaagaaaagaaaaaagaaaagaaaaaagccaaaactgtggaacagact

SEQ ID NO: 852 - DNA, 441 bp, Homo sapiens
  CDS 47..439
  misc_feature 379: r=a or g
gtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaagggctacttggtgaattgggatgttcagagacaggtttgggattacctttttggaaaagaaatgtatcaggttgattttttagatactaatattattatcactgaaccatactttaacttcacttcaattcaagaatcaatgaatgarattctatttgaagaataccagtttcaagcagtattaagagtaaatgctggggctctcagtgc

SEQ ID NO: 853 - DNA, 372 bp, Homo sapiens
  CDS 47..370
  misc_feature 310: r=a or g
gtcggaaagggaaaacaactacggctgcggtgtggttggtggtgagatgacgaccttagtgctggataatggagcttacaacgccaaaatcggttacagccatgaaaatgtgtcggttattcctaattgtcagttccggtcaaaaacagcacgtcttaaaacttttactgccaaccagatagatgaaataaaagacccttctggactcttttacatcctcccttttcaaaaggttgattttttagatactaatattattatcactgaaccatactttaacttcacttcaattcaagaatcaatgaatgarattctatttgaagaataccagtttcaagcagtattaagagtaaatgctggggctctcagtgc

SEQ ID NO: 854 - DNA, 355 bp, Homo sapiens
  CDS 110..355
  misc_feature 172: y=c or t
  misc_feature 259: k=g or t
  misc_feature 260: n=a, g, c or t
  misc_feature 298: n=a, g, c or t
  UNSURE 51: Xaa= *  or Gly or Arg
  UNSURE 63: Xaa=Asp or Glu
cttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgyggtacatttccaattgatttaaccaagacacggctccagattcaaggccagacgaatgatgcaaaatttaaggaaattagataccgkngaatgttgcacgcattagtgaggataggcagagaaganggggctgaaagcactctactcggggattgcccccgcgatgttacgccaggcatccta

SEQ ID NO: 855 - DNA, 317 bp, Homo sapiens
  CDS 16..315
  misc_feature 190: w=a or t
  misc_feature 191: r=a or g
  misc_feature 298: n=a, g, c or t
  UNSURE 59: Xaa= *  or Lys or Arg or Trp
  UNSURE 95: Xaa= *  or Gly or Arg
aacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgwrggagctgttgggaggacccaagccagattccagaatgcaggaattcttccagccaccgccacctcggcctcccaacccccaaaatgtcccctttagtcaacgcagtngaatgatgaaaaagccatc

SEQ ID NO: 856 - DNA, 469 bp, Homo sapiens
  CDS 98..469
  misc_feature 424: k=g or t
  misc_feature 438: n=a, g, c or t
  UNSURE 109: Xaa=Asp or Glu
  UNSURE 114: Xaa= *  or Leu or Ser or Trp
aattgggccgcgagttgtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgakgctatccagaaatngaaaattctttcccttcaatcctctagactt

SEQ ID NO: 857 - DNA, 385 bp, Homo sapiens
  CDS 125..385
  misc_feature 3: n=a, g, c or t
  misc_feature 7: y=c or t
ganagcyataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggag

SEQ ID NO: 858 - DNA, 371 bp, Homo sapiens
  CDS 126..371
tagagacgcggtgcgcacgcgcgtgagggatgtcgcggtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccag

SEQ ID NO: 859 - DNA, 424 bp, Homo sapiens
  CDS 192..422
gcacgcgcgtgagggatgtcgcggcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaagatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaag

SEQ ID NO: 860 - DNA, 323 bp, Homo sapiens
  CDS 53..322
  misc_feature 257: n=a, g, c or t
  misc_feature 319: n=a, g, c or t
  UNSURE 69: Xaa=Phe or Ile or Leu or Val
acaagcctcttgatgcataaaaacagctgggctcccttggagacagagcgccatgggaaaccgggtctgctgcggaggaagctggagctgcccatcaactttccagaagaaaaagaaaagaggaagccaaacaagacggacactgaagccgcagccacaacagctgcagcagaatctcccaaagggccatgaaacaacaggacatacgtatgaacgggtgttacagcagcaagggtctcaagagaggagtccaggcntcatgtcggaagacagcaacttacattatgctgacattcaagtgtgcagccgtccccatgcncggg

SEQ ID NO: 861 - DNA, 412 bp, Homo sapiens
  CDS 87..410
  misc_feature 268: n=a, g, c or t
  misc_feature 269: n=a, g, c or t
  misc_feature 270: r=a or g
  misc_feature 334: m=a or c
  misc_feature 373: r=a or g
  UNSURE 61: Xaa=His or Leu or Pro or Gln or Arg
  UNSURE 62: Xaa=Gly or Ser
  UNSURE 83: Xaa=Asn or Thr
  UNSURE 96: Xaa=Asn or Ser
aactttttgatttccttttccaagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacnnrgttcctgctttggactgagatggtttacaccagcgagtgaggtcccactctgtggccatgccamcctggcttctgcagctgtgctgtttcacaaaataaaaarcatgaatagcacgctcacgtttgtcactctgagtggaga

SEQ ID NO: 862 - DNA, 241 bp, Homo sapiens
  CDS 40..240
tgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaa

SEQ ID NO: 863 - DNA, 411 bp, Homo sapiens
  CDS 145..411
  misc_feature 390: n=a, g, c or t
  misc_feature 391: n=a, g, c or t
  UNSURE 83: Xaa=Phe or Ile or Leu or Val
gccgcggtcggagccatttcgccgattcctccatgcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcnnttggggtagcatctccgccc

SEQ ID NO: 864 - DNA, 457 bp, Homo sapiens
  CDS 41..457
  misc_feature 425: n=a, g, c or t
  UNSURE 129: Xaa=Leu or Met or Val
gaggcctgcctgaccgaccttcagcagggctgtggctaccatgttctctcgcgcgggtgtcgctgggctgtcggcctggaccttgcagccgcaatggattcaagttcgaaatatggcaactttgaaagatatcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttntgcttgttggaattggtgacctcttctccggg

SEQ ID NO: 865 - DNA, 422 bp, Homo sapiens
  CDS 147..422
  misc_feature 390: n=a, g, c or t
  UNSURE 82: Xaa=Leu or Met or Val
gaggcctgcctgaccgaccttcagcagggctgtggctaccatgttctctcgcgcgggtgtcgctgggctgtcggcctggaccttgcagccgcaatgtcaccaggagactaaagtccatcaaaaacatccagaaaattaccaagtctatgaaaatggtagcggcagcaaaatatgcccgagctgagagagagctgaaaccagctcgaatatatggattgggatctttagctctgtatgaaaaagctgatatcaaggggcctgaagacaagaagaaacacctccttattggtgtgtcctcagatcgaggactgtgtggtgctattcattcctccattgctaaacagatgaaaagcgaggttgctacactaacagcagctgggaaagaagttntgcttgttggaattggtgacctcttctccggg

SEQ ID NO: 866 - DNA, 330 bp, Homo sapiens
  CDS 155..328
aaaggaaagaactctatctaggaaacttagagaaactgacagccagttactgaaaactaaagatatcttgcaggcactgcagaaactttctgaagacaaaaaccttgcagaaagggaagaactcactcataaattatctattatcacaacaaaaatggacgcaaatgacaaaaaaatacaggaaaaggatcgtgagcttgaaattaaaaacatctatagtcatccaatacttaaaaatttacatgacacagaggactatccaaaagtttcttcaacaaaatcagtccaagcagacagaaaaattttgccattcacaagtatgagacacca

SEQ ID NO: 867 - DNA, 500 bp, Homo sapiens
  CDS 156..500
  misc_feature 32: r=a or g
  misc_feature 73: s=g or c
  misc_feature 228: m=a or c
  misc_feature 272: y=c or t
  UNSURE 25: Xaa=Pro or Thr
acagaggtgcgaccgggtcccggcctgagtcrcggccacccgcaggtctgagctgtgggctgaggcagcgcascgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttmcgttggttcgagagagtggctccttaacttatgaagaatttctygggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagca

SEQ ID NO: 868 - DNA, 420 bp, Homo sapiens
  CDS 6..419
aggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacc

SEQ ID NO: 869 - DNA, 352 bp, Homo sapiens
  CDS 6..350
  misc_feature 350: w=a or t
  misc_feature 351: r=a or g
  UNSURE 115: Xaa=His or Gln
aggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccawrg

SEQ ID NO: 870 - DNA, 307 bp, Homo sapiens
  CDS 133..306
aggggcttgtacggcaactggagcagttcagagttcaacaacaagcttccaagatgccgcccaaaggaaaaagtggttctggaaaagcggggaaaggtcagacacattctatgtgaaaaacatggcaaaatcatggaagccatggaaaagttaaagtctgggatgagattcaatgaagtggccgcacagtatagtgaagataaagccaggcaagggaggatgcagcaacaaggcaccatcttggaagcagagagcagccctcaccagataccaatcctgctggcaccttcatcttggactcttcagc

SEQ ID NO: 871 - DNA, 197 bp, Homo sapiens
  CDS 3..197
agatgttattccctccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaacgaagaaaagaaggagaaggggaagaaaagaaggg

SEQ ID NO: 872 - DNA, 449 bp, Homo sapiens
  CDS 75..449
aggtcccaatcctccgcttccgcgcttgcggccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaag

SEQ ID NO: 873 - DNA, 649 bp, Homo sapiens
  CDS 117..647
  misc_feature 97: n=a, g, c or t
  misc_feature 389: r=a or g
gtagaggcggagggaggggacacgggctcattgcggtgtgcgccctgcactctgtccctcactcgccgccgacgacctgtctcgccgagcgcacgcnttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaraacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacgg

SEQ ID NO: 874 - DNA, 652 bp, Homo sapiens
  CDS 19..651
ggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggcta

SEQ ID NO: 875 - DNA, 783 bp, Homo sapiens
  CDS 549..782
ggagacttcggggccaagatggcgacgggaacgggcaaacacaagctgctaagcactggccccacagagccatggtccatccgagagaagctatgtttagcatcttctgtcatgagaagtggcgatcaaaattgggggtggtcttactctgtcacccaggctggagtgcagtggcgcgatttgggctcactgcagcctcttgacttcctgggctcaagggatcctcctacctcagctgcccaagtagctgggaccacaggccgcaggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggcta

SEQ ID NO: 876 - DNA, 414 bp, Homo sapiens
  CDS 45..413
acaaggggcttgagcgttctgtggagagagtgcgaggtcaggccatgaacttgggagatggtttaaagcttgaaactgaattactggatggaaaaaccaagctaatattgtctccatatgaacataaatcaaaaatttctgtgaagatgggaaataaggccaagattgcaaaatgtcctttaagaacaaaaactgggcacattctaaaatcaacacaagatacttgtattgggagtgaaaaacttttgcaaaagaagccagttggttcagaaacatcacaggcaaaaggtgaaaaaaatggaatgactttttcatccactaaggatttatgtaaacaatgtatagataaagactgtcttcatatccagaaagagatttcacctgcaactcctaatatgcagaagactagaaaca

SEQ ID NO: 877 - DNA, 511 bp, Homo sapiens
  CDS 134..511
  misc_feature 485: s=g or c
  misc_feature 486: n=a, g, c or t
  UNSURE 118: Xaa=Ala or Asp or Gly or His or Leu or Pro or Arg or Val
agcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggasntggaaacatctttcaaaagcgaaga

SEQ ID NO: 878 - DNA, 435 bp, Homo sapiens
  CDS 167..433
  misc_feature 220: w=a or t
attactggactggactagaacactaagtcctgataagacacatcatttgcaatgagaatatattctgtttgtaagcctttctgatgtgccattattgctgctgtgtttcctgttttatgtaggtggtagccctcggagagtaccagatgggactgtggttactgtcatggcgggtaacgatgaaaattattctgctgagctccggaatgcctctgctgtwatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcct

SEQ ID NO: 879 - DNA, 312 bp, Homo sapiens
  CDS 147..311
  misc_feature 102: s=g or c
agtcgcagctgaccctcgctcccgcccccgcctggagtccgacgtggaagttgctggctgactgggcttgcgaggaaaccgcctcggagctgcagccgaagscaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacgg

SEQ ID NO: 880 - DNA, 370 bp, Homo sapiens
  CDS 25..369
  misc_feature 12: s=g or c
gcggatgacgastggctggataacatggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgc

SEQ ID NO: 881 - DNA, 449 bp, Homo sapiens
  CDS 200..448
  misc_feature 335: k=g or t
  misc_feature 416: w=a or t
  misc_feature 429: w=a or t
  UNSURE 46: Xaa=Asp or Tyr
  UNSURE 73: Xaa=Leu or Met
  UNSURE 77: Xaa=Phe or Tyr
ctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgakatgtgaccacaattctagatgatgcaaaaatttattcaagccatgctaagaaagctactgttgatgcagatgatgtgcgawtggcaatccagtwccgcgctgatcagtctttta

SEQ ID NO: 882 - DNA, 546 bp, Homo sapiens
  CDS 315..545
  misc_feature 198: w=a or t
  misc_feature 208: k=g or t
  misc_feature 310: n=a, g, c or t
ctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatawcatggagtckggcaagatggcgcctcccaagaacgctccgagagatgccttggtgatggcacagatcctgaaggatatgggaatcacagagtatgaaccaagggttataaantcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgc

SEQ ID NO: 883 - DNA, 297 bp, Homo sapiens
  CDS 105..296
acattggcaggtaacgagcggcggcggcggcagcgggtcttgggtcctccgagagcagcagcgattttctattttgtacatacattattttgtatatactgtatatgatgacttcagtgagcagtgaccattgtcgaggtgctcaggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacag

SEQ ID NO: 884 - DNA, 500 bp, Homo sapiens
  CDS 299..499
  misc_feature 170: s=g or c
  misc_feature 171: y=c or t
  misc_feature 229: s=g or c
  misc_feature 265: s=g or c
  misc_feature 266: s=g or c
gtcttccctctggagctgtttgaggaatgcagttcttttgcataagaaaggcttttctctccagtcattctgcttgctgatcaagaacacttaacagcttcaggctttcctgatactttgacgaaggtaattgggactcccatcaagtctccacacagctagcagccacsyggggcacttctccagcatatgtaagtggaactcagaaggcaacattccctgaacatastcttccaccagaatctcctctacagatttttgctgssccttttaccagtggctgaatctactttctcttatggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggtt

SEQ ID NO: 885 - DNA, 388 bp, Homo sapiens
  CDS 117..386
  misc_feature 4: w=a or t
agcwttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctc

SEQ ID NO: 886 - DNA, 466 bp, Homo sapiens
  CDS 133..465
aatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctgg

SEQ ID NO: 887 - DNA, 378 bp, Homo sapiens
  CDS 63..377
atacattttatatttaagtctgtgatccattttgagataatttttgtttcaggttgaggttgatgtttagtttgaggttcatttgtgtcaaacagaactctgtgtactggtgttcagttccaagggaaggctggcactccatggaggttagcaaaaaccatcattatgccaaccatcaggaatacgatccagacacttgtgcccgctgtatctcagtacgagagtctccaaggaaaacacaacacagtcaggtagtcgagggagcaatagttacacagagaagagacagagcaagatcagtttcagtagtgcgtatgggtcccctgtgtccaggggtccctcgtggctgcccgtacggggtggtctgcctacgagcac

SEQ ID NO: 888 - DNA, 429 bp, Homo sapiens
  CDS 199..429
acgcccccagagtcgtccggctgacgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagat

SEQ ID NO: 889 - DNA, 464 bp, Homo sapiens
  CDS 97..462
aaggcggctctcgtggaggcagtagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgg

SEQ ID NO: 890 - DNA, 399 bp, Homo sapiens
  CDS 179..397
  misc_feature 54: s=g or c
aaaaccagctctaggcggctctgggtaagttgtcgttctgtgggctgcggaacsagacttcggctggacttgcctgcggtgacacctgctcccctctgagagcttcaggttctccggcctgccttcactggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacagtgataattatgaagttttattcaatttggaggaacttaagttagaccagcccttcattgattgtatcagagt

SEQ ID NO: 891 - DNA, 451 bp, Homo sapiens
  CDS 217..450
  misc_feature 56: m=a or c
aaaaaccagctctaggcggctctgggtaagttgtcgttctgtgggctgcggaacgmgacttcggctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgatgtatcagagttgctccagatgaaaa

SEQ ID NO: 892 - DNA, 494 bp, Homo sapiens
  CDS 217..492
  misc_feature 393: n=a, g, c or t
  misc_feature 423: n=a, g, c or t
  misc_feature 461: m=a or c
  UNSURE 59: Xaa=Asp or Glu
  UNSURE 69: Xaa=Asp or Glu
  UNSURE 82: Xaa=Ala or Asp
gtgatctgaagccgacgtgtgcagaagtccctctcctccaggtaccagatccctgtttccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggaganccaggtgatgagggacaactggaagatganggaaaccaggaaaagcagggcaagtctgaaggtgaggmcaagccacaaagtgagggcaagccagcctccca

SEQ ID NO: 893 - DNA, 267 bp, Homo sapiens
  CDS 63..266
acacagcacgctgccacgccgacgcagacccctctctgcacgccagcccgcccgcacccaccatggccacagttcagcagctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctccca

SEQ ID NO: 894 - DNA, 454 bp, Homo sapiens
  CDS 65..454
  misc_feature 154: s=g or c
  misc_feature 155: s=g or c
  UNSURE 30: Xaa=Asp or Glu
  UNSURE 31: Xaa=Leu or Val
gggccctgctgcgggggggagagccactgacgccgggaccgggaccgccgccgccgccgccaccatgagtgatcagcagctggactgtgccttggacctaatgaggcgcctgcctccccagcaaatcgagaaaaacctcagcgacctgatcgasstggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctgga

SEQ ID NO: 895 - DNA, 331 bp, Homo sapiens
  CDS 36..329
ataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggatgacttttctcgtctagggggtgatgaagatggttatgaagaagaagaagatgagaacagtagacagtcggaagatgacgattcagagactgaaaaacctgaggctgatgacccaaaggataatacagaagcagaaaagcgagaccccca

SEQ ID NO: 896 - DNA, 220 bp, Homo sapiens
  CDS 36..218
ataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggattggtatctgatgcctatggggaggataccaatccgctatatccagccttgtcgctgccaccgcc

SEQ ID NO: 897 - DNA, 468 bp, Homo sapiens
  CDS 139..468
  misc_feature 4: w=a or t
  misc_feature 86: s=g or c
  misc_feature 440: k=g or t
  UNSURE 101: Xaa=Ile or Ser
cttwtttagcgccatctgctcgcggcgccgcctcctgctcctcccgctgctgctgccgctgccgccctgagtcactgcctgcgcastccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagtcatgakcttgaaaggaagtatgctgtctctatca

SEQ ID NO: 898 - DNA, 347 bp, Homo sapiens
  CDS 45..347
atcccgggcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggagatgaagtcttgctatgttgcccaggctggtctcgaactcatggcc

SEQ ID NO: 899 - DNA, 451 bp, Homo sapiens
  CDS 103..450
  misc_feature 97: r=a or g
  misc_feature 285: w=a or t
  misc_feature 390: r=a or g
  misc_feature 391: n=a, g, c or t
  misc_feature 404: n=a, g, c or t
  misc_feature 417: m=a or c
  misc_feature 422: r=a or g
  UNSURE 61: Xaa=Lys or Asn
  UNSURE 97: Xaa=Cys or Gly or Arg or Ser
  UNSURE 101: Xaa=Ile or Lys or Arg or Thr
  UNSURE 105: Xaa=Asp or Glu
  UNSURE 107: Xaa=Gln or Arg
acttccgggtctcctctgtttacgaatgtttgggcgcgaattactctaagcgcggctctcagaagggtgcaagaagaatcagtgcactgtgtttagrtcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaawcacggaaagacagcagccagcaagagaaaaacctggcaacctctgtcaaagagtaccagagaccatttgcaaactatgatggaatcagtaataatgacaattttrngtaacagtattanagaaaaagaagamatacrataccatctcaacttcctgaagaaaagat

SEQ ID NO: 900 - DNA, 422 bp, Homo sapiens
  CDS 37..420
  misc_feature 99: n=a, g, c or t
  misc_feature 301: r=a or g
  misc_feature 302: n=a, g, c or t
  misc_feature 303: n=a, g, c or t
  misc_feature 319: n=a, g, c or t
  misc_feature 376: r=a or g
  misc_feature 377: n=a, g, c or t
  UNSURE 89: Xaa=Ala or Asp or Glu or Gly or Ile or Lys or Met or Asn or Arg or Ser or Thr or Val
  UNSURE 95: Xaa=Ala or Pro or Ser or Thr
  UNSURE 114: Xaa=Ala or Asp or Gly or Ile or Asn or Ser or Thr or Val
cttggcgtggctgcaggggaggccgcggcggggaaaatggcggacgggaaggcgggagacgagaagcctgaaaagtcgcagcgagctggagccgccggnagacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcrnncttggatcaagtaagnctaaagaaactgttccaactcttgctccaaaaactctttcagtagcagcagcttttrntgaagatgaaggtagtgaaccagaggaaatgcctccagaagcaaa

SEQ ID NO: 901 - DNA, 340 bp, Homo sapiens
  CDS 94..339
  misc_feature 184: n=a, g, c or t
  misc_feature 185: m=a or c
  misc_feature 303: s=g or c
  UNSURE 31: Xaa=Ala or Asp or His or Asn or Pro or Ser or Thr or Tyr
  UNSURE 70: Xaa=Lys or Asn
agtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcaggtgggctcccgccccanmctggcccccgaggatttgggtcgaggcctggctttggtcgcctccattcgttgcgcctgccgagcctacgcagaccctagcggctcgggagcctgtcgtgcctgttacttgtgcgaascaaagggctttcctgatggggtcgcgcagtcccggag

SEQ ID NO: 902 - DNA, 447 bp, Homo sapiens
  CDS 94..447
  misc_feature 412: n=a, g, c or t
  UNSURE 107: Xaa=Phe or Ile or Leu or Val
agtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatatnttgattctgattccgaggatgaagacagagcagta

SEQ ID NO: 903 - DNA, 705 bp, Homo sapiens
  CDS 459..704
  misc_feature 637: n=a, g, c or t
  UNSURE 60: Xaa=Ala or Glu or Gly or Val
ttttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttggnacaggtgaccgaccaggtggaggtgaatgcccagaacagtgtgcctgacgaggaggccaagacaacca

SEQ ID NO: 904 - DNA, 333 bp, Homo sapiens
  CDS 76..333
gtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatcctcacgcaagcaacc

SEQ ID NO: 905 - DNA, 504 bp, Homo sapiens
  CDS 76..504
gtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaat

SEQ ID NO: 906 - DNA, 267 bp, Homo sapiens
  CDS 108..266
  misc_feature 162: n=a, g, c or t
  UNSURE 19: Xaa= *  or Glu or Lys or Gln
ataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgnaagaaaaacggagacgcaggagaagaacaccctgccgaccaaagagaccattgagcaggagaagcggagtgaaatttcctaagatcctggtcaatggtctcgtgc

SEQ ID NO: 907 - DNA, 283 bp, Homo sapiens
  CDS 108..281
ataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagagtgagtgtgcctcggtctcccgcgccccagcccagcccctcaccctgctcttccttgcaaacccactcctccaccc

SEQ ID NO: 908 - DNA, 511 bp, Homo sapiens
  CDS 109..510
gcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggcccttttgcagcccacggctatgg

SEQ ID NO: 909 - DNA, 388 bp, Homo sapiens
  CDS 109..387
  misc_feature 146: n=a, g, c or t
  misc_feature 189: s=g or c
  misc_feature 190: k=g or t
  misc_feature 271: r=a or g
  misc_feature 302: s=g or c
  UNSURE 13: Xaa=Ala or Asp or Gly or Val
  UNSURE 27: Xaa=His or Gln
  UNSURE 28: Xaa=Leu or Val
  UNSURE 55: Xaa=Ala or Thr
  UNSURE 65: Xaa=Ala or Gly
gcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgntcttgtcgcctccgaccgggtggccgccagcaatattgtccasktgaaggacggatatgaattgtctcccacggcagcagctaacttcacacgccgaaacctggctgactgtcttcggagtcggrccccatatcatgtgaacctcctcctggctgsctatgatgagcatgaagggccagcgctgtattacatggactacctggcagccttggccaaggcccttttgcagcccacggctatgg

SEQ ID NO: 910 - DNA, 681 bp, Homo sapiens
  CDS 518..679
  misc_feature 12: y=c or t
  misc_feature 412: n=a, g, c or t
atttcttccacyaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcagaataacggtcctgcctcccgacactcttggcgaggtttttgtacagtttgctccgggagctgtttcttcgcttccacctttttctcccccacacttcgcggcttcttcatgctttttcttctcanccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaggaaccgaggcgg

SEQ ID NO: 911 - DNA, 478 bp, Homo sapiens
  CDS 79..477
aggttgcgtttccttcctgtgtgaggccggctgagggcacttgctcttgctgtttctgcccctgggttaacattcaagatggtacatgctgaagccttttctcgtcctttgagtcggaatgaagttgttggtttaattttccgtttgacaatatttggtgcagtgacatactttactatcaaatggatggtagatgcaattgatccaaccagaaagcaaaaagtagaagctcagaaacaggcagaaaaactaatgaagcaaattggagtgaaaaatgtgaagctctcagaatatgaaatgagtattgctgctcatcttgtagaccctcttaatatgcatgttacttggagtgatatagcaggtttagatgatgtcattacggatctgaaagacacagtcatcttacctatcaaaaagaaacatttgtttgagaattccaggcttctgcagcctccaaaaggtgttcttctctatgggc

SEQ ID NO: 912 - DNA, 470 bp, Homo sapiens
  CDS 168..470
atttttatttttctcctcttccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtc

SEQ ID NO: 913 - DNA, 308 bp, Homo sapiens
  CDS 112..306
  misc_feature 46: s=g or c
  misc_feature 107: s=g or c
  misc_feature 161: n=a, g, c or t
  misc_feature 288: k=g or t
  misc_feature 303: y=c or t
  misc_feature 304: w=a or t
  misc_feature 305: y=c or t
  misc_feature 306: k=g or t
  UNSURE 17: Xaa=Ile or Asn or Ser or Thr
  UNSURE 65: Xaa=Phe or Ile or Leu or Met or Ser or Thr
accgccgctgccggcgccgctgctgtaggggaccagcgcgggtgcscagacgaaaggcgctctttgccagctgaaagttccacggaaaaactaccatctcccctgcscaccatggcagacgaaattgatttcactactggagatgccggggcttccagcanttaccctatgcagtgctcggccttgcgcaaaaacggcttcgtggtgctcaaaggacgaccatgcaaaatagtggagatgtcaacttccaaaactggaaagcatggtcatgccaaggttcaccttgtkggaattgatattttywykga

SEQ ID NO: 914 - DNA, 465 bp, Homo sapiens
  CDS 125..463
acattaacgcacacatcagttccaggccccattccattctctgaacatcttctgacacactgacagtgctgagcagagcaagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcgg

SEQ ID NO: 915 - DNA, 393 bp, Homo sapiens
  CDS 91..393
gcacgccgccttcgccgctggctccgtctgttggggggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcag

SEQ ID NO: 916 - DNA, 458 bp, Homo sapiens
  CDS 156..458
  misc_feature 73: s=g or c
gcacgccgccttcgccgctggctccgtctgttggggggcgaacacgccgcggtcctcgtcgtggtgagcgcascactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcag

SEQ ID NO: 917 - DNA, 449 bp, Homo sapiens
  CDS 100..447
acgtttcgcttccgcctacctcgcccaggctgccagaccggaagcgctccgctgtacctggatcctgctcctctgggttgaaacccgggcgccgccaagatgccggcttaccactcttctctcatggatcctgataccaaactcatcggaaacatggcactgttgcctatcagaagtcaattcaaaggacctgcccccagagagacaaaagatacagatattgtggatgaagccatctattacttcaaggccaatgtcttcttcaaaaactatgaaattaagaatgaagctgataggaccttgatatatataactctctacatttctgaatgtctgaagaaactgcaaaagtgcaattccaaaagccaaggtgagaaagaaatgtatacgctgggaatcactaattttcccattcctggagagcctggttttccacttaacgcaattta

SEQ ID NO: 918 - DNA, 353 bp, Homo sapiens
  CDS 52..351
atgtctgcgcccgcgatccgaccggaagttgcacgctgagccgcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgattactgg

SEQ ID NO: 919 - DNA, 449 bp, Homo sapiens
  CDS 246..449
  misc_feature 423: r=a or g
  UNSURE 60: Xaa=Asp or Asn
ggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcaggagtctcactctgtcatccagactggagtgcagtggcgtgatcacagctcaccacaacctccgcctacaggagatattttgatacaggatctcactctattccccaggctagagtgcgatggcaccatctcggctgattgcracctccattttccaggaaggctcttt

SEQ ID NO: 920 - DNA, 425 bp, Homo sapiens
  CDS 246..425
  misc_feature 58: r=a or g
  misc_feature 354: n=a, g, c or t
  UNSURE 37: Xaa= *  or Glu or Lys or Gln
ggtggcggccattttgattggtgttggatttatttgtaggagaggctcctgagcgctrggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagatcctgcactggatggatcagcggacaacacacagaccggtaatctgggtcaatcagttctgccatcccaccnagaacagaaaacagcatgaaaaactcactttaaccccctatgaatccatctccaaccagactgatcagcac

SEQ ID NO: 921 - DNA, 445 bp, Homo sapiens
  CDS 246..443
ggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcaggagtctcgctctgtcatccagactggagtgcagtggcgtgatcacagctcaccacaacctccgcctacaggagatattttgatacagcagcttcttcttggcacaatcctgaactgggcagaacgtccttcccaaactcgcggaagacaaatggctcctgtgac

SEQ ID NO: 922 - DNA, 258 bp, Homo sapiens
  CDS 29..256
  misc_feature 122: m=a or c
  misc_feature 130: m=a or c
  misc_feature 131: s=g or c
  misc_feature 133: n=a, g, c or t
  misc_feature 139: m=a or c
  misc_feature 140: m=a or c
  misc_feature 151: m=a or c
  misc_feature 152: m=a or c
  UNSURE 32: Xaa=Lys or Gln
  UNSURE 34: Xaa=Lys or Asn
  UNSURE 35: Xaa=Asp or Glu or His or Gln
  UNSURE 37: Xaa=Lys or Asn
  UNSURE 38: Xaa=His or Asn
  UNSURE 42: Xaa=Arg or Ser
atttttggcctgtcaggtccatccggcgatgctgggtctggacgagctcgggaggagtggttgtggccattgcacacaggcggatctgaggttcggcgacgccgctggtcgcgacccgggamaggacaamsancagaammaccgccgagcmmgcgttccccccccgcccagagtcatggcggcagcagccgctctgagggcgcctgctcaggttgttggcatggaggggaagatgaggcagcaccttctaagcagagc

SEQ ID NO: 923 - DNA, 428 bp, Homo sapiens
  CDS 41..427
  misc_feature 357: w=a or t
  misc_feature 360: m=a or c
  misc_feature 397: n=a, g, c or t
  UNSURE 106: Xaa=Glu or Val
  UNSURE 107: Xaa=Lys or Thr
ttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggwgamaattcctttgcagatggaggagctcagtactgcagtntattcaaatgatgacttatttatttctaagg

SEQ ID NO: 924 - DNA, 507 bp, Homo sapiens
  CDS 100..507
  misc_feature 407: r=a or g
  UNSURE 103: Xaa=Glu or Gly
ccttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagraggggagagtcggctcaatctggtgcagagaaatgttaatgtcttcaaattcattattcctcagatcgtcaagtacagtcctgattgcatcataattgtg

SEQ ID NO: 925 - DNA, 336 bp, Homo sapiens
  CDS 100..336
  misc_feature 147: k=g or t
  UNSURE 16: Xaa=Asp or Glu
ccttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagakgcaacagttccaaacaataagatcactgtagtgggtgttggacaagttggtatggcgtgtgctatcagcattctgggaaaggtacatttcaagaacaccatagatgatagagaagttcagcatgtgtacacagtttctttgggcaccttggaattttattatatctttaaaagatttctttttttcctg

SEQ ID NO: 926 - DNA, 567 bp, Homo sapiens
  CDS 151..567
aaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgag

SEQ ID NO: 927 - DNA, 386 bp, Homo sapiens
  CDS 18..386
  misc_feature 368: r=a or g
actagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcaggtaaaragtggcttctattccctc

SEQ ID NO: 928 - DNA, 615 bp, Homo sapiens
  CDS 91..615
  misc_feature 553: m=a or c
  UNSURE 155: Xaa=Ile or Leu
ctttcttttcagtcgggcgctgagtggtttttcggatcatgtctggtggctccgcggattataagcagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgatgtgattgctcaagctcagtcaggtactggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacmtttctccaaaatggatcaaaatgtttgttttggatgaagcagatgaaatgttgagccgtggt

SEQ ID NO: 929 - DNA, 378 bp, Homo sapiens
  CDS 184..378
  misc_feature 316: m=a or c
  UNSURE 45: Xaa=Ile or Leu
ctttcttttcagtcgggcgctgagtggtttttcggatcatgtctggtggctccgcggattataacagcagaacatggcggcccagagggaatggaccccgatggtgtcatcgaggtaagaaacggttgtggatcttgaagctttggaaagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacmtttctccaaaatggatcaaaatgtttgttttggatgaagcagatgaaatgttgagccgtggt

SEQ ID NO: 930 - DNA, 203 bp, Homo sapiens
  CDS 17..202
ctagtttctaaggatcatgtctgcgagccaggattcccggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgagatccagagacaatggc

SEQ ID NO: 931 - DNA, 388 bp, Homo sapiens
  CDS 233..388
  misc_feature 168: s=g or c
  misc_feature 376: m=a or c
  UNSURE 48: Xaa=Asp or Glu
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaasctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagamaacaagcgcaaa

SEQ ID NO: 932 - DNA, 375 bp, Homo sapiens
  CDS 175..375
  misc_feature 207: k=g or t
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgtkgttcccagcgctctgcgaacgctgaaaaggaggagcaacctgtccagaatccccgcaggacaggaaaaggaggggaaatctcgacatgttgctcccccttttcgctttttccctttttccggttttttgttttttggttttctttttcccgtcttttctttcccctcc

SEQ ID NO: 933 - DNA, 447 bp, Homo sapiens
  CDS 292..447
  misc_feature 227: s=g or c
  misc_feature 333: n=a, g, c or t
  misc_feature 435: m=a or c
  UNSURE 14: Xaa=Lys or Asn
  UNSURE 48: Xaa=Asp or Glu
gtgctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaasctgaaaaggaggagcaacctgtccagaatccccgcaggacaggaaaaggaggggaaatctcgacatggaaaaactctacagtgaaaatgaaggaatggcttcaaancaaggaaagatggaaaatgaagaacagccacaagacgagagaaagccagaagtaacttgtactctggaagacaagaagttagaaaacgagggaaagacagamaacaagcgcaaa

SEQ ID NO: 934 - DNA, 244 bp, Homo sapiens
  CDS 23..244
tacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccag

SEQ ID NO: 935 - DNA, 424 bp, Homo sapiens
  CDS 119..424
attcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaattt

SEQ ID NO: 936 - DNA, 366 bp, Homo sapiens
  CDS 37..366
  misc_feature 8: n=a, g, c or t
  misc_feature 9: n=a, g, c or t
  misc_feature 317: n=a, g, c or t
  misc_feature 318: k=g or t
  UNSURE 94: Xaa=His or Leu or Pro or Gln or Arg
aagtcgtnncgggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggagaagagcatctttctcgtggcccacaggaaagatcctacaggaatggatcctgatgatatttggcagctgtcctccagtcnkaaaaggtttgatgacaaatacaccttgaagctgaccttcatcagtagg

SEQ ID NO: 937 - DNA, 605 bp, Homo sapiens
  CDS 177..605
  misc_feature 8: n=a, g, c or t
  misc_feature 9: n=a, g, c or t
  misc_feature 49: s=g or c
  misc_feature 199: n=a, g, c or t
  UNSURE 8: Xaa=Ala or Asp or Gly or Val
aagtcgtnncgggagggagacgcagaggcggacaagatggcggcggcastgtacagggcgggagaagcggtggtagcggaggctgtagtggggctggtggtgcttccaactgcgggacaggaagtggccgtagcggcttgttggataagtggaagatagatgataagcctgtaaaaatggacaagatggcggcggcagntgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatcttt

SEQ ID NO: 938 - DNA, 456 bp, Homo sapiens
  CDS 37..456
  misc_feature 8: n=a, g, c or t
  misc_feature 9: n=a, g, c or t
aagtcgtnncgggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatcttt

SEQ ID NO: 939 - DNA, 472 bp, Homo sapiens
  CDS 131..472
  misc_feature 6: s=g or c
  misc_feature 7: n=a, g, c or t
  misc_feature 292: y=c or t
  misc_feature 435: n=a, g, c or t
  misc_feature 456: s=g or c
  UNSURE 102: Xaa=Ala or Glu or Gly or Val
  UNSURE 109: Xaa=Ser or Thr
aaaggsnagggcctgactaaacctggagactcgggtggccgaggggcttcataccagctgaagagcgacaagccgctggcagccgcggatctcaccgccgctcagggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaacaaggtagttaacctgcagtacagygaagttcaagatcgggtcatgctcactggccgccacatggttcgagatgtgagctgcaaaaactgcaatagcaaactgggatggatctatgagtttgccactgaagacagccagcgatataaggaaggccgcgtgatcctggnacgtgctctagttcgagagastgagggcttgaggagc

SEQ ID NO: 940 - DNA, 444 bp, Homo sapiens
  CDS 90..443
  misc_feature 44: s=g or c
  misc_feature 60: s=g or c
gttcttggaaggcggtgctctgagaagccggactacgcggcagsgctcttcaaagcggascgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttg

SEQ ID NO: 941 - DNA, 400 bp, Homo sapiens
  CDS 202..399
  misc_feature 386: m=a or c
  UNSURE 62: Xaa=Lys or Thr
cccttcctctggcgtccaaggtgatatcgcgcgaggttcgcagccaataaggaggcggatgtgacggcccgtttgcagccgccggcagctactgcaaggcaaaagccggagtggacgtgtcttttgaaactgctgctctttcacttctcaggcgtcaccgagagctcagcacccaggctgaactctgtaccatttggaagaatggaagctgatgcatctgttgacatgttttccaaagtcctggagcatcagctgcttcagactaccaaactggtggaagaacatttggattctgaaattcaaaaactggatcagatggatgaggatgaattggaacgccttaaagaaaagagactccaggcactaaggaaagctcaacagcagamacaagaatggcttt

SEQ ID NO: 942 - DNA, 401 bp, Homo sapiens
  CDS 32..400
gtttccggtgttgtgactgaaacccgtcaatatggcggcgatcggccgcggccgctctctgaagaacctccgagtacgagggcggaatgacagcggcgaggagaacgtcccgctggatctgacccgagaaccttctgataacttaagagagattctccaaaatgtggccagattgcagggagtatcaaatatgagaaagctaggccatctgaataactttactaagcttctttgtgatattggccacagtgaagaaaaactgggctttcactatgaggatatcataatttgtttgcggttagctttattaaatgaagcaaaagaagtgcgagcagcagggctacgagcgcttcgatatctcatccaagactccagtattctccagaaggtgctaaaattga

SEQ ID NO: 943 - DNA, 448 bp, Homo sapiens
  CDS 30..446
  misc_feature 36: r=a or g
  UNSURE 3: Xaa=Ile or Val
cacttggcgagtgagacgctgatgggaggatggacrtactggtgtctgagtgctccgcgcggctgctgcagcaggaagaagagattaaatctctgactgctgaaattgaccggttgaaaaactgtggctgtttaggagcttctccaaatttggagcagttacaagaagaaaatttaaaattaaagtatcgactgaatattcttcgaaagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcagatgctcaaaaccaaggaacagaaagttaatccaagagaaattgctgaaaa

SEQ ID NO: 944 - DNA, 391 bp, Homo sapiens
  CDS 95..391
acaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacct

SEQ ID NO: 945 - DNA, 371 bp, Homo sapiens
  CDS 26..370
  misc_feature 23: r=a or g
  misc_feature 83: s=g or c
  UNSURE 20: Xaa=Asp or His
aagtcggcggtcggcgtggggcrctatgccggggcggcacgtttctcgagtccgggcattgtacaagcgcgtcttgcagctgsaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaattta

SEQ ID NO: 946 - DNA, 376 bp, Homo sapiens
  CDS 152..376
  misc_feature 324: m=a or c
  misc_feature 354: n=a, g, c or t
  UNSURE 58: Xaa=Lys or Thr
  UNSURE 68: Xaa=Ile or Asn or Ser or Thr
aagaccttgccagactgcctgctttcatggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggcccctccaggggaatttgtaaatgcctttgatgatctctgtctgcttatccgtgatgaaaaacttatgcaccaccaaggtgagtgtgcaggccaccaacactgccaaamatattctgtaccactctgcatcgatggaantccagtactcttgtctcaccac

SEQ ID NO: 947 - DNA, 469 bp, Homo sapiens
  CDS 42..467
atttttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaa

SEQ ID NO: 948 - DNA, 473 bp, Homo sapiens
  CDS 15..473
  misc_feature 5: n=a, g, c or t
gatcngcggccgccatgttaggagcgcagtggcggcgcaaccagccttctagggcggcggaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatg

SEQ ID NO: 949 - DNA, 637 bp, Homo sapiens
  CDS 338..637
  misc_feature 207: m=a or c
aaatgaacggcggcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagamaggctgaaggggatgctaagggagataaagcaaaggtgaaggacgaaccacagagaagatccgcgaggttgtctgtggttcgtccttcacctttgctttatctcccttagcatccccagacgcggagaaaatggcggcaggggtcgaagcggcggcggaggtggcggcgacggagatcaaaatggaggaagagagcggcgcgcccggcgtgccgagcggcaacggggctccgggccctaagggtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaagttggtgaggtaacatac

SEQ ID NO: 950 - DNA, 468 bp, Homo sapiens
  CDS 213..467
  misc_feature 445: r=a or g
  UNSURE 78: Xaa=Glu or Gly
ggttcctcttgggtccttccggcgtcgcggagtgaattgatccgggagttgaagagggctgcaaggtgggaagtgaagtcagtgcctcagttgctgatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggrgtcccttcttcgtatggcagctg

SEQ ID NO: 951 - DNA, 542 bp, Homo sapiens
  CDS 287..541
  misc_feature 519: r=a or g
  UNSURE 78: Xaa=Glu or Gly
ggttcctcttgggtccttccggcgtcgccggagtgaattgatccgggagttgaagagggctgcaaggtgggaagtgaagtcagtgcctcagttgctgctttctcctctaaatcttggtctcttgtttggaagtgactaacagcattttggcatgagaaagccctaaaaagatcagtgtgttttttgtgtccaattcttttatcaccaaaaaagagaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggrgtcccttcttcgtatggcagctg

SEQ ID NO: 952 - DNA, 392 bp, Homo sapiens
  CDS 147..392
  misc_feature 170: r=a or g
  misc_feature 349: w=a or t
  misc_feature 350: r=a or g
  UNSURE 68: Xaa=Glu or Val
ctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaagatttgatgaraaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagwrttactcttttttagacaaagagaagggcctttttatccaacc

SEQ ID NO: 953 - DNA, 547 bp, Homo sapiens
  CDS 266..547
  misc_feature 110: w=a or t
  misc_feature 120: y=c or t
  misc_feature 124: y=c or t
  misc_feature 127: w=a or t
  misc_feature 128: s=g or c
  misc_feature 131: n=a, g, c or t
ctttcagctacctccaactgctgaggaaccggttgcctaaaaggagccggcaaaagcgcctacgtggagtccagaggagcggaagtagtcagatttgactgagagccgtwaagcgcggcygggytcwsgtntttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacac

SEQ ID NO: 954 - DNA, 526 bp, Homo sapiens
  CDS 227..526
  misc_feature 29: m=a or c
  misc_feature 161: r=a or g
  misc_feature 166: m=a or c
  misc_feature 167: m=a or c
  misc_feature 427: k=g or t
  UNSURE 67: Xaa=Asp or Glu
atttaactcatttatagagggcatctgtmggttgcatttgatttatttaaaacgttttcttacatggccaatttagtaacagcaagcaaaaccaaaatgagcaaaggagaggatcccaataatcccagatctataaagcggatttctcaagggggtagagrtaacmmcctagctattgctaaatgtgatctcactcagttgaaaaagaaacaatcagaagtgagcaatgggagccgtgaaacccatctcaatgaagacttgttgccaacatggagatagaggatattggtctacagggtactattggagagggggtcctgatgacaacttaattgaaggtggaggaacaaaatttgtctgcaaacctggagccagaaacattaccgtcatattccacccattactaagatttattcaggagattgakcatgctctgggtcttggcccagccaaacagtgtcctcttcgagagtttctcaccgtgtacatcaaaaacatctttctcaatcaagtcttggctgagatc

SEQ ID NO: 955 - DNA, 552 bp, Homo sapiens
  CDS 263..550
  misc_feature 155: s=g or c
  misc_feature 525: r=a or g
  UNSURE 88: Xaa=Asp or Gly
aaaatagtctccatcggccattttgtgcgagaagccgcagcgccgcctcttctctcgcgccctcgcctcttcctccgcctcctccttcgcctcttcctgcctcctcccggcttccgccgccgccactccagcctaatcccaaccccagggcgaasgttttcttatttatttccgttttctcgccactacagcctcctgacaaggtgatccgggcgggccccgcaggaattttatcccctcaccggcctcacactagtatcgcatgtccactatccagaacctccaatctttcgacccctttgctgatgcaactaagggtgacgacttactcccggcagggactgaggattacattcatataagaatccagcaacggaacggcagaaagacactgactactgttcagggcattgcagatgattatgacaaaaagaaacttgtgaaagctttcaaaaagaaatttgcctgtaatggtactgtgattgaacatcctgaatacggagaggttattcagcttcaaggtgrccaaagaaaaacatctgccagtttctc

SEQ ID NO: 956 - DNA, 379 bp, Homo sapiens
  CDS 78..377
  misc_feature 218: r=a or g
aagactgcgtgcagaaggtgactgtctcagtggagctgggtcatctcaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccrgagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagac

SEQ ID NO: 957 - DNA, 422 bp, Homo sapiens
  CDS 117..422
  misc_feature 14: r=a or g
  misc_feature 19: r=a or g
  misc_feature 71: s=g or c
  misc_feature 413: m=a or c
  UNSURE 99: Xaa=Asp or Glu
atttcaagaagtcratcaraaagaaagccccagcgctctagagctcagctgacgggaaagggggtgcgcasctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgcccttaaccgcaaagaagggttgcgtttagcagaggaccggagcaaggamcctcacgac

SEQ ID NO: 958 - DNA, 389 bp, Homo sapiens
  CDS 62..388
ccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgtttccttggtgctcccacagaccctgaccaatcataacacccatctcactgaatcactatcta

SEQ ID NO: 959 - DNA, 434 bp, Homo sapiens
  CDS 254..433
  misc_feature 173: r=a or g
gcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttaattcccgtactrattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggaaccctggcactggcccagcagcctcttctctg

SEQ ID NO: 960 - DNA, 480 bp, Homo sapiens
  CDS 192..479
  misc_feature 107: r=a or g
  misc_feature 143: s=g or c
  misc_feature 145: s=g or c
  misc_feature 149: r=a or g
  misc_feature 184: s=g or c
  misc_feature 187: y=c or t
  misc_feature 188: r=a or g
  misc_feature 196: y=c or t
  misc_feature 371: r=a or g
  misc_feature 401: r=a or g
  misc_feature 438: r=a or g
  misc_feature 446: y=c or t
  UNSURE 2: Xaa=Ala or Val
  UNSURE 83: Xaa=Met or Val
agtttcatattactctaaatccattacaaatctgcttagcttctaaatatttcatcaatgaggaaatcccagccctacaacttcggaacagtgaaatattagtccarggatccagtgagagacacagaagtgctagaagccastsctcrtgaactaaggagaaaaagaacagacaagggaacasccyrgacatggyatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggraagaaaaagggcttctctctgggctccacrgtgcagtctcacactaaaggaatctggatgtggtgtrtgccccaycccaagaagccaggccacatcctagttctgctgg

SEQ ID NO: 961 - DNA, 504 bp, Homo sapiens
  CDS 132..503
aaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaag

SEQ ID NO: 962 - DNA, 315 bp, Homo sapiens
  CDS 20..313
ccttttggtacgctccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccc

SEQ ID NO: 963 - DNA, 341 bp, Homo sapiens
  CDS 18..341
  misc_feature 241: m=a or c
  misc_feature 247: w=a or t
  misc_feature 256: m=a or c
  misc_feature 290: m=a or c
  misc_feature 311: s=g or c
  misc_feature 312: r=a or g
  UNSURE 75: Xaa=Ala or Glu
  UNSURE 77: Xaa=Ile or Asn
  UNSURE 80: Xaa=Lys or Thr
  UNSURE 98: Xaa=His or Gln
  UNSURE 99: Xaa=Ala or Thr
aagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggmaaggawcctaaagamggcatccaaaacccacaagcagaagagtggaggmcttcaacagacacctggacasrctcacggagcattacgacattcccaaagt

SEQ ID NO: 964 - DNA, 363 bp, Homo sapiens
  CDS 77..361
  misc_feature 15: r=a or g
actccttggctggargcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaaggcagaggatctactacctgtctttagagttctatatgggacgga

SEQ ID NO: 965 - DNA, 475 bp, Homo sapiens
  CDS 145..474
aagtctggtccaacagctgacaggggtggcagccaactgcaggtgcccaagaacttggcacttctcagttccatctaaaggggcacatctcccttctgggtgtcacgttttcagccaaacatctaaaagaacttcatcatcaagatgtctgatgatattgactggttacgcagccacaggggtgtgtgcaaggtagatctctacaacccagaaggacagcaagatcaggaccggaaagtgatatgctttgtcgatgtgtccaccctgaatgtagaagataaagattacaaggatgctgctagttccagctcagaaggcaacttaaacctgggaagtctggaagaaaaagagattatcgtgatcaaggacactgagaagaaagaccagtctaagacagagggatctgtatgccttttcaaacaagctccctctgatcctgtaagtgtcctcaactggcttctcagtgatctccaga

SEQ ID NO: 966 - DNA, 281 bp, Homo sapiens
  CDS 63..281
gtttgtttgttaaattacgaccgtcgtaaactagaattttcttgcggcttcttagctttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaa

SEQ ID NO: 967 - DNA, 935 bp, Homo sapiens
  CDS 406..933
  misc_feature 851: w=a or t
  UNSURE 149: Xaa=Phe or Tyr
actactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgtwccatgcgatgttttacggagaacttgcagaggacaaagatgaaatccgtataccagatgtcgaacctgctgcttttctcgctat

SEQ ID NO: 968 - DNA, 233 bp, Homo sapiens
  CDS 34..231
ggcggactgcggcgcacttccgtagaggtggacatggcgtgcggctttcgccgcgctattgcttgccagctttccagagtgttgaatcttccaccagaaaacttgatcacatcaatatctgcagttccaatttcccaaaaagaagaagtagctgattttcagctttctgtggattctttattggaaaaagacaatgaccattcaagaccagatattcaagttcaagccaagag

SEQ ID NO: 969 - DNA, 589 bp, Homo sapiens
  CDS 80..589
  misc_feature 439: k=g or t
  misc_feature 440: y=c or t
  UNSURE 120: Xaa=His or Gln
gagagaagcgagatttattcctacgtaccgggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcakytggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaa

SEQ ID NO: 970 - DNA, 976 bp, Homo sapiens
  CDS 467..976
  misc_feature 826: k=g or t
  misc_feature 827: y=c or t
  UNSURE 120: Xaa=His or Gln
gagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcakytggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaa

SEQ ID NO: 971 - DNA, 332 bp, Homo sapiens
  CDS 180..332
ataagcgtcaccctcttttcagcactggaagctgagggttttgacagcggcaggccacataggcaaggaagctggtgcatgcagtgtctctgggcaaggttatgcaaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccac

SEQ ID NO: 972 - DNA, 515 bp, Homo sapiens
  CDS 30..515
  misc_feature 411: r=a or g
  UNSURE 128: Xaa=Gly or Arg
agggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcgrggtgcaggcagattcaagacctggagctctcgtctgtggaggtggatccctgtggagacgctcaggctgctgcggagggagcggtgcttggtctctatgaatac

SEQ ID NO: 973 - DNA, 461 bp, Homo sapiens
  CDS 66..461
gtgacccacttccgttacttgctgcggaggaccgtgggcagccagggtcggtgaaggatcccaaaatggctgggcgaaaacttgctctaaaaaccattgactgggtagcttttgcagagatcataccccagaaccaaaaggccattgctagttccctgaaatcctggaatgagaccctcacctccaggttggctgctttacctgagaatccaccagctatcgactgggcttactacaaggccaatgtggccaaggctggcttggtggatgactttgagaagaagtttaatgcgctgaaggttcccgtgccagaggataaatatactgcccaggtggatgccgaagaaaaagaagatgtgaaatcttgtgctgagtgggtgtctctctcaaaggccaggattgtagaatatgagaaagagatggagaagatgaagaacttaattccatttgatcagatgacc

SEQ ID NO: 974 - DNA, 557 bp, Homo sapiens
  CDS 181..555
  misc_feature 57: s=g or c
  misc_feature 323: n=a, g, c or t
  misc_feature 369: r=a or g
  UNSURE 48: Xaa=Lys or Met or Arg or Thr
acctcgggagctggcggctgagctgccaggagcccagcccagctgaatcgagcggascggtggagcaggggccttgtgggtacccggttgggcagggagaggtgcggctctgcgacggaaacaatcgccagagatgccggggctagccttccccaccagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagangaaaaagaaggaccgattttaccgatccattttacctggagataaracaaataaaaagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcagctgttctggat

SEQ ID NO: 975 - DNA, 492 bp, Homo sapiens
  CDS 204..491
  misc_feature 466: n=a, g, c or t
  UNSURE 88: Xaa=Ala or Asp or Gly or Val
aattttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagnccagaacctgcaggagctggagaaag

SEQ ID NO: 976 - DNA, 537 bp, Homo sapiens
  CDS 208..537
ctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccg

SEQ ID NO: 977 - DNA, 334 bp, Homo sapiens
  CDS 79..333
ataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatagac

SEQ ID NO: 978 - DNA, 535 bp, Homo sapiens
  CDS 122..535
  misc_feature 90: s=g or c
aaaagggtgactctttcctgtcccggcctgcgtggtgtgggcttgtgggtctttgagacccgaaaattgagagcgttttcgcactccagsggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaaca

SEQ ID NO: 979 - DNA, 648 bp, Homo sapiens
  CDS 377..646
  misc_feature 304: k=g or t
  misc_feature 338: n=a, g, c or t
agaaaggcggaaccagtgtcccaggcgttctcacgcccgcaacaattcctgagtagggccttgcttgagttcttcggaaagtctcatccacccccacatcgcctctttaggaagtcacttaatgttgggcttcattattcccacatccctttccttactacttgcctgcacttcttgagaaaaagactgcagaaaggagaggtggggctttcagtagaaacaagcaaaccgcagtccctgtggggggactctccaggaagaagggtaatttcctgcctccttaaattggctgctactgtcagtkattttgctcccaaccccagagcttcacttgctcnttcacttcccagttccgcaagaaccgtgggcgacagttatggagaagcgtctgcaggaggctcagctgtacaaggaggaagggaaccagcgctaccgggaagggaagtaccgagatgctgtgagtaggtaccatcgagctctgcttcagctgcggggtctggatccgagtctgccctctccgttacctaatctcggacctcagggcccggccctcacgcctgaacaagaaaacatattgcataccacccagacagactgctataacaatctagctgcttgtctccttcagatggagcccgtgaactacga

SEQ ID NO: 980 - DNA, 372 bp, Homo sapiens
  CDS 106..372
  misc_feature 257: m=a or c
  misc_feature 343: m=a or c
  UNSURE 51: Xaa=Lys or Thr
  UNSURE 80: Xaa=Pro or Thr
agcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattamaaagcaggcagagaggtcactaccttcagcccacacctccacacccgcatctgcctccccaatggctgtcagttcggtaaagtcamcctctccttctactctggtattaccacga

SEQ ID NO: 981 - DNA, 405 bp, Homo sapiens
  CDS 110..403
acaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatct

SEQ ID NO: 982 - DNA, 466 bp, Homo sapiens
  CDS 36..464
cttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttat

SEQ ID NO: 983 - DNA, 532 bp, Homo sapiens
  CDS 300..530
  misc_feature 174: k=g or t
  misc_feature 386: y=c or t
ttcatttccgctagaaggcttggatcttcagccatttcttgctaaggatagtccagctcaaattgtgacatatgatcttctgtcagtcatttgccatcatggaactgcaagtagtggacactatataagcctactgccgaaacaatctaaataatctctggtatgaatttgatkatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaayaatgactttctttgtattcatggaggtgttcctccaagaaaagctggttatattgaagacctggttttgatgctgcctcagaacatttgggataacctatatagcaggtatggtggaggaccagctgtcaccatctgtacatttgt

SEQ ID NO: 984 - DNA, 270 bp, Homo sapiens
  CDS 66..269
tgtgatctggagccaccttctgtttctaaccatcagtttccttccctgaaaatggggaagtggggatgataattcttattctgcctcactgcagggtagtcaaaaagagcgtaattagtgagccccagggccttttgtatatggattgggggagaagggctaccatcttttccattgccagggagctgccctgtctgtctccaaggaatccagccacgagacagagtacccacaggccaggccctgggctgaaatttccaccacacccag

SEQ ID NO: 985 - DNA, 489 bp, Homo sapiens
  CDS 82..489
  misc_feature 273: n=a, g, c or t
  misc_feature 274: k=g or t
  UNSURE 64: Xaa=Phe or Leu
  UNSURE 65: Xaa=Asp or Tyr
agccccggccccgccccgcgagcgccgggacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcctgtcagagttgttcagtataatatcaatacagaagaattnkattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgcc

SEQ ID NO: 986 - DNA, 414 bp, Homo sapiens
  CDS 238..414
  misc_feature 193: m=a or c
  misc_feature 194: n=a, g, c or t
  misc_feature 196: n=a, g, c or t
  misc_feature 391: k=g or t
  misc_feature 394: w=a or t
  UNSURE 52: Xaa=Cys or Gly
  UNSURE 53: Xaa=Asn or Tyr
tcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacmncnacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctcattcttggggcttttgtkgtwactggtggatatctgatcag

SEQ ID NO: 987 - DNA, 366 bp, Homo sapiens
  CDS 119..364
aaaaaagataaaatttgaaatctggttaggctggtgtggcaggcctccccagaggactggggagctggtgagggcctgagcagtccacactggccagagctgggtgggttgcaggtggatggaccccgggcagcacagtcctgggcaccatgccctgtttgtgaggactgttagagccccagatgggcgttccccaggtggtgggtgcagcgggcccagagcccagttttacagggatagtagtaattgggttgggcaccttgaacctctctcccgagtgggcccttttctggactttaaccctctctgcagtgccgcatggagacagcagagcctgggggtggatgggagaggggctgctgagga

SEQ ID NO: 988 - DNA, 393 bp, Homo sapiens
  CDS 181..393
  misc_feature 100: w=a or t
  misc_feature 101: m=a or c
agttctaggtgaatccacagtgtgtggatctgggttagacctgtgctccccatgctgcgctgtgtctgggactggtctgcatcgggaggctctggtggcwmgccttgagtagtggaactctctagggtataaggtgctgggaaatcccaaagagctctattaccaggttttaaattcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaagttgaagacgagacattccaatagttcacagagt

SEQ ID NO: 989 - DNA, 257 bp, Homo sapiens
  CDS 36..257
aaaaagatatgtccaaatcctaaccctgggaacctatgaaaatcctaaccctgggaacctatgaaggtatttccttatttggtgtgttttgttttggtttggtttggtttggtttgtttgatacagagtcttgctctgtcgcccaggctggagtgcagtggtgtgatctcggctcactgcaacctctgcctccgggttcaagcgattgtcctgcctcagcctcccaggtagctgggattacgggcacgcgccaccac

SEQ ID NO: 990 - DNA, 479 bp, Homo sapiens
  CDS 185..478
  misc_feature 10: r=a or g
agcgcttagrgagctcggtggaagctgctaaaggcggaggcggggctctggcgagttctccttccaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacgg

SEQ ID NO: 991 - DNA, 286 bp, Homo sapiens
  CDS 118..285
gacagtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcag

SEQ ID NO: 992 - DNA, 471 bp, Homo sapiens
  CDS 55..471
  misc_feature 355: m=a or c
  misc_feature 447: w=a or t
  UNSURE 101: Xaa=Ile or Leu
  UNSURE 131: Xaa=Asp or Glu
ttcctctcggtcccatattgaactcgagttggaagaggcgagtccggtctcaaaatggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatmtaacagtgaagaaaatttttgttggtggtattaaagaagatacagaagaatataatttgagagactactttgaaaagtatggcaagattgawaccatagaagttatggaagacagg

SEQ ID NO: 993 - DNA, 537 bp, Homo sapiens
  CDS 55..537
  misc_feature 371: n=a, g, c or t
  misc_feature 386: n=a, g, c or t
  misc_feature 391: n=a, g, c or t
  misc_feature 398: r=a or g
  misc_feature 413: n=a, g, c or t
  misc_feature 513: w=a or t
  UNSURE 106: Xaa=Ala or Glu or Gly or Val
  UNSURE 111: Xaa=Ala or Asp or Gly or Val
  UNSURE 113: Xaa= *  or Gly or Arg
  UNSURE 115: Xaa=Asp or Gly
  UNSURE 120: Xaa=Ala or Asp or Gly or Val
  UNSURE 153: Xaa=Asp or Glu
ttcctctcggtcccatattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggnaccaaagagagctgnttctngagaggrttctgtaaagcctgntgcccatctaacagtgaagaaaatttttgttggtggtattaaagaagatacagaagaatataatttgagagactactttgaaaagtatggcaagattgawaccatagaagttatggaagacagg

SEQ ID NO: 994 - DNA, 358 bp, Homo sapiens
  CDS 68..358
  misc_feature 62: n=a, g, c or t
  misc_feature 317: m=a or c
  misc_feature 321: y=c or t
  misc_feature 326: m=a or c
  misc_feature 330: m=a or c
  misc_feature 332: r=a or g
  misc_feature 333: m=a or c
  UNSURE 85: Xaa=Ala or Val
  UNSURE 88: Xaa=Ala or Glu
  UNSURE 89: Xaa=Ala or Glu or Lys or Thr
acagaaccggaagcagcgtgtagttctcttcccttttgcggccatcaccgaagcgggagcgnccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaamgggygcagmgggmarmgggcttgggcagcatgaggcccgga

SEQ ID NO: 995 - DNA, 309 bp, Homo sapiens
  CDS 9..308
  misc_feature 50: s=g or c
  misc_feature 86: s=g or c
  UNSURE 14: Xaa=Asp or Glu
  UNSURE 26: Xaa=Ile or Met
accatgggatgtactctgagcgcagaggagagagccgccctcgagcggasaaggcgattgagaaaaacctcaaagaggatggcatsagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctg

SEQ ID NO: 996 - DNA, 454 bp, Homo sapiens
  CDS 186..452
  misc_feature 27: r=a or g
  misc_feature 75: y=c or t
atccggttcttctgggcgctaagggarctgacggagagggccaccgcccagcaatagacggtgcctcagcctgcygagccgcagtttccgtggtgtgagtgagtccgggcccgtgtcccctctcccgccgccgccatgggctgcacgttgagcgccgaagacaaggcggcagtggagcgaacaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgccggcaatta

SEQ ID NO: 997 - DNA, 574 bp, Homo sapiens
  CDS 204..572
  misc_feature 20: k=g or t
  misc_feature 153: m=a or c
  misc_feature 259: w=a or t
  misc_feature 440: n=a, g, c or t
  misc_feature 441: n=a, g, c or t
  UNSURE 19: Xaa=Lys or Met
  UNSURE 80: Xaa=Asp or His or Asn or Tyr
acaccactgggtcaggccakggaagatagaagcaagaaggactgaagagcattccatggctttgctctgagcacctgggtagatggggatgccgtctactgaggatcatccatgaagatggcttctccggagaagacgtgaaacagtacaagmctgttgtctacagcaacactatccagtccctggcagccatcgtccgggccatggacactttgggcatcgaatatggtgataaggagagaaaggctgacgccaagawggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgcnnactaccagcccaccgagcaggacatcctccgaaccagggtcaaaaccactggcatcgtagaaacccacttcacattcaagaacctccacttcaggctgtttgacgtcggaggccagcgatctgaacgcaagaa

SEQ ID NO: 998 - DNA, 422 bp, Homo sapiens
  CDS 190..420
  misc_feature 17: s=g or c
aatgttcaaatgcgcastcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtacta

SEQ ID NO: 999 - DNA, 456 bp, Homo sapiens
  CDS 28..456
  misc_feature 53: y=c or t
  UNSURE 9: Xaa=Leu or Pro
ggcaaagtgacgtggacgtcaacagcaatggcggaaggagaagatgtgccgcygctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagc

SEQ ID NO: 1000 - DNA, 901 bp, Homo sapiens
  CDS 230..901
  misc_feature 311: k=g or t
  misc_feature 312: y=c or t
  misc_feature 323: n=a, g, c or t
  misc_feature 350: r=a or g
  misc_feature 351: n=a, g, c or t
  misc_feature 352: n=a, g, c or t
  misc_feature 858: r=a or g
  UNSURE 28: Xaa=Ala or Phe or Ser or Val
  UNSURE 32: Xaa= *  or Glu or Lys or Gln
  UNSURE 41: Xaa=Ala or Asp or Glu or Gly or Ile or Lys or Met or Asn or Arg or Ser or Thr or Val
  UNSURE 210: Xaa=Gln or Arg
attgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctakytatttttgtgnagaggcaaatcatgcgctttgcaatgrnntctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcrgtcccctgaggtctccccaacaaccatccagttgacatacccc

SEQ ID NO: 1001 - DNA, 401 bp, Homo sapiens
  CDS 238..399
acgtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagt

SEQ ID NO: 1002 - DNA, 485 bp, Homo sapiens
  CDS 202..483
  misc_feature 108: s=g or c
  misc_feature 356: r=a or g
  misc_feature 426: k=g or t
  misc_feature 459: k=g or t
  UNSURE 52: Xaa=Glu or Gly
  UNSURE 75: Xaa=His or Gln
  UNSURE 86: Xaa=Asp or Glu
agctgcagagcgacgcagccttcggtgcagtcgtcactcgcgtctggctaccagctccccgctgccctgagctcggcgggctggcattcggcccggggaaaagcggasaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtgragatggagatgatatggaaatattcatggaggagatgagagaaatcagaagaaaacttagggagctgcakttgaggaattgtctgcgtatccttatgggggakctctctaatcaccatgaccatcatga

SEQ ID NO: 1003 - DNA, 532 bp, Homo sapiens
  CDS 219..530
  misc_feature 108: s=g or c
  misc_feature 333: m=a or c
  misc_feature 345: y=c or t
  misc_feature 403: r=a or g
  misc_feature 473: k=g or t
  misc_feature 506: k=g or t
  UNSURE 39: Xaa=Lys or Gln
  UNSURE 43: Xaa=Phe or Leu
  UNSURE 62: Xaa=Glu or Gly
  UNSURE 85: Xaa=His or Gln
  UNSURE 96: Xaa=Asp or Glu
agctgcagagcgacgcagccttcggtgcagtcgtcactcgcgtctggctaccagctccccgctgccctgagctcggcgggctggcattcggcccggggaaaagcggasaggtctgcgaggctaagtgtctccgcggcgcacctcgcggcgagaatccggaggagaaggagactgcaaggataggcccagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggamaggctcgccgayttgcccctaattttcgatgggccatacccaataggcagatcaatgatgggatgggtgragatggagatgatatggaaatattcatggaggagatgagagaaatcagaagaaaacttagggagctgcakttgaggaattgtctgcgtatccttatgggggakctctctaatcaccatgaccatcatga

SEQ ID NO: 1004 - DNA, 381 bp, Homo sapiens
  CDS 15..380
agcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagc

SEQ ID NO: 1005 - DNA, 483 bp, Homo sapiens
  CDS 100..483
  misc_feature 478: r=a or g
  UNSURE 127: Xaa=Gly or Ser
aaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctargccca

SEQ ID NO: 1006 - DNA, 461 bp, Homo sapiens
  CDS 127..459
  misc_feature 65: k=g or t
  misc_feature 66: w=a or t
  misc_feature 252: n=a, g, c or t
  UNSURE 42: Xaa=Lys or Asn
agtcgttatggtgggggaggcggggcgagacctacgacgccggcgagcagtggccgttacggcckwaaagatggcggtcttggcacctctaattgctctcgtgtattcggtgccgcgactttcacgatggctcgcccaaccttactaccttctgtcggccctgagtatatcaagtacttcaatgataaaaccattgatgaggaactagaacgggacaagagggtcacttggattgtggagttctttgccaantggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagat

SEQ ID NO: 1007 - DNA, 446 bp, Homo sapiens
  CDS 135..446
gtgctgactagctgtttatattttagtaagggccaccctttaactcggcagcttgatgactataatgggcccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctc

SEQ ID NO: 1008 - DNA, 409 bp, Homo sapiens
  CDS 113..409
  misc_feature 267: m=a or c
  UNSURE 52: Xaa= *  or Ser
atcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctmaggtttaacttgcacagagcaaaattttatatcaaaatctggttatcatcagtctgcttcagaacatggtcttgttgtcattgctccagataccagccctcgtggctgcaatattaaaggtgaagatgagagctgggacttt

SEQ ID NO: 1009 - DNA, 277 bp, Homo sapiens
  CDS 113..277
atcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtcatcaacaagaaaagttgcttagaataatgtggaaaaagaaaatcaccaatatgcagagaatggaaaggagcatacagaaaacttcccatgatggg

SEQ ID NO: 1010 - DNA, 439 bp, Homo sapiens
  CDS 99..437
  misc_feature 396: n=a, g, c or t
  UNSURE 100: Xaa=Ala or Pro or Ser or Thr
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtgnccaataatcaagacaaactgggatttgaggatggatcagttct

SEQ ID NO: 1011 - DNA, 547 bp, Homo sapiens
  CDS 389..547
  misc_feature 6: n=a, g, c or t
  misc_feature 482: y=c or t
  UNSURE 32: Xaa= *  or Gln
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgatcatgtcgtcgccaagtcccgcttctggtctactgtgggcaggtgtttgagaagtcccccctgcgggtgaagaacttcgggatctggctgcgctatgactcccggagcggcacccacaacatgtaccgggaataccgggacctgaccaccgcagcgctgtcacccagtgctaccgagacatgggtgcccggcaccgcgcccgagcccactccattcagatcatgaaggtggaggagatcgcggccagcaagtgccgccggccggctgtcaagyagttccacgactccaagatcaagttcccgctgccccaccgggtcctgcgccgtcagcacaagcca

SEQ ID NO: 1012 - DNA, 332 bp, Homo sapiens
  CDS 48..332
  misc_feature 6: n=a, g, c or t
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcaccgcgcccgagcccact

SEQ ID NO: 1013 - DNA, 629 bp, Homo sapiens
  CDS 99..629
  misc_feature 333: k=g or t
  UNSURE 79: Xaa= *  or Gly
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcggacgg

SEQ ID NO: 1014 - DNA, 519 bp, Homo sapiens
  CDS 99..518
  misc_feature 333: k=g or t
  misc_feature 345: n=a, g, c or t
  UNSURE 79: Xaa= *  or Gly
  UNSURE 83: Xaa=Cys or Gly or Arg or Ser
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcngcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgttgccaac

SEQ ID NO: 1015 - DNA, 508 bp, Homo sapiens
  CDS 99..506
  misc_feature 333: k=g or t
  misc_feature 345: n=a, g, c or t
  UNSURE 79: Xaa= *  or Gly
  UNSURE 83: Xaa=Cys or Gly or Arg or Ser
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcngcagttcggcggtcccgcgggtctgtctcttgcttcaacagtgtttggacggaacagatccggggactctcttccagcctccgaccgccctccgatttcctctcccagaagcaggagatggccgagaagatggtcccggaggttgcaagcggagaggaaatcg

SEQ ID NO: 1016 - DNA, 317 bp, Homo sapiens
  CDS 48..317
  misc_feature 6: n=a, g, c or t
  misc_feature 207: r=a or g
  misc_feature 210: r=a or g
  UNSURE 54: Xaa=Met or Val
  UNSURE 55: Xaa=Glu or Lys
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagrtgraggagatcgcggccagcaagtgccgccggccggctgtcaagcagttccacgactccaagatcaagttcccgctgccccaccgggtcctgcgccgtcagcacaagcca

SEQ ID NO: 1017 - DNA, 476 bp, Homo sapiens
  CDS 318..476
  misc_feature 6: n=a, g, c or t
  misc_feature 411: y=c or t
  UNSURE 32: Xaa= *  or Gln
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgatcatgtcgtcgccaagtcccgcttctggtctactgtgggcaggtgtttgagaagtcccccctgcgggtgaagaacttcgggatctggctgcgctatgactcccggagcggcacccacaacatgtaccgggaataccgggacctgaccaccgcagcgctgtcacccagtgctaccgagacatgggtgcccggcaccgcgcccgagcccactccattcagatcatgaaggtggaggagatcgcggccagcaagtgccgccggccggctgtcaagyagttccacgactccaagatcaagttcccgctgccccaccgggtcctgcgccgtcagcacaagcca

SEQ ID NO: 1018 - DNA, 388 bp, Homo sapiens
  CDS 206..388
  misc_feature 6: n=a, g, c or t
  misc_feature 278: r=a or g
  misc_feature 281: r=a or g
  UNSURE 25: Xaa=Met or Val
  UNSURE 26: Xaa=Glu or Lys
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgcgaatctttgcgcctaatcatgtcgtcgccaagtcccgcttctggtactttgtatctcagttaaagaagrtgraggagatcgcggccagcaagtgccgccggccggctgtcaagcagttccacgactccaagatcaagttcccgctgccccaccgggtcctgcgccgtcagcacaagcca

SEQ ID NO: 1019 - DNA, 403 bp, Homo sapiens
  CDS 206..403
  misc_feature 6: n=a, g, c or t
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcaccgcgcccgagcccact

SEQ ID NO: 1020 - DNA, 426 bp, Homo sapiens
  CDS 176..424
  misc_feature 384: k=g or t
  UNSURE 70: Xaa=Ile or Ser
ctttccagtggacctgggctgttgttgcggttgttttccttctctccgtgcaacgctggcaagtctcaaagtcgccacagaaacatgcccctgattcagtgcctctgcttagctgtaacatgttaatcagaactacctggcatcttcctgaacaagactttcaataggggccagtatgcttcgcttcatccagaagttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcakctttaaaaagcagcagagcgaagcacttctagccagaccctc

SEQ ID NO: 1021 - DNA, 383 bp, Homo sapiens
  CDS 128..382
ttgagctgtctgcagcagagctgagaggaccagccattttacttatggaaaacagtgtggcatattctgctgagcttcgccctggaagaagcctcttttatacatctcttcagggaagagagaagcaatgggcatgttagaactgaggtgggctagtgggggtgagatggtgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcggg

SEQ ID NO: 1022 - DNA, 431 bp, Homo sapiens
  CDS 174..431
  misc_feature 119: r=a or g
  misc_feature 363: r=a or g
  misc_feature 364: n=a, g, c or t
  misc_feature 365: n=a, g, c or t
  misc_feature 377: m=a or c
  UNSURE 64: Xaa=Ala or Asp or Glu or Gly or Ile or Lys or Met or Asn or Arg or Ser or Thr or Val
gcggtcaggacgtcgaagccaaagaagaccagagccagccgggtggcacagcggtgtcgtggccgtgttgctgatcgcctgggtggttgttggcgtgtccctgcagcgaaggatcctgrcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcrnngggcctgtggcmagtgcacagtacgtgtcccaggcagaagcctcaagctttgcagcagcagcagta

SEQ ID NO: 1023 - DNA, 386 bp, Homo sapiens
  CDS 87..386
  misc_feature 383: y=c or t
gcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattccygcc

SEQ ID NO: 1024 - DNA, 297 bp, Homo sapiens
  CDS 71..295
gaagattaccggaagctaccgagtctgacccaaagcatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacgg

SEQ ID NO: 1025 - DNA, 524 bp, Homo sapiens
  CDS 73..522
  misc_feature 21: n=a, g, c or t
  misc_feature 502: n=a, g, c or t
  misc_feature 503: n=a, g, c or t
  misc_feature 519: r=a or g
  misc_feature 520: n=a, g, c or t
  misc_feature 521: n=a, g, c or t
  misc_feature 522: n=a, g, c or t
  UNSURE 144: Xaa= *  or Ala or Glu or Gly or Ile or Lys or Leu or Pro or Gln or Arg or Ser or Thr or Val
  UNSURE 150: Xaa=any one of the twenty amino acids
cttcgcgcctcggcggcgggncatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggnnaatatttggcttgttrnnngg

SEQ ID NO: 1026 - DNA, 367 bp, Homo sapiens
  CDS 160..366
  misc_feature 54: y=c or t
agaaggtcagcaaaggaaagtggaagttggattctgaaagatcgaggtgcccayaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcaca

SEQ ID NO: 1027 - DNA, 568 bp, Homo sapiens
  CDS 331..567
  misc_feature 492: y=c or t
gcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccgaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggttcatgcaattcagtgtgatgtgagggaycctgatatggttcaaaacactgtgtcagaactgatcaaagttgcaggacatcctaatattgtgataaacaatgcag

SEQ ID NO: 1028 - DNA, 475 bp, Homo sapiens
  CDS 40..474
gcctgcgccgccttccggcccgagttctggagactcaacatgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcag

SEQ ID NO: 1029 - DNA, 272 bp, Homo sapiens
  CDS 113..271
  misc_feature 95: k=g or t
gcctgcgccgccttccggcccgagttctggagactcaacatgaagctaccggccagggttttctttactctggggtcccggctgccctgtggcckcgctcctcggagggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcag

SEQ ID NO: 1030 - DNA, 556 bp, Homo sapiens
  CDS 160..555
tggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggcc

SEQ ID NO: 1031 - DNA, 493 bp, Homo sapiens
  CDS 103..492
agtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtg

SEQ ID NO: 1032 - DNA, 377 bp, Homo sapiens
  CDS 36..377
  misc_feature 289: r=a or g
  misc_feature 325: n=a, g, c or t
  misc_feature 326: n=a, g, c or t
  misc_feature 331: k=g or t
  UNSURE 85: Xaa=Asp or Gly
  UNSURE 97: Xaa=Ala or Asp or Glu or Gly or Val
  UNSURE 99: Xaa=Gly or Val
acaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgrcatacccagaaatttcccccttgctttggatcttgnngttgkaagaggttacattgcacaatatttgaataaggaaactattggaaag

SEQ ID NO: 1033 - DNA, 325 bp, Homo sapiens
  CDS 137..325
agtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggca

SEQ ID NO: 1034 - DNA, 503 bp, Homo sapiens
  CDS 120..503
  misc_feature 135: s=g or c
  UNSURE 6: Xaa=Ala or Pro
gcaacaaactgctgagacgcacagtctccgtgccggtggaggggcggccccacggcgagcatgaataccacttgggtcgctcgaggaggaagagtgtcccaggggggaagcagtacagcatggagggtgccctgsctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaat

SEQ ID NO: 1035 - DNA, 302 bp, Homo sapiens
  CDS 96..302
aggtgacccggtcgcctggccgcagattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtg

SEQ ID NO: 1036 - DNA, 412 bp, Homo sapiens
  CDS 206..412
  misc_feature 4: s=g or c
  misc_feature 25: s=g or c
  misc_feature 47: s=g or c
ggcsggcgggccaaaaagcgcggastcacggctggagggagggggascggaattagcgggcagttggaaagcccgcgaaacgctttttccgcctgggaggccggacgatcgcgattgggcaggaggaagaggaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtg

SEQ ID NO: 1037 - DNA, 486 bp, Homo sapiens
  CDS 66..485
  misc_feature 119: r=a or g
ctctccaagccggaggggtcctgaggtgacagcgcctgcaactgaaatttcagcagcgggagaagatggacaagagaaagctcgggcgacggccatcttcatccgaaatcatcacagarggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttg

SEQ ID NO: 1038 - DNA, 447 bp, Homo sapiens
  CDS 153..446
  misc_feature 92: s=g or c
aatggaaaccagatgaagaagatgagatttcggaggaattgaaagaaaaggccaagattgaagatgagaaaaaagatgaagaaaaagaagascccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggac

SEQ ID NO: 1039 - DNA, 537 bp, Homo sapiens
  CDS 142..537
gggaggcggggcggggcggggcgggcctcgcctcgcctagggaggatgtggcgggtataaaagccccacccaggccagccggctctgctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatc

SEQ ID NO: 1040 - DNA, 456 bp, Homo sapiens
  CDS 234..455
  misc_feature 150: s=g or c
  misc_feature 197: r=a or g
attacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaasgcagccgcaaggagagctactccgtatacgtgtacaaggtgctgaarcaggtccaccccgacaccggcatctcctctaaagccatggggatcatgaattcctttgtcaacgacatcttcgagcgcatcgccggcgaggcttcccgcctggcgcattacaacaaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgc

SEQ ID NO: 1041 - DNA, 444 bp, Homo sapiens
  CDS 222..443
  misc_feature 139: s=g or c
  misc_feature 212: s=g or c
  misc_feature 215: y=c or t
  misc_feature 218: r=a or g
  misc_feature 227: s=g or c
  misc_feature 236: y=c or t
  misc_feature 242: y=c or t
  misc_feature 269: s=g or c
  misc_feature 272: m=a or c
  misc_feature 293: y=c or t
  misc_feature 309: s=g or c
  misc_feature 318: m=a or c
  misc_feature 322: m=a or c
  misc_feature 324: s=g or c
  misc_feature 354: k=g or t
  misc_feature 360: s=g or c
  misc_feature 378: y=c or t
  misc_feature 384: m=a or c
  misc_feature 402: y=c or t
  UNSURE 30: Xaa=Asp or His
  UNSURE 33: Xaa=Ile or Leu
  UNSURE 34: Xaa=Pro or Gln
  UNSURE 35: Xaa=Gly or Arg
  UNSURE 45: Xaa=Ala or Ser
  UNSURE 47: Xaa=Gly or Arg
  UNSURE 53: Xaa=Cys or Arg
  UNSURE 61: Xaa=His or Tyr
aaaacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagscagccgcaaagagagctactccatctacgtgtacaaggtgctgaagcaggtccaccccgacaccggcatctcstcyaargccatgggsatcatgaaytccttygtcaacgacatcttcgagcgcatcgcsggmgaggcttcccgcctggcgcaytacaacaaagcgctcsaccatcacmtccmgsgagatccagacggccgtgcgcctgctgctkcccggsgagctggccaagcacgcygtgtcmgagggcaccaaggccgtyaccaagtacaccagctccaagtaaacttgtccctgcaactgc

SEQ ID NO: 1042 - DNA, 437 bp, Homo sapiens
  CDS 215..436
  misc_feature 178: r=a or g
  misc_feature 181: r=a or g
attcttgttatttgagtgctctttcactctcctccgccatgcccgacccggctaaatctgctcctgcccccaaaaagggctccaagaaagccgtaaccaaggcccagaaaaaggacggcaagaagcgcaacgcagccgcaaagagagttactctatctacgtgtacaaggtgctgaarcargtccaccccgacaccggcatctcctctaaagccatggggatcatgaattcctttgtcaacgacatcttcgagcgcatcgccggcgaggcttcccgcctggcgcattacaacaaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgc

SEQ ID NO: 1043 - DNA, 449 bp, Homo sapiens
  CDS 227..448
  misc_feature 101: n=a, g, c or t
  misc_feature 102: s=g or c
  misc_feature 220: y=c or t
  misc_feature 256: y=c or t
  misc_feature 295: k=g or t
  misc_feature 311: y=c or t
  misc_feature 341: r=a or g
  misc_feature 359: k=g or t
  misc_feature 362: y=c or t
  misc_feature 368: r=a or g
  misc_feature 383: y=c or t
  misc_feature 389: m=a or c
  misc_feature 398: y=c or t
  UNSURE 29: Xaa=Phe or Leu
  UNSURE 39: Xaa=Gly or Ser
  UNSURE 45: Xaa=Ala or Ser
  UNSURE 46: Xaa=Arg or Trp
  UNSURE 48: Xaa=Ala or Thr
  UNSURE 53: Xaa=Cys or Arg
  UNSURE 58: Xaa= *  or Gln
gttgagccttcactttggggtgtattcttactcctttatcttgttgcaatgcctgatccagctaagtccgctcccgccccgaagaagggctccaagaaggnsggtgaccaaggcgcagaagaaggatggcaagaagcgtaaacgcagccgcaaggagagctactccgtatacgtttacaaggtgctgaagcaagtccaccccgacaccggcatctcctcyaaagccatggggatcatgaattcctttgtcaacgayatcttcgagcgcatcgccggcgaggcttcccgcctggckcattacaacaaagcgytcgaccatcacctccagggagatccagacrgccgtgcgcctgctgctkccyggggarctggccaagcacgcygtgtcmgagggcacyaaggccgttaccaagtacaccagctccaagtaaacttgtccctgcaactgc

SEQ ID NO: 1044 - DNA, 499 bp, Homo sapiens
  CDS 277..498
  misc_feature 240: r=a or g
  misc_feature 242: r=a or g
  misc_feature 266: s=g or c
  misc_feature 267: s=g or c
  misc_feature 269: s=g or c
  misc_feature 270: y=c or t
  misc_feature 273: r=a or g
  misc_feature 282: s=g or c
  misc_feature 291: y=c or t
  misc_feature 297: y=c or t
  misc_feature 298: s=g or c
  UNSURE 8: Xaa=Leu or Val
atgcgcacagcctctgtaagtacacagtcgtttccggtagaccccgagcctaccgctctgcttgcgttctcgggggtcggtgtcggtcttgggtctggccatgcctgagcctgcaaagttcgcgccggctcccaagaagggctccaagaaagccgtcaccaaagcccagaagaaagacggcaagaagcgcaacgcagccgcaaggagagctactccatctacgtgtacaaggtgctgaarcrggtccaccccgacaccggcatctsstsyaargccatgggsatcatgaaytccttystcaacgacatcttcgagcgcatcgccggcgaggcttcccgcctggcgcattacaacaaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgc

SEQ ID NO: 1045 - DNA, 353 bp, Homo sapiens
  CDS 76..351
  misc_feature 50: k=g or t
  misc_feature 327: n=a, g, c or t
  misc_feature 328: k=g or t
  UNSURE 84: Xaa=His or Gln
  UNSURE 85: Xaa=Asp or Tyr
atttgtgtcacgtgtactttccaccatgtaatggcgttctaacgtgagtktatatattagtaaatttggttcccgatggcgttccagtacgtatggctttcgctcgagcagttaccttatttaacctcttctaggctgtacccagctctgccttgctttgcttccccctcaccccctgattccatctctgcagcccacgggacatcgggaagatgccagaccaccaggcaggatagtctgcaaggggagggactttctctggaatttcctgatatgaccaagaaagcttcttatcaaaagaagcacaattgccttcggttacctcankatctactgcagaaaagaagacgaga

SEQ ID NO: 1046 - DNA, 595 bp, Homo sapiens
  CDS 315..593
atatccagggattccctgaggatttccttggagagagaagctctagggaggatggagaccccctcttctggaaggaggtgatttctgaatttgtggtcctgtcctcttgggctcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1047 - DNA, 564 bp, Homo sapiens
  CDS 284..562
attgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1048 - DNA, 509 bp, Homo sapiens
  CDS 4..507
  misc_feature 51: s=g or c
  misc_feature 117: s=g or c
  misc_feature 118: k=g or t
  misc_feature 159: r=a or g
  misc_feature 160: s=g or c
  misc_feature 182: r=a or g
  misc_feature 183: r=a or g
  UNSURE 16: Xaa=Asp or Glu
  UNSURE 38: Xaa=His or Gln
  UNSURE 39: Xaa=Ala or Ser
  UNSURE 53: Xaa=Glu or Gln
  UNSURE 60: Xaa=Glu or Gly
aacatgacttctgccttcaagctggatttcctcccggacatgatggtcgasggccgcctgctcgttcctgacagaattaacggcacagccaacaagatgaacggagctttggatcaskcagaccaaccagacccagatgccattaagatgtttgtcggrsagatcccccggtcatggtcggrraaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1049 - DNA, 580 bp, Homo sapiens
  CDS 300..578
gaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1050 - DNA, 404 bp, Homo sapiens
  CDS 180..404
  misc_feature 110: s=g or c
  misc_feature 123: k=g or t
  misc_feature 204: k=g or t
  UNSURE 9: Xaa=Asp or Tyr
gtcttttcctttgcaatgtctaagcctctttcatttttatgcactctgcatggaataatcaccgaaaaaggagctgaggagactccatattagacttgcgttccaaatascgctctaatcctkgacttagcctacctaaatagtcctcctgtgttaccagtaacggcacagccaacaagatgaacggagctttggatcactcakaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcc

SEQ ID NO: 1051 - DNA, 546 bp, Homo sapiens
  CDS 266..544
gaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1052 - DNA, 566 bp, Homo sapiens
  CDS 301..564
  misc_feature 203: n=a, g, c or t
  misc_feature 204: n=a, g, c or t
  misc_feature 330: k=g or t
  misc_feature 372: r=a or g
  misc_feature 390: k=g or t
  misc_feature 394: s=g or c
  UNSURE 10: Xaa=Phe or Leu
  UNSURE 32: Xaa=Leu or Val
gaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattnncagaagcttcacaagactgcatatataaggggctggctgtagctgcagctgaaggagctgaccagccagctgacccctcacactcacctagccaccatggacatcgccatccaccaccccttcttkcctttccactcccccagccgcctctttgaccagttcttcggrgagcacctgttggagtckgatsttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctacc

SEQ ID NO: 1053 - DNA, 404 bp, Homo sapiens
  CDS 42..404
  misc_feature 378: n=a, g, c or t
  UNSURE 113: Xaa=Asp or His or Asn or Tyr
gggtgaagaaggggccggccttcaagcaacagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagnattcatatagcatcaaagttgtcctg

SEQ ID NO: 1054 - DNA, 419 bp, Homo sapiens
  CDS 43..417
tcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaat

SEQ ID NO: 1055 - DNA, 468 bp, Homo sapiens
  CDS 72..467
agagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactatgcagagatctatgagac

SEQ ID NO: 1056 - DNA, 311 bp, Homo sapiens
  CDS 77..310
gcattcgccacgctgaagcccgtatcgctcctgagaccggtccggaggaaacacaagaatagtagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagcaa

SEQ ID NO: 1057 - DNA, 371 bp, Homo sapiens
  CDS 119..370
ggaagtggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtg

SEQ ID NO: 1058 - DNA, 344 bp, Homo sapiens
  CDS 145..342
  misc_feature 2: s=g or c
  misc_feature 37: s=g or c
asctcagccgtaagtagtttctctatcagtcgcgcastgtgttcgcggactcaggtggaaggaatttcttctcttcgttgacgttgctggtgttcactgtttggaattagtcaagtttcgggaatcaccgtcgctgccatcaacatgtcggtcccaagcgctctcatgaagcaaccgcccattcagtctacggctggggccgtcccagttcgcaatgagaaaggtgagatttcaatggaaaaagtgaaggtaaagcgttatgtgtccggaaaaaggccagactatgcccctatggagtcctcagatgaggaggatgaagaatttcagttcattaagaaagccaa

SEQ ID NO: 1059 - DNA, 508 bp, Homo sapiens
  CDS 37..507
agtttcatttccggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgctagcaaggagtgtttcatttgaacaggcagtacaaattcttcaggatgatgttgcatgtgacatcattaaaataggttctttagtaggaataaagagagatttgt

SEQ ID NO: 1060 - DNA, 508 bp, Homo sapiens
  CDS 201..506
agcggccgagaagggcgggacttccggcgggtgacgcgcccgggttcggctacaaaagaggacggctgcggcgcgccgggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggccttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggag

SEQ ID NO: 1061 - DNA, 454 bp, Homo sapiens
  CDS 122..454
  misc_feature 404: n=a, g, c or t
  UNSURE 95: Xaa=Cys or Gly or Arg or Ser
acgtcttggttcgggccgggcataaaaggcttcgcggcccagggctcacttggcgctgagaacgcgggtccacgcgtgtgatcgtccgtgcgtctagcctttgcccacgcagctttcagtcatggcctccggtaacgcgcgcatcggaaagccagcccctgacttcaaggccacagcggtggttgatggcgccttcaaagaggtgaagctgtcggactacaaagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggatcaacaccccccggaaagagggangcttgggccccctgaacatccccctgcttgctgacgtgaccagacgcttg

SEQ ID NO: 1062 - DNA, 393 bp, Homo sapiens
  CDS 231..392
  misc_feature 36: k=g or t
  misc_feature 38: k=g or t
  misc_feature 57: m=a or c
  misc_feature 85: s=g or c
  misc_feature 100: k=g or t
  misc_feature 351: n=a, g, c or t
  misc_feature 365: r=a or g
  misc_feature 366: n=a, g, c or t
  UNSURE 41: Xaa=Asp or His or Asn or Tyr
  UNSURE 45: Xaa= *  or Trp
  UNSURE 46: Xaa=Ala or Pro or Ser or Thr
accggctgtcgtaaaacggtgaatggagagcgagtkgkgggggggaaaaagggaggmcagggggcgcggagtcagagtggcgcasaagtggccgcaggtkgcgacggtggcggggggtggggtgtgaggtaatccaggggtcgcggaagaggaggctgagagggtcaaaagaaaactaaagctgcagtccggcctactgttccgggggccgcggacccccacccggggagatggacctcaaccggatcatccaggcgctgaggcaccatcgacccgaagttgcggattgcagccgagaacgagctcaaccagtcctacaagattatcaattttgcccccagtttacttcgnattatagtctctgrncatgtggattccagtacgacaggcagc

SEQ ID NO: 1063 - DNA, 483 bp, Homo sapiens
  CDS 87..482
  misc_feature 2: n=a, g, c or t
tnctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatca

SEQ ID NO: 1064 - DNA, 254 bp, Homo sapiens
  CDS 69..254
  misc_feature 124: m=a or c
  misc_feature 238: m=a or c
  UNSURE 19: Xaa=Ala or Asp
  UNSURE 57: Xaa=Ala or Glu
aaaaagggcaggcatcgcggggctggccacttccgtacttccgctttccggcccagccagcgcccgcgatgactgccactctccgcccctacctgagtgccgtgcgggccacattgcaggctgmcctctgcctggagaacttctcctcccaggttgtggaacgacacaacaagccggaagtggaagtcaggagtagcaaagagctcctgttacaacctgtgaccatcagcaggaatgmgaaggaaaaggttctg

SEQ ID NO: 1065 - DNA, 351 bp, Homo sapiens
  CDS 103..351
  misc_feature 48: r=a or g
  misc_feature 49: s=g or c
  misc_feature 231: s=g or c
  misc_feature 330: n=a, g, c or t
  misc_feature 341: n=a, g, c or t
  misc_feature 342: n=a, g, c or t
  misc_feature 343: w=a or t
  misc_feature 350: n=a, g, c or t
  misc_feature 351: n=a, g, c or t
  UNSURE 43: Xaa=Ile or Met
  UNSURE 76: Xaa= *  or Cys or Trp
  UNSURE 80: Xaa=Ile or Lys or Met or Asn or Arg or Ser or Thr
  UNSURE 81: Xaa=Phe or Ile
  UNSURE 83: Xaa=Ile or Lys or Met or Asn or Arg or Ser or Thr
agtagtactttccggcgttgttgaccctatttcccgtgctgcaccgcrsccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatscgctttgccaagaagcacaacaaaaagggcctaaagaagatgcaggccaacaatgccaagtccaagaaccacaccacacacaaccagtcccgaaaatgncacagaaatannwtcaagann

SEQ ID NO: 1066 - DNA, 494 bp, Homo sapiens
  CDS 103..492
  misc_feature 48: r=a or g
  misc_feature 49: s=g or c
agtagtactttccggcgttgttgaccctatttcccgtgctgcaccgcrsccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaagga

SEQ ID NO: 1067 - DNA, 360 bp, Homo sapiens
  CDS 134..358
  misc_feature 335: k=g or t
  UNSURE 68: Xaa= *  or Gly
acttagggacctgctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggkgaacgagctatgcagcgtgtgtggg

SEQ ID NO: 1068 - DNA, 497 bp, Homo sapiens
  CDS 120..497
ctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgagg

SEQ ID NO: 1069 - DNA, 446 bp, Homo sapiens
  CDS 237..446
gactccattttgtaggccgcttatttgtgtgcatccacggcgattcttcccgcagagttgtgaagcgaaaggcttacaattaaaaggaagaaaaaaaaataaagataattcgggagtacaattgacaaagcgtgtgggtcgctcagcctccagcagtaactgctgatctccagttcttggagggttccggtgagaagaacgcccctactgcggtactgaggaagcggcaggaggagatgcggcccctggacatagacgaggtggaagcgcctgaggaagtggaggtgctggagcccgaggaggatttcgagcagttcctgctcccggtcatcaacgagatgcgcgaggacatcgcgtctcttatacgcgagcacgggcgggcgtacctgcggaccaggagcaagctgtgggagatggacaatatgcttatccagatcaaaacgcag

SEQ ID NO: 1070 - DNA, 279 bp, Homo sapiens
  CDS 64..279
  misc_feature 268: s=g or c
  misc_feature 269: k=g or t
  UNSURE 69: Xaa=Gly or Leu or Arg or Val
attttttttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagcagtgggaagagatgcggcccctggacatcgtcgaaskggcggaaacg

SEQ ID NO: 1071 - DNA, 292 bp, Homo sapiens
  CDS 64..291
attttttttgttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcgaaggaga

SEQ ID NO: 1072 - DNA, 391 bp, Homo sapiens
  CDS 179..391
  misc_feature 313: n=a, g, c or t
  UNSURE 45: Xaa=Asp or Glu
attttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgancacgggcgggcgtacctgcggaaccggagcaagctgtgggagatggacaatatgctcatccagatcaaaacgcaggtg

SEQ ID NO: 1073 - DNA, 472 bp, Homo sapiens
  CDS 76..471
  misc_feature 327: n=a, g, c or t
  misc_feature 348: y=c or t
gcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcnactaaactgaagaataaattyggaggaagttttggagatctcagaggattatgttcaagaagttaccaaagctggcgagggcttgtgggtcatcttgcacctttacaaacaaggaattcccctctgtgcctgataaatcagcacc

SEQ ID NO: 1074 - DNA, 435 bp, Homo sapiens
  CDS 50..433
  misc_feature 87: r=a or g
  UNSURE 13: Xaa=Asn or Ser
gggatccgctgcgcgagctgtctcggtcccacgtgtgcgagttgctacgatggaagttaaagggaaaaagcaattcacaggaaagartacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataa

SEQ ID NO: 1075 - DNA, 357 bp, Homo sapiens
  CDS 70..357
  misc_feature 346: r=a or g
  UNSURE 93: Xaa=Met or Val
cggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcrtgaacattacg

SEQ ID NO: 1076 - DNA, 462 bp, Homo sapiens
  CDS 280..462
  misc_feature 328: n=a, g, c or t
  misc_feature 329: w=a or t
  misc_feature 361: n=a, g, c or t
  misc_feature 362: n=a, g, c or t
  misc_feature 365: n=a, g, c or t
  misc_feature 368: n=a, g, c or t
  UNSURE 17: Xaa= *  or Glu or Lys or Leu or Met or Gln or Val
  UNSURE 28: Xaa= *  or Ala or Glu or Gly or Ile or Lys or Leu or Pro or Gln or Arg or Ser or Thr or Val
  UNSURE 29: Xaa=Ile or Asn or Ser or Thr
  UNSURE 30: Xaa= *  or Leu or Ser
atttttttgcttccatgaccaaagaagattctaaacttatagctctcatatggcccagtgagtggcaaatgatacaaaagctctttgttgtggatcatgtaattaaaatcacgaagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagagnwggacaaggaagaagctaaaccagatggagaannaanttnagattttaatcaaagcaatggtggaacaaagcggcaaaagatatcccatcaaaattatatagcctatcaaagcaagttattcgccgaagtatgc

SEQ ID NO: 1077 - DNA, 770 bp, Homo sapiens
  CDS 453..770
cccccaccttccctgctaggggcttcatagggtgtctgttgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctgttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcaaagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggt

SEQ ID NO: 1078 - DNA, 1126 bp, Homo sapiens
  CDS 479..1126
cccccaccttccctgctaggggcttcatagggtgtctgttgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggt

SEQ ID NO: 1079 - DNA, 568 bp, Homo sapiens
  CDS 202..567
  misc_feature 513: r=a or g
atataattgatgtgcagtctgcattgctgaatcctggactgcaccattctgtgttcaagggaagatgtaatctgatccctctgctgctgagggaggaatctgttcagtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaaatgaaaagaaagttggaccatggttctgaggtccgctctttttctttgggraagaaaccatgcaaagtctcagaatatacaagtaccactgggcttgtaccatgtt

SEQ ID NO: 1080 - DNA, 239 bp, Homo sapiens
  CDS 17..238
ctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacc

SEQ ID NO: 1081 - DNA, 210 bp, Homo sapiens
  CDS 43..210
gcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaagggttggccatcgcttcccaccct

SEQ ID NO: 1082 - DNA, 414 bp, Homo sapiens
  CDS 118..414
  misc_feature 19: s=g or c
gtgggtgtacgcggcgcasgcggcagtcctgatggcccggcatgggttaccgctgctgcccctgctgtcgctcctggtcggcgcgtggctcaagctaggaaatggacaggctacagtatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtcaagtttacccatgggggaactggttccagccaaaccgcacca

SEQ ID NO: 1083 - DNA, 458 bp, Homo sapiens
  CDS 38..457
ctttttttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacagtggcagctgc

SEQ ID NO: 1084 - DNA, 399 bp, Homo sapiens
  CDS 71..397
ctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcata

SEQ ID NO: 1085 - DNA, 596 bp, Homo sapiens
  CDS 265..594
  misc_feature 552: s=g or c
  misc_feature 553: y=c or t
  misc_feature 567: n=a, g, c or t
  misc_feature 568: n=a, g, c or t
  misc_feature 573: m=a or c
  misc_feature 577: r=a or g
  misc_feature 578: n=a, g, c or t
  misc_feature 592: k=g or t
  misc_feature 593: n=a, g, c or t
  misc_feature 595: s=g or c
  UNSURE 96: Xaa=Phe or Leu
  UNSURE 97: Xaa=Cys or Arg
  UNSURE 101: Xaa=His or Gln
  UNSURE 102: Xaa=Asp or His or Asn or Tyr
  UNSURE 105: Xaa=Ala or Asp or Gly or Ile or Asn or Ser or Thr or Val
  UNSURE 110: Xaa=Ala or Cys or Asp or Phe or Gly or Ser or Val or Tyr
caagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattsygtgtcctgggccannatcgmtggrnctatggcttacackncsa

SEQ ID NO: 1086 - DNA, 405 bp, Homo sapiens
  CDS 83..403
ttttctcaacatcctggcttagtattgtgtgcaaaatcagagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattct

SEQ ID NO: 1087 - DNA, 340 bp, Homo sapiens
  CDS 17..340
taagcagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaac

SEQ ID NO: 1088 - DNA, 341 bp, Homo sapiens
  CDS 143..340
  misc_feature 7: r=a or g
  misc_feature 187: m=a or c
  misc_feature 221: n=a, g, c or t
  misc_feature 226: s=g or c
  misc_feature 315: s=g or c
  UNSURE 27: Xaa=Ala or Pro or Ser or Thr
  UNSURE 58: Xaa=Arg or Thr
aggaggrccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcmcctgccaaaacctctgctgtgagcaatacaaaanctggscaacctcctcaaggctggccaggctccaacccttggaataatccgagtgctccatcttcagtgccatctggactcccaccaagtgcaasaccctccactgtgccttttggaccag

SEQ ID NO: 1089 - DNA, 536 bp, Homo sapiens
  CDS 172..534
  misc_feature 445: w=a or t
  misc_feature 481: w=a or t
  misc_feature 494: w=a or t
  misc_feature 510: w=a or t
  UNSURE 92: Xaa= *  or Lys
  UNSURE 104: Xaa=Phe or Ile
  UNSURE 108: Xaa=Asp or Val
  UNSURE 113: Xaa=Phe or Leu
accgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggwaactatttgagaaatatggaaaggcaggcgaagtcwtcattcataaggwtaaaggatttggcttwatccgcttggaaacccgaaccctagc

SEQ ID NO: 1090 - DNA, 650 bp, Homo sapiens
  CDS 286..648
  misc_feature 18: m=a or c
  misc_feature 19: r=a or g
  misc_feature 397: s=g or c
  misc_feature 400: m=a or c
  misc_feature 559: w=a or t
  misc_feature 595: w=a or t
  misc_feature 608: w=a or t
  misc_feature 624: w=a or t
  UNSURE 38: Xaa=Ala or Pro
  UNSURE 39: Xaa=Pro or Thr
  UNSURE 92: Xaa= *  or Lys
  UNSURE 104: Xaa=Phe or Ile
  UNSURE 108: Xaa=Asp or Val
  UNSURE 113: Xaa=Phe or Leu
accgagctccgtcgtctmrtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccascamcgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggwaactatttgagaaatatggaaaggcaggcgaagtcwtcattcataaggwtaaaggatttggcttwatccgcttggaaacccgaaccctagc

SEQ ID NO: 1091 - DNA, 447 bp, Homo sapiens
  CDS 83..445
  misc_feature 356: w=a or t
  misc_feature 392: w=a or t
  misc_feature 405: w=a or t
  misc_feature 421: w=a or t
  UNSURE 92: Xaa= *  or Lys
  UNSURE 104: Xaa=Phe or Ile
  UNSURE 108: Xaa=Asp or Val
  UNSURE 113: Xaa=Phe or Leu
cttttttttttctcgggacgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggwaactatttgagaaatatggaaaggcaggcgaagtcwtcattcataaggwtaaaggatttggcttwatccgcttggaaacccgaaccctagc

SEQ ID NO: 1092 - DNA, 643 bp, Homo sapiens
  CDS 279..641
  misc_feature 18: m=a or c
  misc_feature 19: r=a or g
  misc_feature 552: w=a or t
  misc_feature 588: w=a or t
  misc_feature 601: w=a or t
  misc_feature 617: w=a or t
  UNSURE 92: Xaa= *  or Lys
  UNSURE 104: Xaa=Phe or Ile
  UNSURE 108: Xaa=Asp or Val
  UNSURE 113: Xaa=Phe or Leu
accgagctccgtcgtctmrtttccggcggtcgcgcgctcttttctcgggacgggagaggccgtgtagcgtcgccgttatccgaggagataccagtcggtagaggagaagtcgaggttagagggaactgggaggcactttgctgtctgcaatcgaagttgagatggagtttcactcttgtgcaatggcacaatctcggctcacggcaacctccgcctcccaggttcaagtgattctcctggctcagcctcctgagtaactgggattacagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggwaactatttgagaaatatggaaaggcaggcgaagtcwtcattcataaggwtaaaggatttggcttwatccgcttggaaacccgaaccctagc

SEQ ID NO: 1093 - DNA, 611 bp, Homo sapiens
  CDS 247..609
  misc_feature 520: w=a or t
  misc_feature 556: w=a or t
  misc_feature 569: w=a or t
  misc_feature 585: w=a or t
  UNSURE 92: Xaa= *  or Lys
  UNSURE 104: Xaa=Phe or Ile
  UNSURE 108: Xaa=Asp or Val
  UNSURE 113: Xaa=Phe or Leu
cttttttttttctcgggacgggagaggccgtgtagcgtcgccgttatccgaggagataccagtcggtagaggagaagtcgaggttagagggaactgggaggcactttgctgtctgcaatcgaagttgagatggagtttcactcttgtgcaatggcacaatctcggctcacggcaacctccgcctcccaggttcaagtgattctcctggctcagcctcctgagtaactgggattacagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggwaactatttgagaaatatggaaaggcaggcgaagtcwtcattcataaggwtaaaggatttggcttwatccgcttggaaacccgaaccctagc

SEQ ID NO: 1094 - DNA, 711 bp, Homo sapiens
  CDS 18..710
  misc_feature 81: n=a, g, c or t
  UNSURE 22: Xaa=Leu or Met or Val
gatttgatatcaaatcaatggcagggaacattattcctgctattgctactactaatgcagtaattgctgggttgatagtantggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagcc

SEQ ID NO: 1095 - DNA, 380 bp, Homo sapiens
  CDS 202..378
  misc_feature 201: s=g or c
  misc_feature 324: s=g or c
  misc_feature 334: m=a or c
  misc_feature 370: w=a or t
  UNSURE 41: Xaa=Asp or Glu
  UNSURE 45: Xaa=His or Asn
  UNSURE 57: Xaa=Cys or Ser
agttctgctttaggacccgccccccagcacgctcctcgacgctgcgaggtcccgccccgcgtgctggccgcggtaaaagtggtagcagcggaggcgagcggagggtttcccgcggcggatttctgacagtcagacttgtccacaagaactcaactggcaaggctgcttttctgtgctaaaactggggagctagtgggcacsatgaagatcttctgcagtcgggccaatccgaccacggggtctgtggagtggctggaggaggatgaacactatgattaccaccaggagattgcaaggtcatcttatgcagatatgctacatgasaaagacagamatgtaaaatactaccaaggtatccgggctgccgtgwgcagggaagg

SEQ ID NO: 1096 - DNA, 371 bp, Homo sapiens
  CDS 74..370
gtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaga

SEQ ID NO: 1097 - DNA, 400 bp, Homo sapiens
  CDS 198..398
  misc_feature 359: m=a or c
  misc_feature 366: r=a or g
  UNSURE 57: Xaa=Asp or Asn
aagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggmgattggrattcaagtaaatacaactgttccactcaacatgc

SEQ ID NO: 1098 - DNA, 366 bp, Homo sapiens
  CDS 11..364
  misc_feature 340: n=a, g, c or t
  UNSURE 110: Xaa=Ile or Met
ttttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaatngacaagctgatcaagactgcagtgac

SEQ ID NO: 1099 - DNA, 249 bp, Homo sapiens
  CDS 27..248
  misc_feature 95: n=a, g, c or t
  UNSURE 23: Xaa=Arg or Ser
aaccccgcctccctccccgccccgcgatgtcggaagaaacccgacagagcaaattggccgcagcgaagaaaaagttgagagaatatcagcagagnaatagccctggtgttcctacaggagcgaaaaagaagaagaaaataaaaaatggcagtaaccctgagacaaccacttctggtggttgccactcacctgaggatgtgagtcttggatggccaggctcctggggacagggggcccaaggggcagtag

SEQ ID NO: 1100 - DNA, 450 bp, Homo sapiens
  CDS 99..449
  misc_feature 271: n=a, g, c or t
  UNSURE 58: Xaa=Ile or Asn or Ser or Thr
aaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtanttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactac

SEQ ID NO: 1101 - DNA, 278 bp, Homo sapiens
  CDS 43..276
gaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaac

SEQ ID NO: 1102 - DNA, 211 bp, Homo sapiens
  CDS 58..210
aggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagaga

SEQ ID NO: 1103 - DNA, 336 bp, Homo sapiens
  CDS 88..336
acctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttattaccgagactatgacgagggccgcagtttttctcatgatcgaagaagtggtccacctcacagaggagatgaatctggtt

SEQ ID NO: 1104 - DNA, 507 bp, Homo sapiens
  CDS 65..505
  misc_feature 79: y=c or t
  misc_feature 91: k=g or t
ccctagctttccttttccggttgcggcgccgcgcggtgaggttgtctagtccacgctcggagccatgccgtccaagggyccgctgcagtckgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggtctggtgcccgcgctcgctaccagaaatcctaccgataagcc

SEQ ID NO: 1105 - DNA, 437 bp, Homo sapiens
  CDS 98..436
aaaaagcgggctgtctcggaaactcagagccgggttcctcccgggtttctgccgggtttctccctgcggctcctgggttgttgagactcttgtgaagatggcttgcgctgccgcgcggtccccggccgaccaggacaggtttatttgtatctatcctgcttatttaaataataagaagaccatcgcagagggaaggcgaatccccataagtaaggctgttgaaaatcctacagctacagagattcaagatgtatgttcagcagttggacttaacgtatttcttgagaaaaataaaatgtactctagagaatggaatcgtgatgtccaatacagaggcagagtccgggtccagctcaaacaggaagatgggagcctctgccttgtacagttcccatcacgtaagtcagtaatgttgtatgcagcagaaatgataccta

SEQ ID NO: 1106 - DNA, 395 bp, Homo sapiens
  CDS 72..395
  misc_feature 370: w=a or t
  UNSURE 100: Xaa=Glu or Val
ctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgwagaagttcgacaggtgggtcctata

SEQ ID NO: 1107 - DNA, 406 bp, Homo sapiens
  CDS 117..404
aaaatgtgtcagttatcagcaggatccatgccgccagagtaaagctttctaccctttactccctgcaaagaaacaagagtgcttatcccagctaagctccagggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagcca

SEQ ID NO: 1108 - DNA, 438 bp, Homo sapiens
  CDS 232..438
  misc_feature 58: y=c or t
acttattatttattcgttttccaaagaagcgactagggacccaagtttaaaaattccyccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcag

SEQ ID NO: 1109 - DNA, 458 bp, Homo sapiens
  CDS 38..457
  misc_feature 102: n=a, g, c or t
  misc_feature 437: s=g or c
  misc_feature 438: r=a or g
  misc_feature 443: w=a or t
  UNSURE 22: Xaa=Ala or Asp or Gly or Val
  UNSURE 134: Xaa=Glu or Gly or Gln or Arg
  UNSURE 136: Xaa= *  or Lys
gcaaaccccagaggagctcggcctgcgctgcgccacgatgtccggggagtcagccaggagcttggggaagggaagcgcgcccccggggccggtcccggaggnctcgatccgcatctacagcatgaggttctgcccgtttgctgagaggacgcgtctagtcctgaaggccaagggaatcaggcatgaagtcatcaatatcaacctgaaaaataagcctgagtggttctttaagaaaaatccctttggtctggtgccagttctggaaaacagtcagggtcagctgatctacgagtctgccatcacctgtgagtacctggatgaagcatacccagggaagaagctgttgccggatgacccctatgagaaagcttgccagaagatgatcttagagttgttttctaaggtgccatccttggtaggaagctttattagaagcsraaatwaagaagactatgatg

SEQ ID NO: 1110 - DNA, 234 bp, Homo sapiens
  CDS 15..233
caaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacac

SEQ ID NO: 1111 - DNA, 378 bp, Homo sapiens
  CDS 174..377
  misc_feature 357: r=a or g
  misc_feature 358: n=a, g, c or t
  misc_feature 359: n=a, g, c or t
  UNSURE 62: Xaa=Ala or Asp or Glu or Gly or Ile or Lys or Met or Asn or Arg or Ser or Thr or Val
gcagtcgcgccggcgctgggcgaggaagcggaccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaarnnggcggaaaaaacagatcaa

SEQ ID NO: 1112 - DNA, 380 bp, Homo sapiens
  CDS 69..380
aaaacaatagtggaggaacccgagccgcacggaacggcggtggtggcccgcggaccggacggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgcacaaaataag

SEQ ID NO: 1113 - DNA, 376 bp, Homo sapiens
  CDS 155..376
aattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgag

SEQ ID NO: 1114 - DNA, 328 bp, Homo sapiens
  CDS 80..328
agagggcgggccttccgggacgaggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaa

SEQ ID NO: 1115 - DNA, 391 bp, Homo sapiens
  CDS 171..389
tttttttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccgcctctaaagagagcaatcactacacttatggctgggattttgcgcttagtagttcaatggcccccaggcagactacagaccgtgacaaaaggtgtggagtctcttatttgtacagattggattcgtcacaaattcaccagatcaagaattccagaaaaagtgtttcaggcctcacctgaagatcatgaaaaatacggtggggatccacagaaccctcataaactgcatattgttaccagaataaaaag

SEQ ID NO: 1116 - DNA, 328 bp, Homo sapiens
  CDS 132..326
cacttttaaatacatttgacatccttggcagccctggccatcatcagtaccacttaacatatttccaaggagtctggtatgtttgggagtgcctccttgcctcagactaaattggccaatccaccaagtgaatgcctgaatctctactaggctggtttgaacctgttgtgtgtaccttaagaatgaaaaatactagacatctgtcacttcatccaattaagtcctaccttggtttattaatagaactaagagcctcacataggtcacctgactccttcttcagtagatgccatttcaatagattttgcaatccctctgataccagcgc

SEQ ID NO: 1117 - DNA, 369 bp, Homo sapiens
  CDS 39..368
  misc_feature 308: k=g or t
ttgttttttctcctttcaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtkaagctgctgttagatgccgatgtgtgtaatgtggatcaccagaacaaggcaggctacaccc

SEQ ID NO: 1118 - DNA, 446 bp, Homo sapiens
  CDS 83..445
  misc_feature 283: r=a or g
  misc_feature 431: n=a, g, c or t
  misc_feature 432: n=a, g, c or t
  UNSURE 117: Xaa= *  or Ala or Glu or Gly or Lys or Leu or Met or Pro or Gln or Arg or Ser or Thr or Val or Trp
atcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctrttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacganngaacaaagcagcac

SEQ ID NO: 1119 - DNA, 420 bp, Homo sapiens
  CDS 217..420
  misc_feature 3: k=g or t
  misc_feature 47: n=a, g, c or t
  misc_feature 48: n=a, g, c or t
  misc_feature 339: r=a or g
  misc_feature 368: n=a, g, c or t
  misc_feature 369: n=a, g, c or t
  misc_feature 373: n=a, g, c or t
  UNSURE 51: Xaa= *  or Cys or Phe or Leu or Ser or Trp or Tyr
  UNSURE 53: Xaa=Leu or Met or Val
ggktccgctccctggggcgcacgtcagtcaggaggcggaagcgcagnngaggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactgacaaagagaaaagaaaactacttatgcagaaccagtcttcaacaaatcatcctggarctaggtattgacactataatgtgggtttnntgtntgttttgttttgttttgttttgttttgagacggagtctcgccctgtc

SEQ ID NO: 1120 - DNA, 244 bp, Homo sapiens
  CDS 38..244
cgaaaaatataaaatatcaagttataccagctatcccatgcatgatttctacagatgtcatacttgtaacaccacagatcgaaatgccatatgtgtgaactgcattaagaagtgccatcagggacatgatgtagagtttattagacatgataggtttttctgtgactgtggtgctggaacactgtctaatccttgtacattagctggtgagcctacacatgatacagatacactatatgactct

SEQ ID NO: 1121 - DNA, 454 bp, Homo sapiens
  CDS 41..454
  misc_feature 8: m=a or c
agaagtcmtcctgggccacccctacgacgtggccattgacatgtggagcctgggctgcatcacggcggagttgtacacgggctaccccctgttccccggggagaatgaggtggagcagctggcctgcatcatggaggtgctgggtctgccgccagccggcttcattcagacagcctccaggagacagacattctttgattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctct

SEQ ID NO: 1122 - DNA, 262 bp, Homo sapiens
  CDS 62..262
tctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcat

SEQ ID NO: 1123 - DNA, 413 bp, Homo sapiens
  CDS 226..411
  misc_feature 374: r=a or g
  misc_feature 384: r=a or g
  UNSURE 50: Xaa=His or Arg
gtctttgtaaggagaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcrtgcaagaggrcatgcgaaagtacgctggactgaatctag

SEQ ID NO: 1124 - DNA, 544 bp, Homo sapiens
  CDS 333..542
aactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatgggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagat

SEQ ID NO: 1125 - DNA, 254 bp, Homo sapiens
  CDS 75..254
attgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagac

SEQ ID NO: 1126 - DNA, 293 bp, Homo sapiens
  CDS 46..291
  misc_feature 143: m=a or c
  misc_feature 225: k=g or t
  UNSURE 33: Xaa=Asn or Thr
  UNSURE 60: Xaa=Cys or Trp
agaacctcggtgacggttggccagtttttttacagtggctctgaaatgagagaaattgcagaaattctccctgctcaggaaaaggtagaggcaaggattgacttaaagatgggtaagaagcgtgttactgatcataagctaamtgtggacaaagtaattaaaaatattaacacaatttcttcggagttgaagaagataaaagagctctcccagttattgctttgkgaccttatcctacattttaatcatcccatcaagactgagaacttagcagaagcagaaagaaacaaccc

SEQ ID NO: 1127 - DNA, 532 bp, Homo sapiens
  CDS 107..532
tcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcgccaagtttcctttcaaccagtggggcctgcagcctcgaagtctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacac

SEQ ID NO: 1128 - DNA, 467 bp, Homo sapiens
  CDS 162..467
gattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggcaggtaaaaatcaaggtgaccccaagaaaatggctcctcctccaaaggaggtagaagaagatagtgaagatgaggaaatgtcagaagatgaagaagatgatagcagtggagaagaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaa

SEQ ID NO: 1129 - DNA, 377 bp, Homo sapiens
  CDS 97..375
acctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatga

SEQ ID NO: 1130 - DNA, 411 bp, Homo sapiens
  CDS 106..411
  misc_feature 365: r=a or g
  UNSURE 87: Xaa=Asn or Ser
actttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgagtttaatggctatgctgggarcctcttctcaagtggaccctacgagaaagatgatgaggaagcagat

SEQ ID NO: 1131 - DNA, 505 bp, Homo sapiens
  CDS 263..505
  misc_feature 139: m=a or c
  misc_feature 447: n=a, g, c or t
  UNSURE 62: Xaa=Ala or Asp or Gly or Val
gcggttgtgtctgggaaggagagaaaatggcggcggagcgaacaagaccgaaatccagactctttttaagaggcttcgcgcagttccaaccaacaaggcctgtttcgactgcggcgccaagaatccgagttgggccagmatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgncgttcctaatcactccccagagaagaaggactctgatttcttcacagaacacactcaa

SEQ ID NO: 1132 - DNA, 488 bp, Homo sapiens
  CDS 331..486
ctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttccgacaccttctgtggcttcagtagtttcaaaaagtggcctttcccactggagttgcttcacttagctctacaatcaacccatgtggacatttattc

SEQ ID NO: 1133 - DNA, 582 bp, Homo sapiens
  CDS 386..580
  misc_feature 151: y=c or t
  misc_feature 508: r=a or g
  misc_feature 525: n=a, g, c or t
  UNSURE 47: Xaa=Ile or Asn or Ser or Thr
gccctgtggagcatccctgcggtggactctggccagcctgagtgacgcgatccaaagagcgctcccgggtaggaaattccccgggtggaacgcctcgccagagcagcacgtagcaggcccccgaggaggattaacacactggctgaacacygggaaggaactggcacttggagtccggacatctgaaacttgaattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatggatgccagtgaaatttggtgccgtgactcggatcggggaagctcccttaggagatcaatcccctgtcctcctgctctttgtttcgtgaggaagatccacctacgacctctggtcctcagrccaaccagcccaaggancatctcaccaattttaaatccgttcctttcctttcctggtagagacgaaggagacgc

SEQ ID NO: 1134 - DNA, 330 bp, Homo sapiens
  CDS 89..328
  misc_feature 2: n=a, g, c or t
  misc_feature 10: n=a, g, c or t
  misc_feature 17: m=a or c
  misc_feature 18: m=a or c
  misc_feature 21: n=a, g, c or t
angttctgcnttgtctmmgcngcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacg

SEQ ID NO: 1135 - DNA, 480 bp, Homo sapiens
  CDS 31..480
  misc_feature 87: k=g or t
gctgccgggtgaaatcgtaggacagtgaagatgctgctggaattgtccgaggagcataaggaacacctggccttcctgcctcaagtkgacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagaacaacaaaaaagtgatggaactggatgctctcccagtcttacatttc

SEQ ID NO: 1136 - DNA, 273 bp, Homo sapiens
  CDS 98..271
  misc_feature 11: y=c or t
  misc_feature 13: y=c or t
  misc_feature 221: m=a or c
  misc_feature 222: y=c or t
  UNSURE 42: Xaa=Leu or Met or Pro or Thr
gctgcggtgaytyttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaatggtgacactccatggmygagagagattcagatctctccttcccccaagccacacgcctccctgcctcc

SEQ ID NO: 1137 - DNA, 512 bp, Homo sapiens
  CDS 113..511
  misc_feature 2: k=g or t
  misc_feature 4: k=g or t
  misc_feature 10: y=c or t
  misc_feature 20: k=g or t
  misc_feature 510: n=a, g, c or t
  UNSURE 133: Xaa=Cys or Phe or Ser or Tyr
aktkacaggyagggcgggckgggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtnca

SEQ ID NO: 1138 - DNA, 377 bp, Homo sapiens
  CDS 17..376
agaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattg

SEQ ID NO: 1139 - DNA, 732 bp, Homo sapiens
  CDS 98..730
  misc_feature 368: m=a or c
  misc_feature 401: r=a or g
  misc_feature 537: s=g or c
  UNSURE 102: Xaa=Ile or Val
  UNSURE 147: Xaa=Ser or Thr
gggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatmggaccagtgtccctaaggaagtagttgattatrtcatctttggtacagttattcaggaagtgaaaacaagcaatgtggctagagaggctgcccttggagctggcttctctgacaagactcctgctcacactgtcaccatggcttgtatctctgccaaccaagccatgascacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaagtgcctagcacctgagct

SEQ ID NO: 1140 - DNA, 332 bp, Homo sapiens
  CDS 166..330
gggcaggacccgccccttggtcccgcagagccttggtacttggacctgaaccttgctccgagagggagtcctcgcggacgtcagccaagattccagaatgactactatcttgacttaccccctatagttggggtgagtggggacccacaggctcaggaggctgagatgggccaggggcacattccatttccgagagcccccataggctgcccaccctgccctggggtctggggcccagggtctggtgcggagagggcccacagtggacttggtgacgctgtatgccctcaccgctcagcccctggggctggcttggcagacagtacagcatc

SEQ ID NO: 1141 - DNA, 316 bp, Homo sapiens
  CDS 14..316
  misc_feature 242: n=a, g, c or t
  misc_feature 311: m=a or c
  UNSURE 77: Xaa=Ala or Pro or Ser or Thr
  UNSURE 100: Xaa=Lys or Gln
tttgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactctncctgcatttccaacaagtttgccaacgatggtagcttcttgcagcagtttctgaagttgcagaaggcamagacc

SEQ ID NO: 1142 - DNA, 558 bp, Homo sapiens
  CDS 283..558
agggcgtggcttctcgtagccattaggaaagagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggag

SEQ ID NO: 1143 - DNA, 529 bp, Homo sapiens
  CDS 254..529
agctccatgttcctaagcctgcctcactggtttcggagggctggagagcagctcagctcgctagctgcgcgcttcccggcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagatggtacatcaggataactgctcgtatcaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacag

SEQ ID NO: 1144 - DNA, 442 bp, Homo sapiens
  CDS 141..440
  misc_feature 23: s=g or c
gtgcgtgcgtgggcgcgcgtgcsccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggct

SEQ ID NO: 1145 - DNA, 452 bp, Homo sapiens
  CDS 136..450
  misc_feature 400: w=a or t
  misc_feature 414: n=a, g, c or t
  misc_feature 422: k=g or t
  UNSURE 89: Xaa= *  or Lys
  UNSURE 93: Xaa=Asp or Glu
  UNSURE 96: Xaa=Leu or Arg
agtgctggggagcagggaggtgggaggggagggtgcccctacaaatcccgggggctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgwaagggaagagcgangaggagckgggagtgcaagagaaaaacagggagggcca

SEQ ID NO: 1146 - DNA, 347 bp, Homo sapiens
  CDS 77..346
  misc_feature 44: s=g or c
gtcttgggcgtcggtcgtcggtggggtcggagctgggcgcggasccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactactccccagagac

SEQ ID NO: 1147 - DNA, 435 bp, Homo sapiens
  CDS 86..433
  misc_feature 306: w=a or t
  misc_feature 307: k=g or t
  UNSURE 74: Xaa=Ile or Lys or Met or Asn
ttttttttttttccggtaggtcgccagctgaggcggtttgtaagttttgggtcgcagtatgctagaattttgaggctcccttctgatgaaaattgagctgtccatgcagccatggaacccgggttacagcagtgagggggccacggctcaagaaacttacacatgtccaaaaatgattgagatggagcaggcggaggcccagcttgctgagttagacctgctagccagtatgttccctggtgagaatgagctcatagtgaatgaccagctggctgtagcagaactgaaagattgtattgaaaagawkacaatggaggggcgatcttcaaaagtctactttactatcaatatgaacctggatgtatctgacgaaaaaatgactcagaaaattaaactggaagagaattttaattcgccatcgagaagacattcctt

SEQ ID NO: 1148 - DNA, 341 bp, Homo sapiens
  CDS 61..339
  misc_feature 276: n=a, g, c or t
  UNSURE 72: Xaa=Asp or Glu
gcagtgcgcggcttttgctcggacctggagtaatgagagtggacgtttgattccaacaggatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgangaagaaatggaaaaatgcacatctgatcggaatcagggtgaagaatgcggctatgatacagttgt

SEQ ID NO: 1149 - DNA, 479 bp, Homo sapiens
  CDS 79..477
  misc_feature 2: n=a, g, c or t
  misc_feature 209: k=g or t
  UNSURE 44: Xaa=Ile or Ser
tncttttgctgattttgcctcacagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttakctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgaga

SEQ ID NO: 1150 - DNA, 560 bp, Homo sapiens
  CDS 200..559
ctctttgcggggcgcaccggcaggctcccagccccgcttcgtcgcagcggcttgggccctccggccctccgtagccgctcgactgtcgcgctgcaccagcttcctcctcggcgttccccacgcctatttgggcggattcttggcgccggaggaagaggcagggtcaccctctctccacgtcagagacctgactgtggagatggcggctcagaagataaacgaggggctggaacacctcgccaaagcagagaaatacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgag

SEQ ID NO: 1151 - DNA, 550 bp, Homo sapiens
  CDS 132..548
acacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcgtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttc

SEQ ID NO: 1152 - DNA, 393 bp, Homo sapiens
  CDS 112..393
agcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcaag

SEQ ID NO: 1153 - DNA, 656 bp, Homo sapiens
  CDS 200..655
  misc_feature 437: m=a or c
  misc_feature 438: r=a or g
  UNSURE 80: Xaa=Lys or Gln or Arg
aattttccggtctctatgctttctcatccggccggcttgctttcccctgcggtcgtccagactattgggcgctaggagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttmrgttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagact

SEQ ID NO: 1154 - DNA, 472 bp, Homo sapiens
  CDS 262..471
  misc_feature 87: w=a or t
  misc_feature 298: n=a, g, c or t
  UNSURE 13: Xaa=Phe or Ile or Leu or Val
aaaaagcagcaattaaagtcagcccagcaccaactccgacgccaagcgttacactggaaactactttttaaagcaacaaaagagtcwaaaacaaaatacaacatttcttaaatacactgtttccagaaagagctattttaacagaagcaactcaaagatatcccttcgacagaagtggaagtgctgaaaaatgctcatctctcacacagacttttgatggacaggagtttctaagtatcatgcctaccaacaagctgtaaaatgatcaccctgaacaatcaagatcaacctgtccctnttaacagctcacatccagatgaatacaaaattgcagcccttgtcttctatagctgtatcttcataattggattatttgttaacatcactgcattatgggttttcagttgtaccaccaagaagagaaccacggtaaccatctatatgatgaatgtggcattagtggacttgatat

SEQ ID NO: 1155 - DNA, 427 bp, Homo sapiens
  CDS 144..425
  misc_feature 57: m=a or c
agtcctccggggattagagccggtgggctcgttgtgggcgccatttctcggcgtctmccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagc

SEQ ID NO: 1156 - DNA, 604 bp, Homo sapiens
  CDS 174..602
  misc_feature 133: n=a, g, c or t
  misc_feature 135: w=a or t
  misc_feature 137: n=a, g, c or t
  misc_feature 140: k=g or t
agattttgagagccttttgtactatatgcaactaacttgatttcaagcttgggaaccttttaaaaaaaacattaaaagcaaaatgtaagtatataaggaataccaaatcaaatttatagactaatctttttcnawtnagkattttaagagtctttttcttctttataggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaagcttacaaatacgcctttgataagtatagagaccaatacaactggttcttccttgcacgc

SEQ ID NO: 1157 - DNA, 605 bp, Homo sapiens
  CDS 175..603
tttcgcggcgctcgtttcctggcgctccccacctttagcgagaccaacgagagaacaccgcctgcagctagaacagcctggtcaggagcgtaacggagtggatgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaagcttacaaatacgcctttgataagtatagagaccaatacaactggttcttccttgcacgc

SEQ ID NO: 1158 - DNA, 415 bp, Homo sapiens
  CDS 13..414
  misc_feature 294: y=c or t
gtgccgcgggggatgccgggagcgcgcagtggcggcagcggcggcgacggcagtaacagcggcagctacagcggggacgcgagcggggcggtgacggtgtgggaggtggtctcactcttgggaaaactgctgggcaccgtcgtcgcgctgaaggtggttctgtacctgctccgagtgtgcttagcgatggcctggaaatccggcggcgccagccactcggagctaatccacaatctccgcaaaaatggaatcatcaagacagataaagtatttgaagtgatgctggctacagaycgctcccactatgcaaaatgtaacccatacatggattctccacaatcaataggtttccaagcaacaatcagtgctccacacatgcatgcatatgcgctagaacttctatttgatcagttgc

SEQ ID NO: 1159 - DNA, 277 bp, Homo sapiens
  CDS 113..277
  misc_feature 41: s=g or c
agaggcggcgtggagatcgctgggagcggttgcggcgtgcsgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgtggatttgaagaagtcattgtggttacaa

SEQ ID NO: 1160 - DNA, 460 bp, Homo sapiens
  CDS 94..459
  misc_feature 18: s=g or c
  misc_feature 138: y=c or t
  misc_feature 450: m=a or c
  misc_feature 451: n=a, g, c or t
  UNSURE 120: Xaa=Leu or Met or Val
atatgctgggacagcccscccctagaacgctttgcgtcccgacgcccgcaggtcctcgcggtgcgcaccgtttgcgacttggtacttggaaaaatggacaaggattgtgaaatgaaacgcaccacactggacagcccyttggggaagctggagctgtctggttgtgagcagggtctgcacgaaataaagctcctgggcaaggggacgtctgcagctgatgccgtggaggtcccagcccccgctgcggttctcggaggtccggagcccctgatgcagtgcacagcctggctgaatgcctatttccaccagcccgaggctatcgaagagttccccgtgccggctcttcaccatcccgttttccagcaagagtcgttcaccagacaggtgttatggaagctgctgaaggttgtgaaattcggagaagtgatttcttaccagcaattagcagcmntggcaggca

SEQ ID NO: 1161 - DNA, 474 bp, Homo sapiens
  CDS 129..473
  misc_feature 353: r=a or g
  UNSURE 75: Xaa=Ile or Met
cggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttatrccttatatgaaaaaatacaaaattcaaaaggataagccagagacatgggaaaaccaatggaagtgtttcaaagttcttctctttaatcacttctgtatccagctgcctttgatttgtggaa

SEQ ID NO: 1162 - DNA, 362 bp, Homo sapiens
  CDS 77..361
aggtgtccgccccacggccggcgttgccgggtaacggcgagcgcgtggggccaagaaagaatacctcctctgaaaaatggcagaagcagttttccatgccccaaagaggaaaagaagagtgtatgagacttacgagtctccattgccaatcccttttggtcaggaccatggtcctctgaaagaattcaagatattccgtgctgaaatgattaacaacaatgtgattgtgaggaatgcggaggacattgagcagctctatgggaaaggttattttggaaaaggtattctttcaagaagccgtccaagcttcacaatttcagatcctaaactggttgctaaatggaaagatatgaagacaaaca

SEQ ID NO: 1163 - DNA, 266 bp, Homo sapiens
  CDS 7..264
agaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgg

SEQ ID NO: 1164 - DNA, 629 bp, Homo sapiens
  CDS 384..629
  misc_feature 139: m=a or c
  misc_feature 407: r=a or g
  misc_feature 562: n=a, g, c or t
  misc_feature 563: n=a, g, c or t
  misc_feature 609: r=a or g
  UNSURE 60: Xaa=Ala or Asp or Glu or Gly or Val
  UNSURE 76: Xaa=Gly or Ser
attttgcacctagaaattttaggcaagtgatagctgcgtaatcatactgcggcaccgtttttttcttgcagcagtagctgcttgcggaggaggtctgcccactgcagctctctgcagtctccggctctctcctgcaggmtcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaargagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggnnaacggtgaagatactgctgctgggtccggggaagatgggaaaaaargtggcgatactgatgaggac

SEQ ID NO: 1165 - DNA, 488 bp, Homo sapiens
  CDS 193..486
  misc_feature 347: r=a or g
  UNSURE 52: Xaa=Asn or Ser
gccaatggcgggggagtgttgttagcgcgcgccttccggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttartacaaattctacaaaatcagtgcctaattcaacacgcaaaataaaagacacttgtattcagtcaccaagcaaagagtgcagaaatcacatccaaagtcagttccagtttcttcaaagaagaaagaagctctctacagtttg

SEQ ID NO: 1166 - DNA, 370 bp, Homo sapiens
  CDS 81..368
aaaaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtctt

SEQ ID NO: 1167 - DNA, 481 bp, Homo sapiens
  CDS 81..479
aaaaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtctt

SEQ ID NO: 1168 - DNA, 400 bp, Homo sapiens
  CDS 74..400
gaaaggataagaaagggagtgggactggcgcctacggtggccgaagtgggacgcgccgagccggaggtgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaag

SEQ ID NO: 1169 - DNA, 338 bp, Homo sapiens
  CDS 27..338
  misc_feature 50: k=g or t
  misc_feature 171: r=a or g
  UNSURE 49: Xaa=Asp or Asn
aatcctgagaggtcgggaccggcaagatggcggcgcggacagcgttcggkgctgtgtgccggcgcctctggcagggattggggaatttttctgtaaacacttctaagggcaatacagccaaaaatggtggcttgcttctcagtaccaatatgaagtgggtacagttttcaracctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatc

SEQ ID NO: 1170 - DNA, 364 bp, Homo sapiens
  CDS 176..364
aatcctgagaggtcgggaccggcaagatggcggcgcggacagcgttcggtgctgtgtgccggcgcctctggcagggattggggaatttttctgtaaacacttctaagggcaatacagccaaaaatggtggcttgcttctgtttctctttttttccccacacatagcagtaccaatatgaagtgggtacagttttcaaacctacacgttgatgttccaaaggatttgaccaaacctgtggtaacaatctctgatgaaccagacatattatataagcgcctctcggttttggtgaaaggtcacgataaggctgtattggacagttatgaatattttgctgtgcttgctgctaaagaacttggtatc

SEQ ID NO: 1171 - DNA, 403 bp, Homo sapiens
  CDS 42..401
ttaagcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagtcctcatg

SEQ ID NO: 1172 - DNA, 358 bp, Homo sapiens
  CDS 56..358
  misc_feature 16: m=a or c
aaaaaggtcggacggmagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaa

SEQ ID NO: 1173 - DNA, 491 bp, Homo sapiens
  CDS 164..490
gttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagg

SEQ ID NO: 1174 - DNA, 355 bp, Homo sapiens
  CDS 203..355
tccagcacttccgggtgagggaggccgggccgcgagacgggaaggccctgggcaagaacgctgagaaacgggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggag

SEQ ID NO: 1175 - DNA, 520 bp, Homo sapiens
  CDS 84..518
ctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacgg

SEQ ID NO: 1176 - DNA, 438 bp, Homo sapiens
  CDS 69..437
  misc_feature 57: s=g or c
  misc_feature 80: w=a or t
agaggaagtcctgctcttacagtgacatgggctgaattaaattcccagaatccgcascaaccagcaccatgcccatgacwctggggtactggaacatccgcgggctggcccattccatccgcctgctcctggaatacacagactcaagctacgaggaaaagaagtacacgatgggggacgctcctgattatgacagaagccagtggctgaatgaaaaattcaagctgggcctggactttcccaatctgccctacttgattgatgggactcacaagatcacccagagcaacgccatcctgcggtacattgcccgcaagcacaacctgtgcggggaatcagaaaaggagcagattcgcgaagacattttggagaaccagtttatggacagccgtatgcagctggccaaactctgctatgacccagattttgtaagtcccc

SEQ ID NO: 1177 - DNA, 442 bp, Homo sapiens
  CDS 74..442
ccccttatgtcgggtataaagcccctcccgctcacagtttccctagtcctcgaaggctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgac

SEQ ID NO: 1178 - DNA, 373 bp, Homo sapiens
  CDS 137..373
  misc_feature 27: w=a or t
  misc_feature 67: k=g or t
ttcggcagcctgaacacccggtgtgawaggtaggtggcagacgtggagcggcgcgcatgctcagcakctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattataga

SEQ ID NO: 1179 - DNA, 277 bp, Homo sapiens
  CDS 85..276
  misc_feature 68: m=a or c
  misc_feature 69: r=a or g
  misc_feature 78: k=g or t
gcacatgcgcggcagctcccgctgctgaatagctgagaggcgcacccgggcggccagctgggctcggmrtgcagcggkgttaggatggacgaggacgtgttgcaccctgaagagcctcatcatcgcctgctcttgaggttcacagatgatacctttgatccagaacttgcagcaacaataggtgagcctgtgtttaaaaattcaatagaaatgtctaatattttcttgcctttgggctttttttatctaaatccttctaccttcctcttaccacgcc

SEQ ID NO: 1180 - DNA, 522 bp, Homo sapiens
  CDS 24..521
  misc_feature 10: s=g or c
  misc_feature 11: s=g or c
ccccttcccssgcccggacggccatggccattcccggcatcccctatgagagacggcttctcatcatggcggaccctagagataaggcgcttcaggactaccgcaagaagttgcttgaacacaaggagatcgacggccgtcttaaggagttaagggaacaattaaaagaacttaccaagcagtatgaaaagtctgaaaatgatctgaaggccctacagagtgttgggcagatcgtgggtgaagtgcttaaacagttaactgaagaaaaattcattgttaaagctaccaatggaccaagatatgttgtgggttgtcgtcgacagcttgacaaaagtaagctgaagccaggaacaagagttgctttggatatgactacactaactatcatgagatatttgccgagagaggtggatccactggtttataacatgtctcatgaggaccctgggaatgtttcttattctgagattggagggctatcagaacagatccgggaattaagagaggtgatagaattacctc

SEQ ID NO: 1181 - DNA, 455 bp, Homo sapiens
  CDS 299..454
aatttagcatgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgtcaggacctgacagcttccgcttctttaccagggaatcccttgctgctattgaacaacgcattgcagaagagaaagctaagagacccaaacaggaacgcaaggatgaggatgatgaaaatggcccaaagccaa

SEQ ID NO: 1182 - DNA, 456 bp, Homo sapiens
  CDS 75..455
  misc_feature 173: y=c or t
gaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttyaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctc

SEQ ID NO: 1183 - DNA, 305 bp, Homo sapiens
  CDS 73..303
agcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcac

SEQ ID NO: 1184 - DNA, 443 bp, Homo sapiens
  CDS 234..443
  misc_feature 242: s=g or c
  UNSURE 3: Xaa=Lys or Asn
agcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaasactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgat

SEQ ID NO: 1185 - DNA, 268 bp, Homo sapiens
  CDS 71..268
aagagttgtagccgaggtggcggcgcggggcggggcgggcggagagagaagaaggaggtggttgtgcaggatggcgacggcggcctacgagcagctgaagctgcatatcacacctgaaaaattttatgtggaagcttgtgatgatggagcagatgacgtacttaccattgaccgtgtgtccacagaggttacccttgcagtcaagaaagatgttcctccttcagctgtcacaagaccaatatttggtatactgggcacaatccatctg

SEQ ID NO: 1186 - DNA, 340 bp, Homo sapiens
  CDS 77..340
  misc_feature 184: s=g or c
  misc_feature 186: m=a or c
  UNSURE 36: Xaa=Arg or Ser
  UNSURE 37: Xaa=Ser or Tyr
aagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcagstmcacagaaaagttctccaagtccccactcgacccaggaagtcctgctgtcttcacctgtcaccagctactggggaggctgaggcaggagaatcgcttgaacccaggaggtggaggttgctgggagccaagccaagatcacgccactacactccag

SEQ ID NO: 1187 - DNA, 238 bp, Homo sapiens
  CDS 28..237
  misc_feature 12: s=g or c
  misc_feature 157: y=c or t
  misc_feature 172: w=a or t
  misc_feature 207: w=a or t
  UNSURE 44: Xaa=Pro or Ser
  UNSURE 49: Xaa= *  or Lys
  UNSURE 60: Xaa=Phe or Leu
atcatcaaaatsagatcataagtgttaatgtacactggacatgaaaacaaagactggtttagcagacattggtttactctgcagcctgtgttttctgtttccccctttcccacctccttccccccacccaatccttttttttttcttttttgctttycttttcttttttttwagtttttatttactttacctagtatgccttttttwagttgcttctcaagtcagaaaacttttcagg

SEQ ID NO: 1188 - DNA, 620 bp, Homo sapiens
  CDS 260..619
  misc_feature 577: w=a or t
atgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacwgcaaagatgtacaggggtggcaaaatatgcctgacggatcatt

SEQ ID NO: 1189 - DNA, 571 bp, Homo sapiens
  CDS 211..570
  misc_feature 528: w=a or t
cttttgattctgcatggtttctaatctttatcaggagttaaacatccttctacaggataactgcatctagaggcaggactatatataagcaaaggaaaagttcttcgaagaggaaacacgaatcgctcgttttaggaataaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacwgcaaagatgtacaggggtggcaaaatatgcctgacggatcatt

SEQ ID NO: 1190 - DNA, 575 bp, Homo sapiens
  CDS 292..573
  misc_feature 17: s=g or c
  misc_feature 113: m=a or c
  misc_feature 215: r=a or g
  misc_feature 221: w=a or t
  misc_feature 223: r=a or g
  misc_feature 227: y=c or t
cctttgcaattgccttsggtcctgccgcacagagcggcctgtctttatcagaggtccctctgccagggggagggccccagagaaaaccagaaaagagggtgagagactgaggmagataaagcgtcccagggcctcctacaccagcgcctgagcaggaagcgggaggggccatgactacgaggccctgggaggtcactttagggagggctgtcctraaaccwgragcytggagcagaaagtgaaaccctggtgctccagacaaagatcttagtcgggactagccggccaaggatgaagcctcacttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtgtattcccagcctgagcaccacgcagaaatgtgcttcctctcttggttctgtggcaaccagctgcctgcttacaagtgtttccagatcacctggtttgtatcctggacccc

SEQ ID NO: 1191 - DNA, 693 bp, Homo sapiens
  CDS 30..692
  misc_feature 413: w=a or t
  misc_feature 417: r=a or g
  UNSURE 128: Xaa=Phe or Leu
  UNSURE 130: Xaa=Ala or Thr
gtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtggcttwagarcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcataccacctacagcccaggtggttggcgtgcttaagattcaggttcactattatgaagatggcaatgttcagttggttagtcataaagatgtacaggattcactaactgtttcgaatgaag

SEQ ID NO: 1192 - DNA, 429 bp, Homo sapiens
  CDS 84..428
  misc_feature 300: n=a, g, c or t
  misc_feature 301: r=a or g
  misc_feature 303: n=a, g, c or t
  misc_feature 357: k=g or t
  misc_feature 358: r=a or g
  misc_feature 366: w=a or t
  misc_feature 367: n=a, g, c or t
  misc_feature 371: s=g or c
  UNSURE 73: Xaa=Cys or Asp or Gly or His or Asn or Arg or Ser or Tyr
  UNSURE 74: Xaa=Ala or Pro or Ser or Thr
  UNSURE 92: Xaa= *  or Glu or Gly
  UNSURE 95: Xaa=Cys or Phe or Ile or Asn or Ser or Thr or Tyr
  UNSURE 96: Xaa=His or Gln
atcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcaccnrtncctactacaggggagcagctggagcactgctggtgtacgacattacaaggcgtkraaccttcwnccasctgacctcatggttagaggatgcccggcagcactctagttccaacatggttatcatgc

SEQ ID NO: 1193 - DNA, 325 bp, Homo sapiens
  CDS 149..325
  misc_feature 107: r=a or g
  misc_feature 305: n=a, g, c or t
  UNSURE 53: Xaa=Phe or Ile or Leu or Val
tatggaaaccatccctagtcaaggacactttaaatatatagtctaaataccgttaaggtaggcccactagctgtgttcacattttcccttggccaccttaccagggrctttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccntcattatacttttaactgca

SEQ ID NO: 1194 - DNA, 448 bp, Homo sapiens
  CDS 153..446
  misc_feature 16: s=g or c
attgcgcctgcgccasgccggctgcgagactggggccgtggctgctggtcccgggtgatgctaggcggctccctgggctccaggctgttgcggggtgtaggtgggagtcacggacggttcggggcccgaggtgtccgcgaaggtggcgcagcatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagca

SEQ ID NO: 1195 - DNA, 459 bp, Homo sapiens
  CDS 80..457
  misc_feature 313: n=a, g, c or t
  misc_feature 314: n=a, g, c or t
  UNSURE 78: Xaa=Ile or Met
  UNSURE 79: Xaa=Asp or His or Asn or Tyr
aaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatnnattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtct

SEQ ID NO: 1196 - DNA, 310 bp, Homo sapiens
  CDS 78..308
  misc_feature 7: m=a or c
  misc_feature 8: y=c or t
  misc_feature 272: s=g or c
  misc_feature 297: y=c or t
  UNSURE 65: Xaa=Lys or Asn
  UNSURE 74: Xaa=Phe or Leu
gcaaacmyttcccgtcaattggcagaaaacaaccttgaggaaccttgacgagtgtccggagtttagaaaacttagggatggagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaascgatgcacagagagtgtggcttcaytcgcctcaagccc

SEQ ID NO: 1197 - DNA, 463 bp, Homo sapiens
  CDS 193..462
gaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaatccaggtcgaggtcaaggagacattctcatagacgttacactcgatccagatcccactctcactctcataggagacgatctcgaagtagatcatatacaccagaata

SEQ ID NO: 1198 - DNA, 447 bp, Homo sapiens
  CDS 3..446
  misc_feature 76: s=g or c
  misc_feature 77: m=a or c
  misc_feature 426: r=a or g
  UNSURE 25: Xaa=Ala or Gly
  UNSURE 142: Xaa=Asp or Asn
taatgcgcccgccgtgtccatggagagaagctgaggcggccgaccttcggcccgaggcaccggggcgccgggacgsmaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaracatcaaagggacttgtggct

SEQ ID NO: 1199 - DNA, 405 bp, Homo sapiens
  CDS 33..404
gcgcatgcgcgctcccctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcaca

SEQ ID NO: 1200 - DNA, 430 bp, Homo sapiens
  CDS 94..429
ttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatg

SEQ ID NO: 1201 - DNA, 403 bp, Homo sapiens
  CDS 28..402
aaccagggacgaccgcggccaccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaacctggatgagaagctacggtgggccttcaagctctacgacttggacaatgatggctacatcaccaggaatgagatgctggacattgtgga

SEQ ID NO: 1202 - DNA, 461 bp, Homo sapiens
  CDS 88..459
  misc_feature 414: n=a, g, c or t
  misc_feature 425: n=a, g, c or t
  misc_feature 426: n=a, g, c or t
  UNSURE 109: Xaa=Arg or Ser
  UNSURE 113: Xaa= *  or Cys or Phe or Leu or Ser or Trp or Tyr
taaagttaagagtggcgccagggatttgaaccgcgctgacgaagttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagncaggatctctnnagctactgcaaaagttccttctccaccagacgagc

SEQ ID NO: 1203 - DNA, 401 bp, Homo sapiens
  CDS 224..400
  misc_feature 244: n=a, g, c or t
  misc_feature 335: r=a or g
  UNSURE 7: Xaa=Lys or Asn
  UNSURE 38: Xaa=Met or Val
agaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccccgtgcgcgcttcgacgttgctgctgttggctctcctcgcccctcgtcccttgggaaccgcctgggaactccgccatgtcatccacttcgcccaanctccagaaagcgatagatctggctagcaaagcagcgcaagaagacaaggctgggaactacgaagaagcccttcagctctatcagcatgctrtgcagtattttcttcatgtcgttaaatatgaagcacagggtgataaagccaagcaaagtatcaggg

SEQ ID NO: 1204 - DNA, 430 bp, Homo sapiens
  CDS 60..428
agggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaag

SEQ ID NO: 1205 - DNA, 387 bp, Homo sapiens
  CDS 35..385
aaccatttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagca

SEQ ID NO: 1206 - DNA, 431 bp, Homo sapiens
  CDS 220..429
  misc_feature 406: y=c or t
  UNSURE 63: Xaa= *  or Arg
cctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtygaatcagagcagataataaactgga

SEQ ID NO: 1207 - DNA, 855 bp, Homo sapiens
  CDS 653..853
  misc_feature 478: m=a or c
  misc_feature 636: m=a or c
  misc_feature 675: r=a or g
  misc_feature 830: y=c or t
  UNSURE 8: Xaa=Glu or Gly
  UNSURE 60: Xaa= *  or Arg
cctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggmtatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcaggctggmtactatctataaagagatggtcactcaagctcaacaggraataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtygaatcagagcagataataaactgga

SEQ ID NO: 1208 - DNA, 439 bp, Homo sapiens
  CDS 106..438
  misc_feature 12: n=a, g, c or t
  misc_feature 13: n=a, g, c or t
  misc_feature 14: s=g or c
aaccgacgcgcnnstgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccgg

SEQ ID NO: 1209 - DNA, 287 bp, Homo sapiens
  CDS 94..285
  misc_feature 260: y=c or t
  UNSURE 56: Xaa=Leu or Ser
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgccctygggaggaagaaaaagccatcgacgtca

SEQ ID NO: 1210 - DNA, 406 bp, Homo sapiens
  CDS 253..405
  misc_feature 98: r=a or g
  misc_feature 99: m=a or c
  misc_feature 372: r=a or g
  UNSURE 40: Xaa=Ile or Met
tttgtaaatgaaggaacatggctgtgttccaataaaactttatgaaaacagtgagctgaatttagcctacaggccataatacgccaatcctgctctarmcaataaaactgatccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattatraacatctatttatcgagtgacaatacaaaccgaa

SEQ ID NO: 1211 - DNA, 346 bp, Homo sapiens
  CDS 150..344
agcagaatagaggcgccagaagatgcgccatgaggatacacattggccaatcagcttcagcaatggagcgtgcaaaacaccagtgagcttctgtcttgctggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaaggtaagtgatctcttcttcctgccagagggatggaggaggctggattcttgtatccggga

SEQ ID NO: 1212 - DNA, 515 bp, Homo sapiens
  CDS 134..514
gagcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgg

SEQ ID NO: 1213 - DNA, 426 bp, Homo sapiens
  CDS 134..424
gagcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcataggggggtcgcgttcacttctggttccggagctgattggacagccagtccagtccttcatagagcccgtcgccgctggtggcgcaggtggcctgaatgtactccattttttccacatcaccatcgacattcggaatgtctgtgtgttcctggccccactcttctcctccttcaccaccatcgtcac

SEQ ID NO: 1214 - DNA, 304 bp, Homo sapiens
  CDS 98..304
ctagtgcgttacttacctcgactcttagcttgtcggggacggtaaccgggacccggtgtctgctcctgtcgccttcgcctcctaatccctagccactatgcgtgagtgcatctccatccacgttggccgggctggtgtccggattggcaatgcctgctgggagctctactgcctggccatccgttgtccttctggcttcaaaatttctgctattattactgtttttcctccttttgatcttccttttgggcgcgttgttctcgtcgcgggcgcccttgctgccgccgatgatgacatccgccgc

SEQ ID NO: 1215 - DNA, 304 bp, Homo sapiens
  CDS 65..304
aagcgcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaat

SEQ ID NO: 1216 - DNA, 324 bp, Homo sapiens
  CDS 82..324
  misc_feature 167: n=a, g, c or t
  misc_feature 301: k=g or t
  UNSURE 29: Xaa=Ala or Glu or Gly or Val
  UNSURE 74: Xaa=Leu or Val
aggttgcagttgggcgctcagcagctgtggcagccggttgaggtctggcagtagcgttgggctgaagcagcggagttcgccatgcgcgagtgtatctctatccacgtggggcaggcgggtgtccagatcggcaatgcctgctgggaactgtactgccttgaacatgnaattcagcccgatggccaaatgccaagtgataaaaccattggtggcggggacgactccttcaacacgttcttcagtgagactggagctggcaagcacgtgcccagagcagtgtttgtggacctggagcccactktggtcgatgaagtgcgcacaggg

SEQ ID NO: 1217 - DNA, 414 bp, Homo sapiens
  CDS 126..413
  misc_feature 344: n=a, g, c or t
  UNSURE 73: Xaa=Asp or Glu
cgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagancgcaatgcctatgtctggagtcagaaagatggtgtttggaagccaaccctggtgatcctgagaattaatc

SEQ ID NO: 1218 - DNA, 255 bp, Homo sapiens
  CDS 96..254
  misc_feature 2: n=a, g, c or t
  misc_feature 3: y=c or t
  misc_feature 244: r=a or g
  UNSURE 50: Xaa=Asn or Ser
anytggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagartcaggttggag

SEQ ID NO: 1219 - DNA, 561 bp, Homo sapiens
  CDS 142..561
  misc_feature 43: w=a or t
  misc_feature 44: n=a, g, c or t
  misc_feature 55: n=a, g, c or t
  misc_feature 56: r=a or g
  misc_feature 62: w=a or t
  misc_feature 63: r=a or g
  misc_feature 454: r=a or g
  misc_feature 459: r=a or g
  misc_feature 495: m=a or c
  UNSURE 105: Xaa=Met or Val
aaaaatattggaaaaaaaaacatgatgagaagtctataaaaawngtgtgctaccnragatcwrtcttatttggcagctgctgcctcacccacagcttttgatatctaggaggcactcttctctcccaaactacctgtcaccatggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtgrtgggratcaagttagaccaaggaggtgctcctcttgcaggmacaaacaaagaaaccaccattcaagggcttgatggcctctcagagcgctgtgctcagtacaagaaa

SEQ ID NO: 1220 - DNA, 496 bp, Homo sapiens
  CDS 159..494
  misc_feature 291: y=c or t
  misc_feature 323: k=g or t
  misc_feature 452: r=a or g
  UNSURE 55: Xaa=Lys or Asn
aagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcytggcagtgcaggttcaaaatgaagaaggcaaktgtgaggtgacggaagtgagtaagcttgatggagaggcatccattaacaatcgcaaagggaaacttatcttcttttatgaatggagcgtcaaactaaactggacaggtacttctaagtcaggagtacartacaaaggacatgtggagatcccaatttgtctgatgaaacagcg

SEQ ID NO: 1221 - DNA, 406 bp, Homo sapiens
  CDS 159..404
aagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcatcccaaagtgctgggattacaggcaggaaccacggcccctggccctcatcatagtcttaagtgtcgttgttgccttcaaaaacct

SEQ ID NO: 1222 - DNA, 1776 bp, Homo sapiens
  CDS 1388..1774
  misc_feature 752: n=a, g, c or t
  misc_feature 765: m=a or c
  misc_feature 771: s=g or c
  misc_feature 1158: n=a, g, c or t
  misc_feature 1159: y=c or t
  misc_feature 1180: s=g or c
  misc_feature 1211: r=a or g
  misc_feature 1218: w=a or t
  misc_feature 1561: k=g or t
agaggagactcgggggccattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgcttcgttcagtatgttaatgagagaaatgccngggctgctgtagmagagasgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggtttnygatattaacctggctgcagascaaaagtgaaccgaggaaaagcaggtgtgaracgaagwctgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgtkaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacg

SEQ ID NO: 1223 - DNA, 1094 bp, Homo sapiens
  CDS 706..1092
  misc_feature 245: n=a, g, c or t
  misc_feature 476: n=a, g, c or t
  misc_feature 477: y=c or t
  misc_feature 498: s=g or c
  misc_feature 529: r=a or g
  misc_feature 536: w=a or t
  misc_feature 879: k=g or t
tttttttttgtgaagagacgaagactgagcggttgtggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacattttcggctttgtgagaaaccttaccatcaaacacgatggcnagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgcttcgttcagtatgttaatgagagaaatgccgggctgctgtagcaggagaggatggcagaatgattgctggccaggtttnygatattaacctggctgcagascaaaagtgaaccgaggaaaagcaggtgtgaracgaagwctgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgtkaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacg

SEQ ID NO: 1224 - DNA, 410 bp, Homo sapiens
  CDS 129..410
ttttctcctcctcctcagggctccagtcaggccgatccgctccgctcacggaaggaaaacagaaataacttgctggcttgtctggagtcacatggtgacaatttacagaaagtcatctctgcagcttgatgggcgacaacccttttcaaccaaaaagtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaaatattttgaacagagttaaccccagctcatattcaaggggactaaagaatggtgcactcagtcgaggtattactgctgcattcaagcctacaagtcaacactacacg

SEQ ID NO: 1225 - DNA, 608 bp, Homo sapiens
  CDS 394..606
  misc_feature 387: w=a or t
  misc_feature 467: y=c or t
  misc_feature 552: m=a or c
  UNSURE 25: Xaa=Phe or Ser
agtgtctgatgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaattggattgwagagagatggacttatatgaggactaccagtccccgtttgattttgatgcaggagtgaacaaaagctatctctacttgtytcctagtggaaattcatctccacccggatcacctactcttcagaaatttggtctgctgagaacagacccagtccctgaggaaggmgaagatgttgctgccacgatcagtgccacagagaccctctcggaagaggagcagga

SEQ ID NO: 1226 - DNA, 282 bp, Homo sapiens
  CDS 118..282
atttaatgtaagaaattaggtgctttcagagttaatggaaagctaaaacagaagacattagggtccatcactagcttcagggtcacggcactgtggctatgagagggagcccctaaaatgactgctagccatgcaacaggaggcagccacctgcgtagacagggatgggtgcctggtgaaacccaccttcaagccaaaaacagcctgaaggctgaaagactggaccgctggtgccggatgaaaccgagacgcagagtgagaacttctgttcctgtttgcccg

SEQ ID NO: 1227 - DNA, 460 bp, Homo sapiens
  CDS 206..460
  misc_feature 128: r=a or g
  misc_feature 407: n=a, g, c or t
  UNSURE 68: Xaa=Ala or Pro or Ser or Thr
aaatttaaagccggcttccggaagccgggacgatgtccgcatgacaaccgacgttggagtttggaggtgcttgccttagagcaagggaaacagctctcattcaaaggaactagaagcctctccctcartggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccagnctggcctggtcaacctcctattccataagttcaaagggaccatcatcctgaca

SEQ ID NO: 1228 - DNA, 463 bp, Homo sapiens
  CDS 42..461
  misc_feature 4: n=a, g, c or t
  misc_feature 362: y=c or t
ctcntcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaayctgatcaatttgcttgctgaaaatggtcgattaagcaatacccaaggagtcgtttctgccttttctaccatgatgagtgtccatcgcggagaggtaccttg

SEQ ID NO: 1229 - DNA, 355 bp, Homo sapiens
  CDS 128..355
gtgcgtgtttccggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagcttatcacacagactttcagccaccacaatcagctggcacagaagacccggcgggagaagagagcccgg

SEQ ID NO: 1230 - DNA, 329 bp, Homo sapiens
  CDS 128..328
  misc_feature 69: y=c or t
  misc_feature 309: n=a, g, c or t
  UNSURE 61: Xaa=Cys or Phe or Ser or Tyr
gtgcgtgtttccggctccgctgcggaaggcggacgactagagtcgttgggcccggcgcgacccgcagaygcgtagagagcgcgggactagagtgcagagctccgggacgtggatcggagccggcgcgatgggcggagagcaggaggaggagcggttcgacggcatgttgctggccatggctcagcagcacgagggcggcgtgcaggagcttgtgaacaccttcttcagcttccttcgacgcaaaacagactttttcattggaggagaagaagggatggcagagaagattggcaggagagagaatgagtnccagcagaagaaatgccaga

SEQ ID NO: 1231 - DNA, 566 bp, Homo sapiens
  CDS 330..566
  misc_feature 269: y=c or t
  misc_feature 454: w=a or t
  misc_feature 455: n=a, g, c or t
  misc_feature 470: n=a, g, c or t
  UNSURE 42: Xaa=Ile or Lys or Met or Asn
cccctccgctccaggcttccttctgcaacaggcgtgggtcacgctctcgctcggtctttctgccgccatcttggttccgcgttccctgcacaaaatgcccggcgaacacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatygatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacawngtttttggggaagcnaagatcgaagatttatcccagcaagcacaactagcagctgctgagaaattcaaagttcaaggtgaagctgtctcaaacattcaagaaaacacacag

SEQ ID NO: 1232 - DNA, 309 bp, Homo sapiens
  CDS 91..309
cgatctggaggaggagaagtaagcggtggggggtgggagccatctggtactttgacagcattcaaaacagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcggccatgggctcccaggggaacctgtctgctgaggtg

SEQ ID NO: 1233 - DNA, 630 bp, Homo sapiens
  CDS 233..628
  misc_feature 147: w=a or t
  misc_feature 595: n=a, g, c or t
  misc_feature 596: n=a, g, c or t
  UNSURE 122: Xaa=Gly or Arg or Trp
cttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaaactwatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggnnggatgatctatactgggctgaagaactttgaaag

SEQ ID NO: 1234 - DNA, 540 bp, Homo sapiens
  CDS 281..538
  misc_feature 500: r=a or g
  UNSURE 74: Xaa=Ala or Thr
gacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgrcattgaaatatggcgccaagcatgtgatcatgctctttgt

SEQ ID NO: 1235 - DNA, 380 bp, Homo sapiens
  CDS 75..380
  misc_feature 9: s=g or c
attgtcgtsgtcgttgcccgaccgctttccgggagactggagtcgaaggccgtgaggtatttttctaagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagac

SEQ ID NO: 1236 - DNA, 349 bp, Homo sapiens
  CDS 117..347
  misc_feature 9: n=a, g, c or t
  misc_feature 12: m=a or c
  misc_feature 157: k=g or t
  UNSURE 14: Xaa=Leu or Arg
acaggtatnccmggcccctcccagtcagaccccacaggaaaacttggctcccagtaagttaccgctctcctggaagcacagaacggacttttcgtgtcccgctgtaaggaaacaagatggtccttaaaaccgaagaggaggacgttcccagtgacckgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatgga

SEQ ID NO: 1237 - DNA, 532 bp, Homo sapiens
  CDS 325..531
  misc_feature 319: k=g or t
  misc_feature 344: r=a or g
  misc_feature 347: s=g or c
  misc_feature 391: r=a or g
  misc_feature 404: r=a or g
  misc_feature 406: r=a or g
  misc_feature 480: s=g or c
  misc_feature 488: k=g or t
  misc_feature 494: s=g or c
  misc_feature 498: k=g or t
  misc_feature 506: w=a or t
  misc_feature 513: w=a or t
  UNSURE 7: Xaa=Asp or Gly
  UNSURE 8: Xaa=Arg or Thr
  UNSURE 23: Xaa=Gly or Arg
  UNSURE 27: Xaa=Asp or Gly
  UNSURE 28: Xaa=Gly or Arg
  UNSURE 52: Xaa= *  or Tyr
  UNSURE 55: Xaa=Leu or Trp
  UNSURE 57: Xaa=Ala or Gly
  UNSURE 58: Xaa=Phe or Leu
  UNSURE 61: Xaa=Ile or Asn
  UNSURE 63: Xaa= *  or Cys
ttttatttttggtctggctgttgtggtgtgcaaaactccgtacattgctattttgccacactgcaacaccttacagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagakgaggcatgaaggatgaccgtcgggrcasatactctgcgggcaaaaggggtggatttaatacctttagagacrgggaaaattatgrcrgaggttactctagcctgcttaaaagagattttggggcaaaaactcagaatggtgtttacagtgctgcaaattasaccaaatkggaagstttkggagtaawtttgtgwctgctggtatacagaccag

SEQ ID NO: 1238 - DNA, 396 bp, Homo sapiens
  CDS 165..395
  misc_feature 75: y=c or t
  misc_feature 178: r=a or g
  misc_feature 310: s=g or c
  misc_feature 361: r=a or g
  UNSURE 5: Xaa=Cys or Tyr
  UNSURE 49: Xaa=Arg or Thr
  UNSURE 66: Xaa=Asp or Gly
agtggtagcgcggggactggctgggaagcggtcggtcgagtgtggcctgtgtggactcgcatcttgcccgaagcygggcggaggagagctcaagctaagggtgatcagcccatgacctaaacctccagacaaaataaaacagggaaaatttgctagaatcaagaatgatggatccatrttcagttggagtccagcttcgtactacaaatgagtgccataaaacctactatactcgtcacacaggttttaagactttgcaagaattgtcatcaaatgatatgcttttacttcaacttagaactggaatgasactttctgggaacaatacaatttgctttcatcatgtaaaaatttacattgrcagatttgaggatttacagaagtcatgttgtgacc

SEQ ID NO: 1239 - DNA, 320 bp, Homo sapiens
  CDS 79..318
  misc_feature 313: n=a, g, c or t
  misc_feature 314: r=a or g
  misc_feature 315: r=a or g
  UNSURE 79: Xaa= *  or Glu or Gly or Lys or Gln or Arg or Trp
ggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagaggcccaatcaagaaccttaaagagcaactttctatgaaaagatctcagtgggaaatggaaaaacataatctggaaagcacaatgaaaacatacgtaagcnrrctgaa

SEQ ID NO: 1240 - DNA, 583 bp, Homo sapiens
  CDS 260..583
  misc_feature 188: s=g or c
  misc_feature 192: s=g or c
  misc_feature 193: n=a, g, c or t
  misc_feature 396: r=a or g
  misc_feature 403: s=g or c
  misc_feature 424: s=g or c
  misc_feature 523: n=a, g, c or t
  misc_feature 530: s=g or c
  UNSURE 46: Xaa=Glu or Gly
  UNSURE 48: Xaa=Lys or Asn
  UNSURE 55: Xaa=Asp or Glu
  UNSURE 88: Xaa=Ile or Met
  UNSURE 91: Xaa=Ala or Pro
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttsggasnttgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgragagaasgagtgtctgctcttcctggasgagaccattcgctcactggacacggaggctgacagcggactgtccactgacgagtctgagccagccacaactcccagaggtttccgagcactgcccatnacccaasccactccccggggaggtccagaggagaccatcactcagcaaggacgaacgcca

SEQ ID NO: 1241 - DNA, 477 bp, Homo sapiens
  CDS 69..476
  misc_feature 65: n=a, g, c or t
aacgtccggtcaaggcagccatctcgccgtgagacagcaagtgtcggatccgcaggcgcagcgtngcgatgttgtcctctacagccatgtattcggctcctggcagagacttggggatggaaccgcacagagccgcgggccctttgcagctgcgattttcgccctacgttttcaacggaggtactatactggcaattgctggagaagattttgcaattgttgcttctgatactcgattgagtgaagggttttcaattcatacgcgggatagccccaaatgttacaaattaacagacaaaacagtcattggatgcagcggttttcatggagactgtcttacgctgacaaagattattgaagcaagactaaagatgtataagcattccaataataaggccatgactacgggggcaattgctgcaatgctgtctacaatcctgtattcaaggcgcttctttccatactatgtttacaaca

SEQ ID NO: 1242 - DNA, 547 bp, Homo sapiens
  CDS 279..545
  misc_feature 1: k=g or t
  misc_feature 2: n=a, g, c or t
  misc_feature 3: n=a, g, c or t
  misc_feature 4: n=a, g, c or t
  misc_feature 56: r=a or g
  misc_feature 57: m=a or c
  misc_feature 75: s=g or c
  misc_feature 99: s=g or c
  misc_feature 101: r=a or g
  misc_feature 102: s=g or c
  misc_feature 106: k=g or t
  misc_feature 110: r=a or g
  misc_feature 125: y=c or t
  misc_feature 127: w=a or t
  misc_feature 258: y=c or t
  misc_feature 259: w=a or t
  misc_feature 268: r=a or g
  misc_feature 271: r=a or g
knnnctcccgcgggcgtcggcagggtcggcggcgtcggcagcagtgtcgacggcarmgggtgggaaatggcggastatctggcctccatcttcggcacsarsaaakacaragtcaactgttcatytwatttcaaaattggagcatgtcgtcatggagacaggtgctctcggttgcacaataaaccgacgtttagccagaccattgccctcttgaacatttaccgtaaccctcaaaactcttcccagtctgctgacggywgcgcggcgrcgrgtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatgaa

SEQ ID NO: 1243 - DNA, 358 bp, Homo sapiens
  CDS 170..358
  misc_feature 118: r=a or g
ataggcattcaggtgaagaagaatggagaaaacaggtaaaaataaaaataagtactgtctttgtgatgtggttattcatgatccttccatattgcttttgaatgacatatttatctargcaactgttgtaagttaaagctaaaactgactgttctttgatcaattttgaatgtttaggatacagcagttaaaacagttactggaggattctacctcaggtgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgag

SEQ ID NO: 1244 - DNA, 375 bp, Homo sapiens
  CDS 149..373
  misc_feature 357: n=a, g, c or t
  UNSURE 70: Xaa=Ala or Asp or Gly or Val
gctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttgncagtcactttgatgattt

SEQ ID NO: 1245 - DNA, 411 bp, Homo sapiens
  CDS 134..409
aatcatgcaggaaactagatactgagaaaacagttgtagctcagcgtggctacaagtaactgtggtgtggaagcagagtagagagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggacagc

SEQ ID NO: 1246 - DNA, 445 bp, Homo sapiens
  CDS 94..444
  misc_feature 62: s=g or c
  misc_feature 63: n=a, g, c or t
  misc_feature 324: k=g or t
ctcctccgccgccggctcccgggtgtggtggtcgctccagctctctgctctcccagcgcagsncgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtkcgggaggggctgaacgtggtgaagacaggccgagtgatgcttggggagaccaatccagcagattcaaagccaggcaccattcgtggggacttctgcattcaggttggcaggaacatcattc

SEQ ID NO: 1247 - DNA, 348 bp, Homo sapiens
  CDS 98..346
gtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtttagtcccaggaagcaccactctgcacagtgctgagattttggctgaaatcgcccggatccttcggcctggtggatgtctttttctgaagga

SEQ ID NO: 1248 - DNA, 338 bp, Homo sapiens
  CDS 184..336
agagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgt

SEQ ID NO: 1249 - DNA, 484 bp, Homo sapiens
  CDS 176..484
  misc_feature 13: y=c or t
  misc_feature 447: n=a, g, c or t
  UNSURE 91: Xaa=Ile or Asn or Ser or Thr
gccgccgcccgcyctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatantttagaaaacatcccagaaaagtggacccagaagtca

SEQ ID NO: 1250 - DNA, 468 bp, Homo sapiens
  CDS 159..467
  misc_feature 12: s=g or c
  misc_feature 392: s=g or c
  misc_feature 421: r=a or g
  misc_feature 422: s=g or c
  UNSURE 78: Xaa=His or Gln
  UNSURE 88: Xaa=Lys or Asn or Arg or Ser
aggaagcggaasactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccascatgccccgttggccaggctggtctcgarsaccttacctcaggtgatctcccacctttgggattacagacctgcat

SEQ ID NO: 1251 - DNA, 494 bp, Homo sapiens
  CDS 100..492
aaaagtgttagcggggaacgctgggaaactcccggcctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatat

SEQ ID NO: 1252 - DNA, 308 bp, Homo sapiens
  CDS 141..308
ctcagcggtaggggccggggaagtgtctgtagcgtccctccctctcaaccacaataacaggcggagggtcggcgtaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttagatacctccctctgcaggatatcatgtgtatgttctttccc

SEQ ID NO: 1253 - DNA, 338 bp, Homo sapiens
  CDS 183..338
  misc_feature 260: n=a, g, c or t
  misc_feature 264: k=g or t
  misc_feature 265: k=g or t
  UNSURE 28: Xaa=Cys or Phe or Gly or Val
gacagacaccatattgccggccaagcttaaaacatgtatgaatgtgacctctggtctagaaaactgacctcataccagttcagttttttagcagataatcctttgtagatgatgatgggttcaacacaatagtaaaggtttagcctttaaaagactcccaggtatgtattacaggttgatctatgacagaagtaatgaaagttagaaaaagatggctgggaatagtggctcatgcctataatttcagcactttgggaggncggkkcaggaggatctcttggggccaggagtttgagaccagcctgggcaacacagacactttctctacaaaaaaaaaa

SEQ ID NO: 1254 - DNA, 748 bp, Homo sapiens
  CDS 138..746
  misc_feature 482: k=g or t
  misc_feature 483: r=a or g
  misc_feature 681: n=a, g, c or t
  UNSURE 115: Xaa=Cys or Trp
  UNSURE 116: Xaa=Glu or Lys
  UNSURE 182: Xaa= *  or Glu or Lys or Gln
gagttcggcatgcaagagcggaagaaaagcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgkraaagaattgccgatatttctcaggtctacacacagaatgctgaaatgaggcctcttggttgttgtatgattttaattggtatagatgaagagcaaggccctcaggtatataagtgtgatcctgcaggttactactgtgggtttaaagccactgcagcgggagttaaacaaactgagtcaaccagcttccttgaaaaanaagtgaagaagaaatttgattggacatttgagcagacagtggaaactgcaattacatgcctgtctac

SEQ ID NO: 1255 - DNA, 626 bp, Homo sapiens
  CDS 73..624
  misc_feature 15: r=a or g
  misc_feature 435: n=a, g, c or t
  misc_feature 559: n=a, g, c or t
  UNSURE 121: Xaa=Phe or Leu
  UNSURE 163: Xaa= *  or Glu or Lys or Gln
agggtagtgtcctargctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtacagagggcacgctatgaggcagctaactggaaatacaagtatggctatgagattcctgtggacatgctgtgtaaaagaattgccgatatttctcaggtctacacacagaatgctgaaatgaggcctcttggttgttgtatgattttnattggtatagatgaagagcaaggccctcaggtatataagtgtgatcctgcaggttactactgtgggtttaaagccactgcagcgggagttaaacaaactgagtcaaccagcttccttgaaaaanaagtgaagaagaaatttgattggacatttgagcagacagtggaaactgcaattacatgcctgtctac

SEQ ID NO: 1256 - DNA, 391 bp, Homo sapiens
  CDS 155..391
  misc_feature 121: n=a, g, c or t
  misc_feature 123: r=a or g
  misc_feature 127: m=a or c
  misc_feature 317: n=a, g, c or t
  UNSURE 55: Xaa=Gly or Arg or Trp
ctctctgggatgtgtagctttggaaatctgtctttgttgctctgggagaggggactcctggaatgtgtctgtgaataaagactagccgaaggtgcgaagtgactagacgggagcaaaggangraaamctagggaatgggagatactgtggcctcatgaataggaatgtctgcccatatgtcaggattggaaataatggtgaagatcaattaatcaaagacgtcttggataaattccttaattgtcatgagcaaacatatgatgaagaatttctgaacacttttactcatctttcacaagaggatcatgtgtccaaanggggagtgtttggaactgattcttcagaaaacatttttacctcagcaaaagttactcataaaaatgaagcagat

SEQ ID NO: 1257 - DNA, 343 bp, Homo sapiens
  CDS 101..343
aatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacaga

SEQ ID NO: 1258 - DNA, 454 bp, Homo sapiens
  CDS 83..454
  misc_feature 9: m=a or c
  misc_feature 401: n=a, g, c or t
  UNSURE 107: Xaa=Leu or Met or Val
agcggcagmagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgntgcttgctgaccaaatgatcagtcgcatcgaatacattcattcaaagaacttc

SEQ ID NO: 1259 - DNA, 260 bp, Homo sapiens
  CDS 34..258
acccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcc

SEQ ID NO: 1260 - DNA, 336 bp, Homo sapiens
  CDS 116..334
  misc_feature 235: r=a or g
  misc_feature 277: m=a or c
  misc_feature 287: r=a or g
  misc_feature 294: m=a or c
  misc_feature 305: r=a or g
  misc_feature 309: r=a or g
  misc_feature 314: r=a or g
  UNSURE 58: Xaa=Ile or Val
  UNSURE 60: Xaa=Ala or Asp
  UNSURE 64: Xaa=Asp or Asn
  UNSURE 65: Xaa=Lys or Arg
  UNSURE 67: Xaa=Glu or Lys
actcgttccctaacattaaagagaaaatgctgctatccgtgacttccaggcccgggatttcgacttttggctacaatagaaacaacaagaagccatatgtgcactggctcagcagatggcaccacctagcccaagcaacagtacacctaacagcagtagtggaagcaatggaaatgaccagctgagcaaaaccaacctatacatccgaggattgcaaccaggcactactgaccargatcttgtcaagctgtgtcagccatatggcaagattgtttcmactaaggccrtactggmcaagaccacaracaratgtraaggctatggctttgtagattt

SEQ ID NO: 1261 - DNA, 435 bp, Homo sapiens
  CDS 119..433
  misc_feature 53: s=g or c
  misc_feature 159: y=c or t
  misc_feature 355: y=c or t
  UNSURE 14: Xaa=Ala or Val
gcgcaggcgcggacggcgttggtttgaagaccttcagcgttgccctggcggasagagacaggccctcggggtggaggtctttggtttcataagagcctgagagagatttttctaagatatgtgtaacacaccaacgtactgtgacctaggaaaggctgytaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagayaatactctagggacagaaatctcttgggagaataagttggctgaagggttgaaactgactcttgataccatatttgtacc

SEQ ID NO: 1262 - DNA, 424 bp, Homo sapiens
  CDS 170..424
  misc_feature 176: n=a, g, c or t
  misc_feature 359: n=a, g, c or t
  misc_feature 360: k=g or t
  UNSURE 3: Xaa=Phe or Ile or Leu or Val
  UNSURE 64: Xaa=Cys or Phe or Gly or Ile or Leu or Arg or Ser or Val
acaggtggttgcagaagtttcgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtntctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacagttctcattnktttaccaggaccccctggaaacagctgtccctccacctactggctaccagagcttgctatggga

SEQ ID NO: 1263 - DNA, 456 bp, Homo sapiens
  CDS 228..455
  misc_feature 12: n=a, g, c or t
  misc_feature 409: s=g or c
  misc_feature 411: m=a or c
  misc_feature 415: y=c or t
  UNSURE 61: Xaa=Ala or Gly
  UNSURE 62: Xaa=Lys or Gln
  UNSURE 63: Xaa=Ala or Val
aaaagtagaggnaaaaccaccgaattgagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagstmaggyacctgacaatgatgagcagtttgtaccagactatcaggctg

SEQ ID NO: 1264 - DNA, 349 bp, Homo sapiens
  CDS 129..347
agaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaataccaaaggatgacctggacttccgcttagcagccttgtacaaccaccacactgggacattcaagaacaaaagtgagatactgttaaaccagaaaaccacgcaggatacctatagaaccaagatccaattccctggagaatttttaacccctcccactccacccatcactttcct

SEQ ID NO: 1265 - DNA, 322 bp, Homo sapiens
  CDS 141..320
  misc_feature 199: n=a, g, c or t
  UNSURE 20: Xaa=Ile or Asn or Ser or Thr
agctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaancaaagaggtagagactccctcggctggccgtgtggactttgcattcaatcagaatttggaagaaaagacttcatattcactggcaagactgcaggaccagaataaagccttggaagggcagct

SEQ ID NO: 1266 - DNA, 238 bp, Homo sapiens
  CDS 10..237
  misc_feature 204: r=a or g
  misc_feature 210: m=a or c
  UNSURE 67: Xaa=Asp or Glu
attgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaargctgamcgctccaggacgtccattctcatcattt

SEQ ID NO: 1267 - DNA, 458 bp, Homo sapiens
  CDS 187..456
  misc_feature 432: r=a or g
gaggtgtattagattgctgtgtgttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagargctgtgctctccactattttttacca

SEQ ID NO: 1268 - DNA, 252 bp, Homo sapiens
  CDS 48..251
agtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtgg

SEQ ID NO: 1269 - DNA, 540 bp, Homo sapiens
  CDS 367..540
  misc_feature 69: r=a or g
  misc_feature 129: w=a or t
  misc_feature 130: k=g or t
  misc_feature 132: r=a or g
  misc_feature 133: w=a or t
  misc_feature 137: n=a, g, c or t
cttttctttcgcgtctgcggtgctcggagtgtggtacttctcctagttgcagtcaggcttcatacgctrttgtcctgcccgtaagttcccgttttgtgtgtggttagagcagccagcgggtaacagaawkgrwtttnggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacct

SEQ ID NO: 1270 - DNA, 516 bp, Homo sapiens
  CDS 343..516
cttttttttcgcgtctgcggtgctcggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgcctacct

SEQ ID NO: 1271 - DNA, 440 bp, Homo sapiens
  CDS 25..438
atcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgc

SEQ ID NO: 1272 - DNA, 290 bp, Homo sapiens
  CDS 30..290
gcgtgcgccggtgggggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcaggga

SEQ ID NO: 1273 - DNA, 374 bp, Homo sapiens
  CDS 58..372
  misc_feature 5: m=a or c
gaaamaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctga

SEQ ID NO: 1274 - DNA, 436 bp, Homo sapiens
  CDS 137..436
  misc_feature 425: r=a or g
  UNSURE 97: Xaa=Ala or Thr
atttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtarctgctcactta

SEQ ID NO: 1275 - DNA, 416 bp, Homo sapiens
  CDS 12..416
aaatagtggtgatgtcatgcaggcaagatggcggaaggggaggacgtgggatggtggcggactggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagcctatgatggcaccaaggctcgcctctatagcctgcagtcggacccagcaa

SEQ ID NO: 1276 - DNA, 249 bp, Homo sapiens
  CDS 85..249
ctgaccacaaatgagccacctgggggcttgttgaaagcacggaatcctggcccacccactgccttgccgctgcccagcaaaaccatgtgggcccagcctctcctgtgggcacacccacacactgtccctctctctcccctttctttcccccaaagggccatgaccgttttccatgcagccctgcccggccctgccatcctgctcccagccccacgccgagaggacacctgtctgcctccctcctgccga

SEQ ID NO: 1277 - DNA, 372 bp, Homo sapiens
  CDS 55..372
aagaggacagacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcct

SEQ ID NO: 1278 - DNA, 592 bp, Homo sapiens
  CDS 259..591
aaaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaag

SEQ ID NO: 1279 - DNA, 411 bp, Homo sapiens
  CDS 56..409
  misc_feature 392: n=a, g, c or t
  UNSURE 113: Xaa=Ala or Pro or Ser or Thr
gtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcagattgtcttttaaagatgacatgccaaagtcagatgtcancaaagagtactatacacag

SEQ ID NO: 1280 - DNA, 364 bp, Homo sapiens
  CDS 119..364
  misc_feature 43: n=a, g, c or t
  misc_feature 206: n=a, g, c or t
  misc_feature 262: m=a or c
  misc_feature 352: r=a or g
  UNSURE 30: Xaa=Ala or Pro or Ser or Thr
  UNSURE 48: Xaa=Lys or Asn
  UNSURE 78: Xaa= *  or Trp
ggacgcgaggggcggggcgagcgcgggacaaagggaagcgaancggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatncatacagtcatctcgcctacaacaactacaggctgggagggaacccgggcaccaamagccgggtcacggtaggagaatcaactattacagcatccggcaaacaactggaattgaccagaaatgccttcagaattaggtctttttgratcataagcaca

SEQ ID NO: 1281 - DNA, 370 bp, Homo sapiens
  CDS 119..370
  misc_feature 175: m=a or c
  misc_feature 176: w=a or t
  misc_feature 186: s=g or c
  UNSURE 20: Xaa=Ser or Thr
  UNSURE 23: Xaa=Arg or Thr
ggacgcgaggggcggggcgagcgcgggacaaagggaagcgaaccggagctgcgggcgctttttctgcccgcggtgtctcagattcattcttaaggaactgagaacttaatcttccaaaatgtcaaaaagaccatcttatgccccacctcccaccccagctcctgcaacagcatcmwctggtatcasgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatac

SEQ ID NO: 1282 - DNA, 475 bp, Homo sapiens
  CDS 119..475
  misc_feature 373: n=a, g, c or t
  UNSURE 85: Xaa=Lys or Asn
ggacgcgaggggcggggcgagcgcgggacaaagggaagcgaaccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaangcttccaaccctgacctaaagttgtgggagattggcaagattattggtggcatgtggcgagatctcactgatgaagaaaaacaagaatatttaaacgaatac

SEQ ID NO: 1283 - DNA, 557 bp, Homo sapiens
  CDS 228..557
  misc_feature 258: r=a or g
  misc_feature 263: m=a or c
  UNSURE 11: Xaa=Gly or Ser
  UNSURE 12: Xaa=Lys or Asn
attttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgrgtaamctgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgag

SEQ ID NO: 1284 - DNA, 398 bp, Homo sapiens
  CDS 58..396
cccattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgccaacatccaggcc

SEQ ID NO: 1285 - DNA, 436 bp, Homo sapiens
  CDS 69..434
  misc_feature 9: k=g or t
  misc_feature 20: k=g or t
gtttttgtkacacgaggtckgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggt

SEQ ID NO: 1286 - DNA, 422 bp, Homo sapiens
  CDS 190..420
  misc_feature 42: s=g or c
  misc_feature 119: s=g or c
  misc_feature 375: k=g or t
gtcttctcccggaaatggtctaagccccagctcctggcggasgagctagcctgcgaatttcagcatgagtgtactgctgaggtcaggtttggggccgttgtgtgccgtggcgcgcgcascattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctacaggtatatggktcattagtgaatggatggccactggaaaaagcacagctttccagctg

SEQ ID NO: 1287 - DNA, 361 bp, Homo sapiens
  CDS 165..359
  misc_feature 16: y=c or t
  misc_feature 31: r=a or g
attaaaaagcccaacytttcctccatgttaratgtgacttggaaaatgagaaagatttagcaaaattccaccgtatcttttgccaggctagagacagggagagcagagtaaaaccctcaggctgctgaaatttctaggctgttaggaagcccctcgaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcat

SEQ ID NO: 1288 - DNA, 299 bp, Homo sapiens
  CDS 107..298
  misc_feature 163: s=g or c
  UNSURE 19: Xaa=Asp or Glu
gagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggasatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggct

SEQ ID NO: 1289 - DNA, 606 bp, Homo sapiens
  CDS 100..606
  misc_feature 92: y=c or t
acgtcatttcctgccgcctgtcttttccgtgctacctgcagaggggtccatacggcgttgttctggattcccgtcgtaacttaaagggaaaytttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcac

SEQ ID NO: 1290 - DNA, 470 bp, Homo sapiens
  CDS 213..470
  misc_feature 228: n=a, g, c or t
  misc_feature 229: m=a or c
  misc_feature 328: n=a, g, c or t
  UNSURE 6: Xaa= *  or Ala or Glu or Lys or Pro or Gln or Ser or Thr
  UNSURE 39: Xaa=His or Leu or Pro or Arg
tttttttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgagggctgtgctgnmgtttgctgctgccactggagccactccaattgctggccgcttcactcctggaaccttcactaaccagatccaggcagccttccgggagccacggcttcntgtggttactgaccccagggctgaccaccagcctctcacggaggcatcttatgttaacctacctaccattgcgctgtgtaacacagattctcctctgcgctatgtggacattgccatcccatgcaacaacaagggagctcac

SEQ ID NO: 1291 - DNA, 487 bp, Homo sapiens
  CDS 230..487
  misc_feature 245: n=a, g, c or t
  misc_feature 246: m=a or c
  misc_feature 345: n=a, g, c or t
  UNSURE 6: Xaa= *  or Ala or Glu or Lys or Pro or Gln or Ser or Thr
  UNSURE 39: Xaa=His or Leu or Pro or Arg
acgtcatttcctgccgcctgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatgagggctgtgctgnmgtttgctgctgccactggagccactccaattgctggccgcttcactcctggaaccttcactaaccagatccaggcagccttccgggagccacggcttcntgtggttactgaccccagggctgaccaccagcctctcacggaggcatcttatgttaacctacctaccattgcgctgtgtaacacagattctcctctgcgctatgtggacattgccatcccatgcaacaacaagggagctcac

SEQ ID NO: 1292 - DNA, 391 bp, Homo sapiens
  CDS 149..391
  misc_feature 358: n=a, g, c or t
  UNSURE 70: Xaa= *  or Cys or Trp
acacaaaatggtagccgccgtgggggatgtccagttttttttcctcttcccaagtacagacgcagagcagacttgtctttccgcttaacctcaacctcgtgtgatctgccagtttcgctcccgacgccaaattccagcgaaacagctgatgccagccagcttgaagacccctgccacagaagaagggaatcagcatgagaatacagcttcttcatctcgctgtcccatgacttcgccctgtactcttcagccaattaatgatctccacacttgggaccactctaaaacccttaagaacctgagactcaaagtcctcctggagacgaatttgaggtttcctcctatctgtgtttggtgncctatgattaaacctctttctcttctgcaacct

SEQ ID NO: 1293 - DNA, 459 bp, Homo sapiens
  CDS 134..457
  misc_feature 398: s=g or c
  misc_feature 428: k=g or t
  misc_feature 429: y=c or t
  UNSURE 89: Xaa=Ala or Pro
  UNSURE 99: Xaa=Ala or Leu or Ser or Val
gagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcascatcggtgcgctgcaggaggctagcgaagkyacctggtgggtctgttcgaagataccaacc

SEQ ID NO: 1294 - DNA, 285 bp, Homo sapiens
  CDS 115..285
tttccgccgctggtggccacccgcaggtagtgatgtcgagcgtcgagctcccaaaaccgagctggtgaggggctgcaggtggcggcgcagtctcggtaggcggtacttcttcagatgtataaggaagagctggtaccattcagactgaaactattccaaaaaattgaggaggaggaactcctccctaacttattctatgaagccagcattacccttgacattaaaatccaacaaagatacaccaaaaaaacaaaaaaagaaaaagaaaacttcaagccaatatcc

SEQ ID NO: 1295 - DNA, 334 bp, Homo sapiens
  CDS 107..334
  misc_feature 323: s=g or c
  UNSURE 73: Xaa=Leu or Val
ttttcacttttgttttcctgctcccagcagggttaggcttgctgaggggcaggcacaggagtcctggctgagctcatggcctgaggctgcctagcggccacggggaatggttgcaatggcggaggcagaggcaggggtggcagtggaggtccgtggactgccccctgccgtgcccgacgagctgctcactctctactttgaaaaccgccgacgctctggagggggacctgtgttgagctggcagagactgggctgtgggggcgtcctcaccttcagagagcctgcagacgccgagagggtcttggcccaggcagatcatgaastacatggtgcc

SEQ ID NO: 1296 - DNA, 457 bp, Homo sapiens
  CDS 265..456
  misc_feature 401: k=g or t
  misc_feature 405: m=a or c
  misc_feature 416: s=g or c
  misc_feature 424: n=a, g, c or t
  UNSURE 46: Xaa=Leu or Arg
  UNSURE 51: Xaa=Arg or Thr
  UNSURE 54: Xaa=Leu or Met or Val
cagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgckgacmgaccctcccasagccagantgacctccagcctggaagctgggctgcaacgcg

SEQ ID NO: 1297 - DNA, 396 bp, Homo sapiens
  CDS 100..396
agacgcgccgcggtccccgcctgccgctgctccgccgcagtcgccgctccagtctatccggcactaggaacagccccgggcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgct

SEQ ID NO: 1298 - DNA, 456 bp, Homo sapiens
  CDS 110..454
  misc_feature 275: m=a or c
  misc_feature 383: n=a, g, c or t
  misc_feature 384: n=a, g, c or t
  misc_feature 395: n=a, g, c or t
  UNSURE 56: Xaa=Arg or Ser
  UNSURE 92: Xaa=Ala or Cys or Asp or Phe or Gly or His or Ile or Leu or Asn or Pro or Arg or Ser or Thr or Val or Tyr
  UNSURE 96: Xaa=Asp or His or Asn or Tyr
aatttcttgcttggagctcagacaacaaaggcatagagagattggttttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtamgtttctaccgcaatggggaccgctacttcaaggggattgtgtacgctgtgtcctctgaccgttttcgcagctttgacgccttgctggctgacctgacgcgatctctanntgacaacatcnacctgcctcagggagtgcgttacatttacaccattgatggatccaaggaagatcggaagca

SEQ ID NO: 1299 - DNA, 381 bp, Homo sapiens
  CDS 163..381
  misc_feature 12: s=g or c
  misc_feature 13: k=g or t
acagtgccctgskcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtc

SEQ ID NO: 1300 - DNA, 385 bp, Homo sapiens
  CDS 146..385
attgcttctgggtttggggtgtgagaggatgcagagtgggagaccttaaaaccgtctgatctggctgctaaagcgagtgtctgacgaccacccattaacaccagcgagtagcgtttgctcacggctttaggataagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagact

SEQ ID NO: 1301 - DNA, 535 bp, Homo sapiens
  CDS 325..534
  misc_feature 92: y=c or t
attagcggcgcagacgtttgggcctaagcgctgggcgaggcgaggccctgcccctccccgccaacggccattctctggacccgtctttcttyccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaatcc

SEQ ID NO: 1302 - DNA, 383 bp, Homo sapiens
  CDS 74..382
  misc_feature 345: r=a or g
  UNSURE 91: Xaa=Asp or Gly
agcgtgatcggtttccggtcagtggtgtggtaccgggtacccggagacgtgtatcggacggtgggccgcagccatggccgagagaaaacctaacggtggcagcggcggcgcctccacttcctcatcgggcactaacttacttttctcctcctcggccacggagttcagcttcaatgtgcccttcatcccagtcacccaggcctccgcttctccggcctccctgctcttaccgggagaggattccacagatgttggtgaggaggacagcttccttggtcagacttctattcacacatctgccccacagacatttagttacttctctcaggtatcaagcagcagtgrtccttttgggaatattggacagtcaccattaacaactg

SEQ ID NO: 1303 - DNA, 425 bp, Homo sapiens
  CDS 162..425
  misc_feature 142: r=a or g
  misc_feature 152: r=a or g
ctacgttccaattggggccgtaccatggcggagaagactcaaaagagtgtgaagattgctcctggagcagttgtatgtgtagaaagtgaaatcagaggagatgtaactatcgttacccagataatatcactcctgacactgragatccagarccaaaacctatgatcattggcaccaataatgtgtttgaagttggctgttattcccaagccatgaagatgggagataataatgtcattgaatcaaaagcatatgtaggcagaaatgtaatattgacaagtggctgcatcattggggcttgttgcaacctaaatacatttgaagtcatccctgagaatacggtgatctatggtgcagactgccttcgtcgggtgcagactgagcgaccgcagccccagacactacagctggatttcttgatgaaa

SEQ ID NO: 1304 - DNA, 458 bp, Homo sapiens
  CDS 199..456
  misc_feature 299: w=a or t
  misc_feature 300: m=a or c
  UNSURE 34: Xaa=Asp or Glu or Val
attaaagcagctccagccctgcgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgcccccttgactattcagctcccgaagcaattcagcaggatcgaggaggtgttcaaagaagwmcaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagag

SEQ ID NO: 1305 - DNA, 445 bp, Homo sapiens
  CDS 13..444
gacggaaggagcatggcgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaaca

SEQ ID NO: 1306 - DNA, 393 bp, Homo sapiens
  CDS 124..393
aacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaagtgagctgaagagacgcctgaaagctgagaagaaagtagcagagaaggaggccaaacagaaagagctcagtgagaaacagctaagccaagccactgctgctgccaccaaccacaccactgataat

SEQ ID NO: 1307 - DNA, 245 bp, Homo sapiens
  CDS 3..245
  misc_feature 22: m=a or c
  misc_feature 48: y=c or t
  misc_feature 76: s=g or c
  misc_feature 170: k=g or t
  UNSURE 7: Xaa=Pro or Gln
  UNSURE 25: Xaa=Arg or Thr
aaatgctctggggcgtgccgcmgccgtcgctgccacctcccctaccgytagtggaagaagatggcggaaggcggasggcggatctggacacccagcggtctgacatcgcgacgctgctcaaaacctcgctccggaaaggggacacctggtacctagtcatagtcgctggktcaaacagtggaaaaaatatgttggctttgacagttgggacaaataccagatgggagatcaaaatgtgtatcccg

SEQ ID NO: 1308 - DNA, 491 bp, Homo sapiens
  CDS 231..491
ctttcccatctggcgggcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaa

SEQ ID NO: 1309 - DNA, 376 bp, Homo sapiens
  CDS 165..374
gaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggaga

SEQ ID NO: 1310 - DNA, 433 bp, Homo sapiens
  CDS 151..432
  misc_feature 233: y=c or t
  misc_feature 347: r=a or g
  misc_feature 377: n=a, g, c or t
  misc_feature 398: n=a, g, c or t
  UNSURE 28: Xaa=Ile or Thr
  UNSURE 66: Xaa=Asp or Gly
  UNSURE 76: Xaa=Lys or Met or Arg or Thr
  UNSURE 83: Xaa=Ile or Asn or Ser or Thr
ttctcgcatttgtcagctcttgccaaaacggtgacgcagtggtgtgttacctgccgacagcataaagcgaggcaaggtccagctattccacccggcatacaagcttatggagcagccccctttgaagatctccaggtggacttcacagagatgtcaaagtgtagagatgatcgagtgtggatcaaggactggaaagttgcctgtttgtgtccacggtggaaaggaccccagaytgtcgtcctgagcactcccaccgctgtgaaggtggaaggaatcccagcctggatccaacacagccatataaaacctgcagcgcctgaaacctgggaggcaagaccaagcccagrtaacccttgcagagtgaccctgaagaagangacaagccctgctccagtcanccggaagctgactagtcaagcacggccgaagcctg

SEQ ID NO: 1311 - DNA, 424 bp, Homo sapiens
  CDS 93..422
  misc_feature 210: s=g or c
  UNSURE 40: Xaa=Asp or His
tattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtsacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcaga

SEQ ID NO: 1312 - DNA, 444 bp, Homo sapiens
  CDS 56..442
  misc_feature 129: s=g or c
  misc_feature 133: m=a or c
  misc_feature 137: s=g or c
  misc_feature 140: y=c or t
  misc_feature 150: k=g or t
  misc_feature 384: s=g or c
  misc_feature 393: r=a or g
  misc_feature 400: m=a or c
  misc_feature 402: n=a, g, c or t
  misc_feature 417: r=a or g
  UNSURE 25: Xaa=Ala or Gly
  UNSURE 26: Xaa=Asp or Glu
  UNSURE 28: Xaa=Glu or Gln
  UNSURE 29: Xaa=Pro or Ser
  UNSURE 32: Xaa=Ile or Arg
  UNSURE 110: Xaa=Ser or Thr
  UNSURE 113: Xaa=Asp or Gly
  UNSURE 116: Xaa=Ile or Asn or Ser or Thr
  UNSURE 121: Xaa=Asp or Gly
gaggacgtgttccgaggaagccagacccggagccgtggcctgccgggccggcgacatggatcccctgttccagcaaacgcacaagcaggtccacgagatccagtcttgcatgggacgcctggagacggsagamaagsagyctgtgcacakagtagaaaacgaaatccaagcaagcatagaccagatattcagccgtctagaacgtctggagattttgtccagcaaggagccccctaacaaaaggcaaaatgccaaacttcgggttgaccagttaaagtatgatgtccagcacctgcagactgcgctcagaaacttccagcatcggcgccatgcaagggagcagcaggagagacagcgagaagagcttctgtctcgaaccttcascactaacgrctctggmancaccataccaatggrcgatcactgcagtttaactcctccctc

SEQ ID NO: 1313 - DNA, 347 bp, Homo sapiens
  CDS 103..345
ggggaagctgtcatggctgctcctgtacgtagtcacggtcttgtgctctaaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcatt

SEQ ID NO: 1314 - DNA, 469 bp, Homo sapiens
  CDS 160..468
agatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaaggga

SEQ ID NO: 1315 - DNA, 233 bp, Homo sapiens
  CDS 75..233
agccgacgaggcaacaattaggctttggggataaaacgaggtgcggagagcgggctggggcatttctccccgagatggcgggtctgacggcggcggccccgcgggcccggagtcctcctgctcctgctgtccatcctccacccctctcggcctggaggggtccctggggccattcctggtggagttcctggaggagtcttttatccaggggctggtctcggagcccttggagg

SEQ ID NO: 1316 - DNA, 492 bp, Homo sapiens
  CDS 217..492
ataaaggagcgggcggcgcgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaa

SEQ ID NO: 1317 - DNA, 336 bp, Homo sapiens
  CDS 144..335
  misc_feature 132: m=a or c
gagtgtcgggcgcggcaggaggacgaggcagggcgggcgggcgctctaagggttctgctctgactccaggttgggacagcgtcttcgctgctgctggatagtcgtgttttcggggatcgaggatactcaccmagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaagg

SEQ ID NO: 1318 - DNA, 456 bp, Homo sapiens
  CDS 161..454
ctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccgggg

SEQ ID NO: 1319 - DNA, 508 bp, Homo sapiens
  CDS 108..506
  misc_feature 25: s=g or c
  misc_feature 455: r=a or g
aagaaggcgggaggctggagtagasggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtrctggtgatgtgtcacactcgggagttggcttttcagatcagcaaggaatatga

SEQ ID NO: 1320 - DNA, 638 bp, Homo sapiens
  CDS 238..636
  misc_feature 398: s=g or c
  misc_feature 585: r=a or g
  UNSURE 54: Xaa=Pro or Arg
aagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagcsagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtrctggtgatgtgtcacactcgggagttggcttttcagatcagcaaggaatatga

SEQ ID NO: 1321 - DNA, 408 bp, Homo sapiens
  CDS 107..406
  misc_feature 136: n=a, g, c or t
  misc_feature 137: n=a, g, c or t
  misc_feature 139: n=a, g, c or t
  misc_feature 238: y=c or t
  UNSURE 10: Xaa=Arg or Ser
  UNSURE 11: Xaa= *  or Cys or Gly or Arg or Ser or Trp
agaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagnngngagcaggtgtctggtgctaaagtcatcgctcaggccctgaaaacgcaagatgtggagtacatatttggcatcgtaggcatcccagtgaccgaaatcgcyattgctgcccagcagctaggcatcaagtacatcgggatgaggaatgagcaagcggcttgttatgctgcctccgcgattggatatctgacaagcaggccaggagtctgccttgttgtttctggcccaggtctcatccatgccttgggcggtatggcaaatgcaaacatgaa

SEQ ID NO: 1322 - DNA, 361 bp, Homo sapiens
  CDS 142..360
agtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctc

SEQ ID NO: 1323 - DNA, 371 bp, Homo sapiens
  CDS 59..370
  misc_feature 312: n=a, g, c or t
  misc_feature 350: n=a, g, c or t
  misc_feature 351: r=a or g
  UNSURE 85: Xaa=Ile or Lys or Arg or Thr
  UNSURE 98: Xaa=Cys or Asp or Gly or His or Asn or Arg or Ser or Tyr
aaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatganacgatatgagcttccagccccctcctctggtcaaaaanrtgacattactgcatggcaag

SEQ ID NO: 1324 - DNA, 212 bp, Homo sapiens
  CDS 50..211
  misc_feature 135: n=a, g, c or t
  UNSURE 29: Xaa=Ala or Glu or Gly or Val
aaaacgccgggagtagccgaagggacgccgggaacaggaatttcttcacatggctcctggagaagtgaccatcacagttcgcctcatccgttcctttgaacatcgcaatttcaaacctgtagtgtatcacggagngaatttggaccaaactgtaaaggaatttatcgtatttctaaagcaagatatccctttaaggaccaacctgccaccac

SEQ ID NO: 1325 - DNA, 341 bp, Homo sapiens
  CDS 154..339
  misc_feature 162: w=a or t
  misc_feature 299: n=a, g, c or t
  misc_feature 300: n=a, g, c or t
  misc_feature 301: w=a or t
  UNSURE 49: Xaa=His or Leu or Pro or Gln or Arg
  UNSURE 50: Xaa=Ser or Thr
cccacttctaggcttggttgaaccgtgcagataccttctcgaaacaaaagattttcctacctgcttatacttggtaaccgagggaattactaagacttcttgctcatttctgagtattgtctttatatcctgacactatgaaatgctacttggatgcctctwaagtctgttctctggggaggcagtaaggggccgtggagctggcctcggcctcggcatcgggagaggctggacttcctgtctctctgtgctgaatggctgcgatggcgcccgctctcactgacgcagcagctgaagcnnwccatatccggttcaaactggctcccccatcctctaccctg

SEQ ID NO: 1326 - DNA, 302 bp, Homo sapiens
  CDS 49..300
  misc_feature 232: n=a, g, c or t
  misc_feature 233: n=a, g, c or t
  UNSURE 62: Xaa= *  or Ala or Glu or Gly or Lys or Leu or Met or Pro or Gln or Arg or Ser or Thr or Val or Trp
tggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagnnggccactgtttttctcaatcctgcagcttgcaaaggaaaagccaggactctatttgaaaaaaatgcggc

SEQ ID NO: 1327 - DNA, 409 bp, Homo sapiens
  CDS 202..408
  misc_feature 177: m=a or c
  misc_feature 323: r=a or g
  UNSURE 41: Xaa=Cys or Tyr
aggcttgcggggaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctamatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctrtgggggaaaccactctgtgttcctgctggaagatggggaagtttacacatgtggtttgaacaccaaggggcaactgggccatgaga

SEQ ID NO: 1328 - DNA, 418 bp, Homo sapiens
  CDS 206..418
  misc_feature 20: r=a or g
  misc_feature 21: n=a, g, c or t
cctcccctcccaaaaaaacrnccctcatccagtctcttccagcctagagatcctggcctacccctccgccaaagcgcgcactgagtgcaaaccccagagtcaatccctgcccggctccgccccccgcgccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggc

SEQ ID NO: 1329 - DNA, 581 bp, Homo sapiens
  CDS 210..581
  misc_feature 16: r=a or g
cctcccctcccaaaaraacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttc

SEQ ID NO: 1330 - DNA, 268 bp, Homo sapiens
  CDS 114..266
atggtagcaccgccgagagtaaaggaggggtggtgctagacgtttcgggcagagctcggccgctgcggaggacaaggaactctccctctcccactagtctgacttcttccaaaatgagcggcctggatgggggcaacaagctccctctcgcccaaaccggcggcctggctgctcccgaccatgcctcaggagatccggacctagaccagtgccaagggctccgtgaagaaaccgaggcgacacaggtgatggcgaacacaggtggggg

SEQ ID NO: 1331 - DNA, 513 bp, Homo sapiens
  CDS 152..511
  misc_feature 411: n=a, g, c or t
  UNSURE 87: Xaa=Cys or Phe or Ser or Tyr
acgtcgtttaatccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtncctcaagatccagacactcaagtccaacaactcgatggcacaagccatgaagggtgtcaccaaggccatgggcaccatgaacagacagctgaagttgcccag

SEQ ID NO: 1332 - DNA, 636 bp, Homo sapiens
  CDS 275..634
  misc_feature 212: w=a or t
  misc_feature 217: m=a or c
  misc_feature 218: r=a or g
  misc_feature 259: s=g or c
  misc_feature 362: n=a, g, c or t
  misc_feature 376: s=g or c
  misc_feature 534: n=a, g, c or t
  UNSURE 30: Xaa=Asp or His or Asn or Tyr
  UNSURE 34: Xaa=His or Gln
  UNSURE 87: Xaa=Cys or Phe or Ser or Tyr
acgtcgtttaatccggaaacggcggcggcggcgacaggaccgaggggccttagttggtgggcaagtcggggatcccagaaagagaagcgtgacccggaagcggaaacgggtgtccgtcccagctccggtgagtggcccctgctggaccgtggatcccgggcgggcgtgcgggcggcagcgtacgaggccttctactcgcccgggtgtccggwgcctmrcttctccctgggaccctgtcgtcaacatcgaggcctgccastgagcttctaccatcatggacctattgttcgggcgccggaagacgccagaggagctactgcggcagaaccagagggccctgaaccgtgccatgcgggagctgnaccgcgagcgacasaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtncctcaagatccagacactcaagtccaacaactcgatggcacaagccatgaagggtgtcaccaaggccatgggcaccatgaacagacagctgaagttgcccag

SEQ ID NO: 1333 - DNA, 721 bp, Homo sapiens
  CDS 360..719
  misc_feature 120: s=g or c
  misc_feature 122: k=g or t
  misc_feature 154: y=c or t
  misc_feature 299: y=c or t
  misc_feature 443: n=a, g, c or t
  misc_feature 444: s=g or c
  misc_feature 619: n=a, g, c or t
  UNSURE 28: Xaa=Asp or Glu
  UNSURE 29: Xaa=Leu or Val
  UNSURE 87: Xaa=Cys or Phe or Ser or Tyr
acgtcgtttaatccggaaacggcggcggcggcgacaggaccgaggggccttagttggtgggcaagtcggggatcccagaaagagaagcgtgacccggaagcggaaacgggtgtccgtccsakctccggtgagtggcccctggaccgtggatccygggcgggcgtgcgggcggcagcgtacgaggccttctactcgcccgggtgtccggtgcctcgcttctccctgggaccctgtcgtcaacatcgaggtctccaacaccaccttgctttggtgccgggcccactgactgtcctcggtgyatagtgcgaccgaatctccatcatcccgtcctcagtgcctgccagtgagcttctaccatcatggacctattgttcgggcgccggaagacgccagaggagctactgcggcagaaccagagggccctgaaccgtgccatgcggganstggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtncctcaagatccagacactcaagtccaacaactcgatggcacaagccatgaagggtgtcaccaaggccatgggcaccatgaacagacagctgaagttgcccag

SEQ ID NO: 1334 - DNA, 437 bp, Homo sapiens
  CDS 111..437
ggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggaatttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgag

SEQ ID NO: 1335 - DNA, 362 bp, Homo sapiens
  CDS 45..362
actttcagtttcagcccacacaagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcagctcttcaggcagtgcaggacaacccagctatgcccacatgctca

SEQ ID NO: 1336 - DNA, 466 bp, Homo sapiens
  CDS 141..464
  misc_feature 194: m=a or c
  misc_feature 197: m=a or c
  misc_feature 198: n=a, g, c or t
  UNSURE 19: Xaa=Lys or Asn
  UNSURE 20: Xaa=Phe or Ile or Leu or Val
aagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccmaamntctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatggctctgtgtgaatgctcctccaaaaaaag

SEQ ID NO: 1337 - DNA, 391 bp, Homo sapiens
  CDS 166..390
actgcgcaggcgcggcccgggagcgtggggtatctcgaggtgccgggttgcaggcgctcaggagcgctagggtttgaggcctgctttctgctcgcgccagcagagcactacctgaggcagcgaggcgcacgagcctagcctccccgcgccctgggcagtgtggccatggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccaga

SEQ ID NO: 1338 - DNA, 418 bp, Homo sapiens
  CDS 45..416
agagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgt

SEQ ID NO: 1339 - DNA, 353 bp, Homo sapiens
  CDS 75..353
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatat

SEQ ID NO: 1340 - DNA, 533 bp, Homo sapiens
  CDS 131..532
  misc_feature 451: n=a, g, c or t
  misc_feature 452: k=g or t
  UNSURE 107: Xaa=Ile or Met
  UNSURE 108: Xaa=Asp or Tyr
atttttttcatttcccagacttagcacaatctcatccgctctaaacaacctcatcaaaactactttctggtcagagagaagcaataattattattaacatttattaacgatcaataaacttgattgcattatggccagcactattaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagtatnkatggaagagaagcacatgccacccccaaacatgaccacgaacgagcgcagagttatcgtgccagcagatcctacgctatgg

SEQ ID NO: 1341 - DNA, 495 bp, Homo sapiens
  CDS 49..495
  misc_feature 12: s=g or c
  misc_feature 489: n=a, g, c or t
  UNSURE 147: Xaa=Asp or Glu
actttgcggcasgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctgggggctgctggatgcttacttgangacgag

SEQ ID NO: 1342 - DNA, 578 bp, Homo sapiens
  CDS 408..578
  misc_feature 278: n=a, g, c or t
  misc_feature 286: n=a, g, c or t
  misc_feature 289: m=a or c
agattttccagctcagggcccagccagctggcaggaagcaggacagaggtcacttgaattcagaccacatgtccctgttaaatacattagcttttaaatcaatctttgttcaaagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaanttgagaanggmcaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatgga

SEQ ID NO: 1343 - DNA, 511 bp, Homo sapiens
  CDS 171..509
aagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgacgccattctgggggtg

SEQ ID NO: 1344 - DNA, 604 bp, Homo sapiens
  CDS 429..602
  misc_feature 159: s=g or c
  misc_feature 160: s=g or c
  misc_feature 287: s=g or c
  misc_feature 547: w=a or t
  misc_feature 550: r=a or g
  UNSURE 40: Xaa=Glu or Val
  UNSURE 41: Xaa=Glu or Gly
agttcctctccttaaccaccggacaaacgtctctggagtctctccaatgagcaagaaagcaagtcgggggtaggggaggggcctcacaccaaggggtgggcgcagtccctcctccagctccttcaccctccagtagtctcgtgggtccccgagcgccasscgggaaccgggaaaaggaaaccgtgttgtgtacgtaagattcaggaaacgaaaccaggagccgcgggtgttggcgcaaaggttactcccagacccttttccggctgacttctgagaaggttgcgcascagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaagcaagaaacctccctgcgggtcccggatctcatccagatgtttgcaactgwagratatgagctagataagctcagactctcaagtggtggctcatggcaaccttgtct

SEQ ID NO: 1345 - DNA, 446 bp, Homo sapiens
  CDS 102..446
agtgtgggttgattctgaggtgcactgtgggaaagagcttgtcgctgcggtgttgctgttggagactcgattgttggtgacagcgaaagaacgataacaaaatgccggagcgagatagtgagccgttctccaaccctttggcccccgatggccacgatgtggatgatcctcactccttccaccaatcaaaactcaccaatgaagacttcaggaaacttctcatgacccccagggctgcacctacctctgcaccaccttctaagtcacgtcaccatgagatgccaagggagtacaatgaggatgaagacccagctgcacgaaggaggaaaaagaaaagttattatgccaagctacgccaacaagaaattgagagagagagagagctagcagagaagtaccgggatcgtgccaaggaacggagagatggagtgaacaaagattatgaa

SEQ ID NO: 1346 - DNA, 436 bp, Homo sapiens
  CDS 164..436
  misc_feature 44: n=a, g, c or t
  misc_feature 45: n=a, g, c or t
  misc_feature 55: s=g or c
  misc_feature 377: m=a or c
  misc_feature 392: k=g or t
  misc_feature 415: m=a or c
  misc_feature 429: s=g or c
  UNSURE 72: Xaa=Pro or Thr
  UNSURE 77: Xaa=Cys or Gly
  UNSURE 89: Xaa=Arg or Thr
agagatcagccgcccagccaggagttaagctgaggtcgtctganncctgcgacasctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccamcaggaatcgtctctkgccagccagggactcagaaagtmcatcaaagcgacasacagttc

SEQ ID NO: 1347 - DNA, 480 bp, Homo sapiens
  CDS 73..480
  misc_feature 55: s=g or c
  misc_feature 421: m=a or c
  misc_feature 436: k=g or t
  misc_feature 459: m=a or c
  misc_feature 473: s=g or c
  UNSURE 117: Xaa=Pro or Thr
  UNSURE 122: Xaa=Cys or Gly
  UNSURE 134: Xaa=Arg or Thr
agagatcagccgcccagccaggagttaagctgaggtcgtctgagccctgcgacasctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccamcaggaatcgtctctkgccagccagggactcagaaagtmcatcaaagcgacasacagttc

SEQ ID NO: 1348 - DNA, 557 bp, Homo sapiens
  CDS 182..556
gagtcggaaaggaaagctgtgggaccatcctggcaaccccggtgtttggctgggttctagcgtaccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaaggtacatgggcagcgtcaggatctggggcaggctggctaccttgcagtggggtggggaagagtgggaagtttcaccctcaatccagcgggcagcagaagcaggactgttttctatgtgcccaccgtggtggtcttccacacctctcaccctcacacattttctcaggtgtcctcccatcccccaagaatggtcaacaactccattatacaaa

SEQ ID NO: 1349 - DNA, 480 bp, Homo sapiens
  CDS 87..479
  misc_feature 14: s=g or c
  misc_feature 200: s=g or c
  misc_feature 257: r=a or g
  misc_feature 421: w=a or t
  UNSURE 112: Xaa= *  or Leu
gcagtcgcgcggasccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggstccctagatgacctggtgaaggtctggaaatggcgtgatgagaggctggacctacartggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggacttwggccttttctcctgattcccagtatctggccacaggaactcatgtcgggaaagtgaaca

SEQ ID NO: 1350 - DNA, 615 bp, Homo sapiens
  CDS 97..615
gcttggggcctgggcagccacactgcacgcaggctgggccgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaacc

SEQ ID NO: 1351 - DNA, 690 bp, Homo sapiens
  CDS 97..690
  misc_feature 59: y=c or t
gcttggggcctgggcagccacactgcacgcaggctgggccgactgaggggctcagaggycaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaacc

SEQ ID NO: 1352 - DNA, 485 bp, Homo sapiens
  CDS 253..483
  misc_feature 469: r=a or g
  misc_feature 470: r=a or g
  UNSURE 73: Xaa=Glu or Gly or Lys or Arg
acctggcttgatcactgcacacgccatccctggtacctgaggcagaagacacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgttttgrratttgttgtcacagt

SEQ ID NO: 1353 - DNA, 412 bp, Homo sapiens
  CDS 27..410
  misc_feature 374: r=a or g
  UNSURE 116: Xaa= *  or Trp
gtttttttccggtgcaggtggggaaaatggcggtgtctacagtgttctcgacttcgtcgctgatgcttgctctgtcaaggcacagcctattgtctcctttgctcagtgtgacatcattcagacgcttctacagaggtgacagcccaacagattcccaaaaggacatgattgaaatccctttgcctccatggcaggagagaactgatgaatccatagaaaccaaaagagcccgcctgctctatgagagcagaaagaggggaatgttggaaaactgcattcttcttagtctttttgctaaagaacatctgcagcacatgacagaaaagcagctgaacctctatgaccgcctgattaacgagcctagtaatgactgrgatatttactactgggccacagaagctaaaccagcccc

SEQ ID NO: 1354 - DNA, 392 bp, Homo sapiens
  CDS 31..390
ctctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcgga

SEQ ID NO: 1355 - DNA, 416 bp, Homo sapiens
  CDS 140..415
  misc_feature 11: m=a or c
  misc_feature 12: m=a or c
gcaagagctgmmgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctc

SEQ ID NO: 1356 - DNA, 330 bp, Homo sapiens
  CDS 81..329
  misc_feature 183: y=c or t
ggaagcgcgcgccgccactgccgcgccgtgtcagtcgggagggagggagcgagcaggcgaacgcggaggacggggtgaagatggcggccttctccgagatgggtgtaatgcctgagattgcacaagctgtggaagagatggattggctcctcccaactgatatccaggctgaatctatcccaytgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactg

SEQ ID NO: 1357 - DNA, 390 bp, Homo sapiens
  CDS 133..390
  misc_feature 201: n=a, g, c or t
  misc_feature 249: k=g or t
  misc_feature 315: k=g or t
  UNSURE 23: Xaa= *  or Tyr
  UNSURE 39: Xaa=His or Gln
tttttctcgctccttccgagttaccgccgccgtcgccgccgctcctcctctcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctanacaaatctggaacgggtggccgattactgcgagaacaactacatacaktcagcagataagcagagagccctagaagaaaccaaagcctacaccacccaatccttagcaagtgtkgcctatctgataaacaccttggccaacaatgtcctgcagatgctggatatccaggcatcccagctacgaaggatg

SEQ ID NO: 1358 - DNA, 309 bp, Homo sapiens
  CDS 56..307
gtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccac

SEQ ID NO: 1359 - DNA, 446 bp, Homo sapiens
  CDS 78..446
actcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcagtttgaagagagatacagac

SEQ ID NO: 1360 - DNA, 687 bp, Homo sapiens
  CDS 319..687
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcagtttgaagagagatacagac

SEQ ID NO: 1361 - DNA, 373 bp, Homo sapiens
  CDS 218..373
  misc_feature 314: m=a or c
  UNSURE 33: Xaa=His or Asn
agatcatccagtgtgacagagtcttaatccgtggttctgcccatcagcacattcaacggacttaggatttctcaccacgtgcccttattttggaaaactgttcatttcaagaccacaggcaaaggggatactaagaataatcgcagaattaacatcggcaaggtatgatcaggatgaggacgtgagaaacgcagggctaagagttgggagtcctgggatgaacttcccacctcaaagcccagcacgagggtccctggacgctgtcggccccggacgtgggtccccgagactcgactgcagctcagagtggccamatctgccctgccaggctgccgcggagacaacacggaggagcacctgtgagaacacctgc

SEQ ID NO: 1362 - DNA, 423 bp, Homo sapiens
  CDS 85..423
  misc_feature 352: r=a or g
  UNSURE 90: Xaa=Asp or Asn
ataaagtcttttgactcccttggatcacagtctttgcacactcggacttcaaaactgttccagggccagtatcggagtttggacatgaccgacaatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataracaaaagctattacaatgtggttgcccgaagctcagcagagagtcggaggctgctttttaaacctgatgcc

SEQ ID NO: 1363 - DNA, 397 bp, Homo sapiens
  CDS 135..395
  misc_feature 113: s=g or c
ggaagccgttctttggccctgtgacacgtagcaacggggctggttcagggtctgaaacagagtttgggggttgtttgggattagtgaagctactgcctttgccgccagcgcasctcagagtttgattatttgcaatgtcaggctttgaaaacttaaacacggatttctaccagacaagttacagcatcgatgatcagtcacagcagtcctatgattatggaggaagtggaggaccctatagcaaacagtatgctggctatgactattcgcagcaaggcagatttgtccctccagacatgatgcagccacaacagccatacaccgggcagatttaccagccaactcaggcatatactccagcttcacctcagcctttctatggaaacaactttgagga

SEQ ID NO: 1364 - DNA, 365 bp, Homo sapiens
  CDS 143..364
  misc_feature 35: y=c or t
  misc_feature 61: r=a or g
atcttagtctagggactgaggagtcgccgccgccycgagtcccggtaccatgcatttcacrgtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttaccc

SEQ ID NO: 1365 - DNA, 346 bp, Homo sapiens
  CDS 120..344
ctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccag

SEQ ID NO: 1366 - DNA, 585 bp, Homo sapiens
  CDS 60..584
  misc_feature 55: s=g or c
  misc_feature 491: s=g or c
  misc_feature 521: m=a or c
  UNSURE 144: Xaa=Ile or Met
  UNSURE 154: Xaa=Arg or Ser
ctctctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatsccgtccttcattgtccgcctggattccagmaagcacatcgacttctctctgcgctctccctacgggggtggccgcccgggccgcgtgaagagga

SEQ ID NO: 1367 - DNA, 658 bp, Homo sapiens
  CDS 133..657
  misc_feature 128: s=g or c
  misc_feature 564: s=g or c
  misc_feature 594: m=a or c
  UNSURE 144: Xaa=Ile or Met
  UNSURE 154: Xaa=Arg or Ser
ctctctctttctcagtgaccgggtggtttgcttaggtgcggtgcggtggtgtgctttttctctagggtttgggttggatggtggcccgggccttccgagtttccatgagcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatsccgtccttcattgtccgcctggattccagmaagcacatcgacttctctctgcgctctccctacgggggtggccgcccgggccgcgtgaagagga

SEQ ID NO: 1368 - DNA, 453 bp, Homo sapiens
  CDS 144..452
  misc_feature 137: s=g or c
  misc_feature 312: m=a or c
  misc_feature 313: w=a or t
  misc_feature 381: w=a or t
  UNSURE 57: Xaa=Lys or Leu or Met or Gln
  UNSURE 80: Xaa=Arg or Trp
agattctgggagtgcagcggggaggagtcccggctgggctgagcgcagggagctgcttggcagtgccagagcccaggccccagagccctgctggagaggaggcagactgaggcagcaggccccgccagcaggcgaasagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggmwggctgcggataagctcatccagaacctggatgccaatcatgatgggcgcatcagcttcgatgagtacwggaccttgataggcggcatcaccggccccatcgccaaactcatccatgagcaggagcagcagagcagcagct

SEQ ID NO: 1369 - DNA, 361 bp, Homo sapiens
  CDS 164..361
  misc_feature 10: k=g or t
  misc_feature 32: y=c or t
  misc_feature 33: n=a, g, c or t
  misc_feature 157: s=g or c
attcagaagkctgtatccgcttagaaagtgtyntttgtcctggggtgagagggtgacgcatgtgccctctggcagtctgctgctgtgtccagagtccgactccagctgggctgtaactgggcttggcccccgccttaggccccgccagcaggcgaasagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggtaaggcctctcacccaagggccttgcctccctctccccttccct

SEQ ID NO: 1370 - DNA, 473 bp, Homo sapiens
  CDS 164..472
  misc_feature 10: k=g or t
  misc_feature 157: s=g or c
  misc_feature 453: r=a or g
  UNSURE 97: Xaa=Gln or Arg
attcagaagkctgtatccgcttagaaagtgtcttttgtcctggggtgagagggtgacgcatgtgccctctggcagtctgctgctgtgtccagagtccgactccagctgggctgtaactgggcttggcccccgccttaggccccgccagcaggcgaasagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcrggagcagcagagcagcagct

SEQ ID NO: 1371 - DNA, 374 bp, Homo sapiens
  CDS 56..373
  misc_feature 197: k=g or t
  UNSURE 48: Xaa=Asp or Tyr
aagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactgggkacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggc

SEQ ID NO: 1372 - DNA, 588 bp, Homo sapiens
  CDS 213..587
  misc_feature 84: s=g or c
atttcctgccgtaagtatacagtgcctccgggtcgcggtcattttgagcccctgtctggatgacttcttgcggctgttctaccsctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctg

SEQ ID NO: 1373 - DNA, 476 bp, Homo sapiens
  CDS 88..474
  misc_feature 39: s=g or c
  misc_feature 108: y=c or t
  misc_feature 144: y=c or t
  misc_feature 221: r=a or g
  UNSURE 45: Xaa=Lys or Arg
acctactccacaggtccagccggccggtgagcgcctggsgaccgcagaggtgagagtcgcgcccgggagtccgccgcctgcgccaggatggagttcgtgaaatgcctyggccaccccgaagagttctacaacctggtgcgcttycggatcgggggcaagcggaaggtgatgcccaagatggaccaggactcgctcagcagcagcctgaaaacttgctacargtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctccct

SEQ ID NO: 1374 - DNA, 353 bp, Homo sapiens
  CDS 94..351
agttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggtccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcat

SEQ ID NO: 1375 - DNA, 466 bp, Homo sapiens
  CDS 30..464
  misc_feature 267: m=a or c
  misc_feature 433: k=g or t
  UNSURE 80: Xaa=Lys or Gln
  UNSURE 135: Xaa=Ile or Arg
aataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggmaagaggtgctgagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgakatgctggagacagacacattcaaattgcactgc

SEQ ID NO: 1376 - DNA, 369 bp, Homo sapiens
  CDS 58..369
  misc_feature 204: n=a, g, c or t
agtttgaatgaaagctctacaagatggcggcggtcggggccgaggcgcgaggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcnataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggc

SEQ ID NO: 1377 - DNA, 515 bp, Homo sapiens
  CDS 108..515
atttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaaatgtccaccacttcctgtggaaactgagagtcagctg

SEQ ID NO: 1378 - DNA, 346 bp, Homo sapiens
  CDS 96..344
agtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaagga

SEQ ID NO: 1379 - DNA, 223 bp, Homo sapiens
  CDS 30..221
aaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagag

SEQ ID NO: 1380 - DNA, 434 bp, Homo sapiens
  CDS 138..434
  misc_feature 103: r=a or g
  misc_feature 395: r=a or g
gcaatagcgagacgctggagcgcggcgtaggtggctgccgagtcttttcctgtttagggtcttatcctggcattgagggcgccggactggcgcttttggccgrcttggcattgggtgggcggcttcttgggacccacatgagccagtggcatcatccccgcagtggctggggccggagacgcgacttttcaggacgctcctcagccaagaagaagggcggaaaccacatccccgaaaggtggaaagactatctcccagttggacagcggatgcctgggactcgtttcattgctttcaaagttcctttgcaaaagagttttgaaaagaaacttgctccagaagaatgcttttcccctttggatctttttaacaaaatccgagaacaaaatgaagarcttggactgattattgatttaacatatactcaacgctat

SEQ ID NO: 1381 - DNA, 484 bp, Homo sapiens
  CDS 115..483
  misc_feature 458: w=a or t
  UNSURE 115: Xaa=Leu or Gln
ggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattcwactagcagtgatgacatgcttattaa

SEQ ID NO: 1382 - DNA, 403 bp, Homo sapiens
  CDS 54..401
aggtgcggtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaa

SEQ ID NO: 1383 - DNA, 372 bp, Homo sapiens
  CDS 37..372
  misc_feature 91: n=a, g, c or t
  misc_feature 92: r=a or g
  UNSURE 19: Xaa= *  or Glu or Gly or Lys or Gln or Arg
atgttttataagtattgacattacacagtgttaacaatgcatccacagagcttggctgaagaggaaataaaaacagaacaggaggtggtanragggcatggatatctctactcgctccaaagatcctggctctgcagagagaacagcccagaaaagaaagttccccagccctccacattcttccaatggccactcgccgcagacacatcaacaagccccattaaaaagaaaaagaaacctggcttactgaacagtaacaataaggagcaggatggacggaatgatttctactgctgggtttgtcaccgggaaggccaagtcctttgctgtgagctctgtccccgggtttatcacgctaagtgtctgagactg

SEQ ID NO: 1384 - DNA, 440 bp, Homo sapiens
  CDS 146..439
  misc_feature 17: y=c or t
gactggctccgccattygcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacag

SEQ ID NO: 1385 - DNA, 521 bp, Homo sapiens
  CDS 36..521
  misc_feature 235: w=a or t
  misc_feature 236: k=g or t
  UNSURE 67: Xaa=Ile or Lys or Met or Asn
aggagcgaaagagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgawkaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagat

SEQ ID NO: 1386 - DNA, 165 bp, Homo sapiens
  CDS 11..163
aagaaaagaaatggaaaggagtgatgacctgatgcgtgtgagaacacggggacgagccttgcggctccgtgggagagcttgggtgaggaccacccgtgccgcggcgacctctgatcgtcacccaagctgtgccctcccatttcacgaaaattatcacctgctgag

SEQ ID NO: 1387 - DNA, 406 bp, Homo sapiens
  CDS 184..405
  misc_feature 38: y=c or t
  misc_feature 203: s=g or c
  UNSURE 7: Xaa=Arg or Thr
ctcctcggccggcaggggcgcacattttaattcatatytgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccasggagcaggcagctgagtatgtcccagagaaggtgaagaaagcggaaaagaaattagaagagaatccatatgaccttgatgcttggagcattctcattcgagaggcacagaatcaacctatagacaaagcacggaagacttatgaacgccttgttgcccagttccccagttctggcagattctggaaactgtacattgaagcag

SEQ ID NO: 1388 - DNA, 380 bp, Homo sapiens
  CDS 24..380
  misc_feature 340: w=a or t
  misc_feature 341: w=a or t
  UNSURE 106: Xaa= *  or Phe or Leu or Tyr
ccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcattwwacaaaagaccctaatgttgtgggacagctggctaaacag

SEQ ID NO: 1389 - DNA, 246 bp, Homo sapiens
  CDS 2..244
  misc_feature 137: k=g or t
  UNSURE 46: Xaa= *  or Glu
gatgcaggggggcaactccggggtccgcaagcgcgaagaggagggcgacggggctggggctgtggctgcgccgccggccatcgactttcccgccgagggcccggaccccgaatatgacgaatctgatgttccagcakaaatccaggtgttaaaagaacccctacaacagccaaccttcccttttgcagttgcaaaccaactcttgctggtttctttgctggagcacttgagccacgtgcatgaacc

SEQ ID NO: 1390 - DNA, 491 bp, Homo sapiens
  CDS 37..489
  misc_feature 2: n=a, g, c or t
antttttggttaaaagaacccggaaagagaaggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggct

SEQ ID NO: 1391 - DNA, 219 bp, Homo sapiens
  CDS 22..219
cagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgaacg

SEQ ID NO: 1392 - DNA, 529 bp, Homo sapiens
  CDS 145..528
  misc_feature 195: s=g or c
  misc_feature 361: n=a, g, c or t
  UNSURE 17: Xaa=Lys or Asn
  UNSURE 73: Xaa=Leu or Met or Val
agtgagcggagaagctttcttccggcgggaagggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaasgtgccagctattcaacagaaaagaacggtggcttttctaaaccaatttgtggtgcacactgtacagttcctcaaccgcttttctacagtttgtgaggagaaactggcagacctttcacttcgtatccaacaaattgaaacaactctcaatattttagatgcaaagntgtcatctatcccaggcctagatgatgtcacagttgaagtatctcctttaaatgtcaccagtgtcacaaatggagcacatcctgaagccacttcagagcaaccacagcagaacagtacacgagactctggactacaggaaagtgaagtatcagcagaaaatatcttaa

SEQ ID NO: 1393 - DNA, 371 bp, Homo sapiens
  CDS 79..369
  misc_feature 18: s=g or c
  misc_feature 19: n=a, g, c or t
  misc_feature 71: s=g or c
agggccgagcgcggaacsnaggggctgctggggtgtttgtcgcagcgggttttcctcggcggtttgcggastgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgaggggggtaaagttctttacaaagttcgctggaaaggctatacatcggatgatgatacctgggagcccgagattcacctggagga

SEQ ID NO: 1394 - DNA, 385 bp, Homo sapiens
  CDS 218..385
ggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggtgggcgctggggcacgtctcccttttggcatactgtttgaggggtactgaggtgaaagggcggtcactgttcgggtcgtttttacacagc

SEQ ID NO: 1395 - DNA, 494 bp, Homo sapiens
  CDS 147..494
  misc_feature 359: n=a, g, c or t
  misc_feature 395: r=a or g
  misc_feature 461: s=g or c
  misc_feature 462: r=a or g
  UNSURE 105: Xaa=Ile or Met
  UNSURE 106: Xaa=Asp or Asn
agtgcgtgcgcggggcatgccgggagtggttgtgtacggtccgcagcggcaggtgaagcctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcnggaaaaactatgttaataagtcatgctttgaaagarctcatggaaatagaagaagtgagtgaaaatgtattacaagttcacttaaatggactgctgcagatsratgacaaaatcgccctaaaggaaatcacaagg

SEQ ID NO: 1396 - DNA, 318 bp, Homo sapiens
  CDS 4..318
  misc_feature 221: s=g or c
  UNSURE 73: Xaa=Ala or Gly
attatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagsaaagcatttgaaaaaatgtaactcaagagagaaaccaaaacctgatttctatattcaagatattaatgcaggcttaagagatgaaacagaaatacct

SEQ ID NO: 1397 - DNA, 540 bp, Homo sapiens
  CDS 120..539
  misc_feature 11: s=g or c
  misc_feature 340: w=a or t
  UNSURE 74: Xaa=Glu or Val
ctcagtccatsaggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagwaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaa

SEQ ID NO: 1398 - DNA, 329 bp, Homo sapiens
  CDS 27..329
tatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagt

SEQ ID NO: 1399 - DNA, 592 bp, Homo sapiens
  CDS 41..592
ctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgca

SEQ ID NO: 1400 - DNA, 456 bp, Homo sapiens
  CDS 99..455
ctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagaaaaagatcagcccattgagtgtccctccagatcccaagaagagctctgtgaagcaaact

SEQ ID NO: 1401 - DNA, 471 bp, Homo sapiens
  CDS 99..470
  misc_feature 395: w=a or t
  misc_feature 411: r=a or g
  UNSURE 99: Xaa= *  or Tyr
  UNSURE 105: Xaa=Asp or Asn
ctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtagcacagctttatctacctgacagtgttgctcattawggatggagttttagaracaagagaaacatgttcatttgcatagtgttagagttctctgagtcatgtcaaataaata

SEQ ID NO: 1402 - DNA, 254 bp, Homo sapiens
  CDS 40..252
  misc_feature 167: k=g or t
  misc_feature 182: k=g or t
  UNSURE 43: Xaa=Met or Arg
  UNSURE 48: Xaa=Leu or Arg
ctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacactttgtccakgtcactgatctttckggcaagtgagtacctgggtggagaggcatccagctggcaaaaggctgaggaaggcaatggctgggacgggct

SEQ ID NO: 1403 - DNA, 679 bp, Homo sapiens
  CDS 115..678
  misc_feature 137: y=c or t
  misc_feature 147: r=a or g
  misc_feature 347: y=c or t
  UNSURE 8: Xaa=Ala or Val
  UNSURE 78: Xaa=Phe or Ser
gtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgyggatgaggargaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatytggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatg

SEQ ID NO: 1404 - DNA, 534 bp, Homo sapiens
  CDS 339..533
acacagtgttcatcccctcaggaggatacagcttttgaggtaccatcttggaagcagagaccagacctcactagacacaaacttcctggcaccttgattttggacttcatagcctctagaactgtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatg

SEQ ID NO: 1405 - DNA, 323 bp, Homo sapiens
  CDS 115..321
  misc_feature 297: m=a or c
  UNSURE 61: Xaa=Asp or Glu
gtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggatcttggcgccgaggccagamttttcctcctcccatttcaggcgggt

SEQ ID NO: 1406 - DNA, 421 bp, Homo sapiens
  CDS 43..420
  misc_feature 286: r=a or g
  misc_feature 287: s=g or c
  misc_feature 355: n=a, g, c or t
  misc_feature 356: n=a, g, c or t
  misc_feature 381: n=a, g, c or t
  misc_feature 382: w=a or t
  UNSURE 82: Xaa=Ala or Gly or Ser or Thr
  UNSURE 105: Xaa= *  or Ala or Glu or Gly or Ile or Lys or Leu or Pro or Gln or Arg or Ser or Thr or Val
  UNSURE 113: Xaa=Phe or Leu
  UNSURE 114: Xaa=Cys or Ser
acgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacrscctctctactcgggccacgagcatctccacacagcttccagatgacccagccaagaccaccatgaagnnagcctattacctggcatgtggattnwgtcgctggacgtctagagatgtgggcatggcagacaaat

SEQ ID NO: 1407 - DNA, 497 bp, Homo sapiens
  CDS 204..497
  misc_feature 150: k=g or t
  misc_feature 166: s=g or c
gcgtgtgggaggggcgggtgcggggaggggcgcgcgtgcgtggggaggtgtgtgtgctgagatcagtgtgaacatggttacgcctcttcattcccgtccatgccgagcccccgactgcagcattcaaagcccccacggaggtggaggcgkgtgtgagaggtcgcgsagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaa

SEQ ID NO: 1408 - DNA, 410 bp, Homo sapiens
  CDS 187..408
  misc_feature 235: r=a or g
  misc_feature 303: y=c or t
  misc_feature 389: w=a or t
  misc_feature 390: n=a, g, c or t
  UNSURE 17: Xaa=Glu or Lys
  UNSURE 68: Xaa= *  or Phe or Leu or Tyr
agagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttraactaaaagctgaactcaacaatgaaaagaaagaaaagagaaaggaggctgtgaagaaagtgattgcygctatgaccgtggggaaggatgttagttctctctttccagacgtagtgaactgtatgcagactgacaatctggaacgagagaactwncatccttccccacggtcata

SEQ ID NO: 1409 - DNA, 286 bp, Homo sapiens
  CDS 118..285
acgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgtgggttttgctaccaggcaggtggccagcatgaccaagcctaccacaatcatcgaaaagaatggggacattctcaccctaaaaacacacagca

SEQ ID NO: 1410 - DNA, 350 bp, Homo sapiens
  CDS 122..349
agaagggctccaggatggaggccgacctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaa

SEQ ID NO: 1411 - DNA, 375 bp, Homo sapiens
  CDS 169..375
  misc_feature 48: k=g or t
  misc_feature 116: y=c or t
acagccgagggcactatggtaagacgagcgcgctggccgggaggcgckgcgaggcgagaaaagccccccgcacggccccgggagtgaggccgccattttaacctgattttggcctycaaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgat

SEQ ID NO: 1412 - DNA, 321 bp, Homo sapiens
  CDS 62..319
ctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgc

SEQ ID NO: 1413 - DNA, 279 bp, Homo sapiens
  CDS 56..277
  misc_feature 223: w=a or t
  UNSURE 56: Xaa=Lys or Asn
acattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataawttgctcaaggacctggacgccaatggagatgcccaggtggacttcagtgagttcat

SEQ ID NO: 1414 - DNA, 378 bp, Homo sapiens
  CDS 56..376
acattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcaggtgagccaggccggcagtgctggactcagcgggggctggggaagaaggggaaggcgtggcaggcagagggctgagagctgcggtggggtcggcggtcaaggggctcagaggcaagagggacagatcctgaaatgccctggaagcccagccaaggaacggacccaccctggcataaaggcaggggg

SEQ ID NO: 1415 - DNA, 279 bp, Homo sapiens
  CDS 116..277
  misc_feature 192: s=g or c
  misc_feature 196: y=c or t
  misc_feature 252: s=g or c
  UNSURE 26: Xaa=Arg or Thr
  UNSURE 46: Xaa=Arg or Thr
ttcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtasagcygcttgcagcgagaacactgaattgccaacgagcaggagagtctcaaggcgcaagasgaggccagggctcgacccacagagcac

SEQ ID NO: 1416 - DNA, 644 bp, Homo sapiens
  CDS 305..643
  misc_feature 635: s=g or c
  UNSURE 111: Xaa=Ala or Pro
atagcaacctccaatgcatgaaggaaactccgtttacacatgctcgtaggatcccctgcgtggaaacagcagcttgtctctgactacccggaggacatggagcaccccaaataggaactttagagggattgaaatctgttgcctgttccactaggaatattgtttgcaaggcacaaggtgtcttttggtagtgagcgcgctctgcgcatgcgcaggtccattcgggaattactgcccagcagccgactaagttgcattccttgaatcttcgcagaaaagacaattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcasctcgcccct

SEQ ID NO: 1417 - DNA, 315 bp, Homo sapiens
  CDS 138..314
  misc_feature 133: m=a or c
  misc_feature 283: r=a or g
  misc_feature 284: s=g or c
  UNSURE 49: Xaa=Asp or Glu or Gly
agctttggggttgtccctggacttgtcttggttccagaacctgacgacccggcgacggcgacgtctcttttgactaaaagacagtgtccagtgctccagcctaggagtctacggggaccgcctcccgcgccgmcaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagrsactttctacatcaaaacctccaccaccgtgc

SEQ ID NO: 1418 - DNA, 430 bp, Homo sapiens
  CDS 32..430
  misc_feature 139: n=a, g, c or t
gctggcccgtttccggtccggtgggtacaagatgacggagccgggcgcctctcccgaggacccttgggtcaaggtggagtatgcctacagcgacaacagcctggaccccgggctttttgtagaaagcacccgcaagggnagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttg

SEQ ID NO: 1419 - DNA, 461 bp, Homo sapiens
  CDS 70..459
gctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaat

SEQ ID NO: 1420 - DNA, 296 bp, Homo sapiens
  CDS 124..294
cttttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacc

SEQ ID NO: 1421 - DNA, 484 bp, Homo sapiens
  CDS 106..483
gtcagaacggcggccaggacgccggacgtgcggcagttgcaggcgagcaggcgaggaatcgccgtggcgtcttggtgttctccacgctggttcgcaggtgaagagatggcgtttgtgaagagtggctggttgctgcgacagagtactattttgaagcgctggaagaagaactggtttgatctgtggtcggatggtcacctgatctattatgatgaccagactcggcagaatatcgaggataaggtccacatgccaatggactgcatcaacatccgcacggggcaggaatgtcgggatactcagcccccggatggaaagtcaaaagactgcatgctccagattgtttgtcgagatgggaaaacaattagtctttgtgcagaaagcacagatgattgcttggcctggaaatttacactccaagattctaggacaaacacagcgtatgtgggctctgcagtcatgaccgatgagacatccgtggttt

SEQ ID NO: 1422 - DNA, 507 bp, Homo sapiens
  CDS 29..505
  misc_feature 493: r=a or g
agattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaargtgaacgatactgt

SEQ ID NO: 1423 - DNA, 443 bp, Homo sapiens
  CDS 59..442
  misc_feature 26: s=g or c
  misc_feature 415: y=c or t
aactcccggcttccaaccgcgcggasctctgccttggagattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaycacagcctggcaatcggtaccattagtg

SEQ ID NO: 1424 - DNA, 391 bp, Homo sapiens
  CDS 143..391
  misc_feature 344: r=a or g
  UNSURE 68: Xaa=Ala or Thr
gtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccagrccccggacctctatgatgatgacctggagttcagacccccctcgcgg

SEQ ID NO: 1425 - DNA, 485 bp, Homo sapiens
  CDS 28..483
gagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagccaaagccaggagacctggtgggtgtgaacaaagactcctatctgatcctggagacgctgcccacagagtatga

SEQ ID NO: 1426 - DNA, 393 bp, Homo sapiens
  CDS 150..392
agtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagccc

SEQ ID NO: 1427 - DNA, 359 bp, Homo sapiens
  CDS 143..358
  misc_feature 352: w=a or t
agtttattctagcagtggcatcttgcagaatgtgtctggggttaggataaagttttagtctgtcttgggcaaagtgtagaagaacaagaagaaaggaaggcttttgttgtaacaccctgactttaaaagttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgtwacagccc

SEQ ID NO: 1428 - DNA, 738 bp, Homo sapiens
  CDS 74..736
  misc_feature 610: m=a or c
  misc_feature 611: n=a, g, c or t
  UNSURE 180: Xaa=Ala or Pro or Ser or Thr
tctcgcgatctccgaggccgcatacatattacccacaattccctttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtmncttactgcattatcaagggaaaggcaagactgggacgtctagtccacaggaagacctgcaccactgtcgccttcacacaggtgaactcggaagacaaaggcgctttggctaagctggtggaagctat

SEQ ID NO: 1429 - DNA, 422 bp, Homo sapiens
  CDS 93..422
  misc_feature 100: k=g or t
  misc_feature 242: n=a, g, c or t
  misc_feature 392: n=a, g, c or t
  UNSURE 3: Xaa=Gly or Val
  UNSURE 100: Xaa= *  or Tyr
agtcgctgcacagtctgtctcttcgccggttcccggccccgtggatcctacttctctgtcgcccgcggttcgccgccccgctcgccgccgcgatgccagkgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggcngtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttantcagtgcctgctcgagattatctaattgat

SEQ ID NO: 1430 - DNA, 396 bp, Homo sapiens
  CDS 200..394
  misc_feature 13: s=g or c
  misc_feature 14: s=g or c
  misc_feature 264: n=a, g, c or t
  misc_feature 346: n=a, g, c or t
  UNSURE 22: Xaa=Ala or Glu or Gly or Val
agaggaggggccssaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggnactccactatgcatctctgcagaggctgccagtgcccagcagtgagggacctgacctcaggggcagagacaagagaggcacnaaggaggatccaagagctgactatgcctgcattgctgagaacaaacccac

SEQ ID NO: 1431 - DNA, 471 bp, Homo sapiens
  CDS 309..470
  misc_feature 115: s=g or c
  misc_feature 156: s=g or c
  misc_feature 318: n=a, g, c or t
  misc_feature 319: r=a or g
  misc_feature 369: r=a or g
  misc_feature 371: s=g or c
  misc_feature 392: n=a, g, c or t
  misc_feature 393: n=a, g, c or t
  misc_feature 394: n=a, g, c or t
  misc_feature 428: n=a, g, c or t
  misc_feature 429: s=g or c
  misc_feature 430: n=a, g, c or t
  misc_feature 431: r=a or g
  misc_feature 450: m=a or c
  UNSURE 4: Xaa= *  or Glu or Gly or Lys or Gln or Arg
  UNSURE 21: Xaa=Asp or Glu or Lys or Asn
  UNSURE 28: Xaa=Arg or Ser
  UNSURE 29: Xaa= *  or Ala or Glu or Gly or Lys or Leu or Met or Pro or Gln or Arg or Ser or Thr or Val or Trp
  UNSURE 40: Xaa=Asp or Glu
  UNSURE 41: Xaa=Ala or Glu or Gly or Leu or Pro or Gln or Arg or Val
  UNSURE 48: Xaa=Lys or Gln
ggtttggccttgggttccgctgtaggggaggtcccgtgcgaaagaatgaggagatcctggggccttacctactagcggaatcgactgaagagacgcctgccagtgcgggaggtasgaagctcgatccccaaagaaaagagcgagtgggcaggcagstgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtnragaagaaaggatgttgcctgcactgctcgccaatagcaccctgagaggcrasatttgcagaagcagcagcagnnngaagacacagcgccggtccaggaggcggctcgansnrgttcgtaaagtcgcccgamagctttttctccgtagtatgc

SEQ ID NO: 1432 - DNA, 334 bp, Homo sapiens
  CDS 162..332
  misc_feature 289: m=a or c
  misc_feature 291: m=a or c
  misc_feature 295: n=a, g, c or t
  misc_feature 298: n=a, g, c or t
  misc_feature 304: n=a, g, c or t
  misc_feature 309: r=a or g
  misc_feature 313: r=a or g
  UNSURE 43: Xaa=Lys or Thr
  UNSURE 44: Xaa=Lys or Gln
  UNSURE 45: Xaa=Ile or Lys or Arg or Thr
  UNSURE 46: Xaa=Ile or Lys or Arg or Thr
  UNSURE 48: Xaa=Ile or Lys or Arg or Thr
  UNSURE 50: Xaa=Glu or Lys
  UNSURE 51: Xaa=Gln or Arg
atatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggamamaganaanagaganaaaaragcrggactttgatgaagatgatat

SEQ ID NO: 1433 - DNA, 497 bp, Homo sapiens
  CDS 195..497
  misc_feature 87: k=g or t
atacttggctgtctggtttcaccaggaactctacccaaaagaggaaacagcaaggagaacatttgctttgtttgtaggagggaagtkgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaa

SEQ ID NO: 1434 - DNA, 467 bp, Homo sapiens
  CDS 60..467
  misc_feature 436: n=a, g, c or t
  UNSURE 126: Xaa=Ala or Asp or Gly or Val
gactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgnccagattgaggatttacaagaccagctagag

SEQ ID NO: 1435 - DNA, 198 bp, Homo sapiens
  CDS 36..197
  misc_feature 18: n=a, g, c or t
actcagggagccggaggngacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactca

SEQ ID NO: 1436 - DNA, 214 bp, Homo sapiens
  CDS 27..212
catgtgttttattgtttctttcagttatgtattctcattttgcccaagacctttggtcagagcagagcataaaagattctttccaaaaagtgatactaagaagatatgaaaaatgtagacatgacaatttacagttaaaaaaaggctgtgaaagtgtagatgagtgtccagtgcacaaaagaggttataatggacttaaacaatgtttggcaac

SEQ ID NO: 1437 - DNA, 432 bp, Homo sapiens
  CDS 270..431
  misc_feature 393: r=a or g
  UNSURE 42: Xaa=Glu or Lys
gccgcgggcgcgcccccgctctgcgctgtctctccgatggcgtccgcctcaggggccatggcgaacacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatraattaatggattccaaattgagatgcgtatttgaaatgc

SEQ ID NO: 1438 - DNA, 250 bp, Homo sapiens
  CDS 54..248
gttatgtatttatcatcaatcttattccactgcatgtatttgtgttgttactgatgcagagatacagcaaaagagtctacatagcatatagcactttctacattgtgggtttaatattatcaatgcagataccttttgtgggattccagccaatcagaacaagtgaacacatggcagctgcaggtgtctttgcattgctgcaagcttatgctttcttgcagtatctgagagaccgattaacaaaacaaga

SEQ ID NO: 1439 - DNA, 336 bp, Homo sapiens
  CDS 145..336
  misc_feature 75: s=g or c
  misc_feature 330: y=c or t
aagcggcttccgggtgctcgcgcgccgacctggacgcagagaagccagagactttcgcttccggctgccgcaggscttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatcccyacgccc

SEQ ID NO: 1440 - DNA, 424 bp, Homo sapiens
  CDS 103..423
  misc_feature 8: y=c or t
  misc_feature 44: w=a or t
  misc_feature 203: r=a or g
  misc_feature 204: r=a or g
  misc_feature 317: b=c or g or t
  misc_feature 318: m=a or c
  UNSURE 34: Xaa= *  or Trp
  UNSURE 72: Xaa=Ala or Gly or Val
agagttcygggggccaggcggccgccgcgagtctggtatcctgwgcttcgtgagttgagcgctgctgctccgcggtggagtcaccgcacagctcccgggatcatggtgttctacttcaccagcagcagcgttaattcatctgcctacactatttacatgggaaaagataaatatgaaaatgaagatctgatcaagcatggctrrcctgaagatatctggtttcatgtggacaaactctcttcggctcatgtataccttcgattacataagggagagaatatagaagacatcccaaaggaagtgctgatggactgtgbmaaccttgtgaaggccaatagcattcaaggctgcaagatgaacaacgttaatgtggtatatacgccgtggtctaacctgaagaaaacagctgacatggatgtggggc

SEQ ID NO: 1441 - DNA, 495 bp, Homo sapiens
  CDS 112..495
tttttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagca

SEQ ID NO: 1442 - DNA, 319 bp, Homo sapiens
  CDS 108..317
  misc_feature 143: n=a, g, c or t
  misc_feature 144: n=a, g, c or t
  misc_feature 151: s=g or c
  UNSURE 13: Xaa=Cys or Gly or Arg or Ser
  UNSURE 15: Xaa=Pro or Arg
gccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcaggcgcgnngcgtgcsgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaag

SEQ ID NO: 1443 - DNA, 358 bp, Homo sapiens
  CDS 69..356
  misc_feature 338: k=g or t
gccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagckgcaagttttgacgaagtttg

SEQ ID NO: 1444 - DNA, 357 bp, Homo sapiens
  CDS 72..356
agcggcgccctcaccggaagtcccgcctctgccgtgggcctgcgagaatcgaggcactcgctggcgtacccatgtatcgaaatgagttcacggcctggtaccggcggatgtcggtggtctacgggatcggcacctggtctgtgttgggctcactgctttactatagccggacaatggcgaagtcgtcagaccaaaaggatggctcagcaagtgaagtacccagtgaactctctgaacgcccaaaaggattttatgtggaaacagttgtcacatataaagaagattttgttccaaatacagaaaagatcctcaactattggaaatcatggactggtggcctggtacagaaccatgact

SEQ ID NO: 1445 - DNA, 404 bp, Homo sapiens
  CDS 142..402
  misc_feature 39: r=a or g
  misc_feature 41: n=a, g, c or t
  misc_feature 43: k=g or t
  misc_feature 130: r=a or g
gagagaggcgtgacagcgctgtgtttgcgagcgggagcrangkggcgccggctggggtgtgtgctcctgagctcttcagaaaccaggctgctttcaggaacattgctgtggattcccagggcctattccrctagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggt

SEQ ID NO: 1446 - DNA, 517 bp, Homo sapiens
  CDS 83..517
  misc_feature 182: n=a, g, c or t
  misc_feature 376: n=a, g, c or t
  misc_feature 479: n=a, g, c or t
  UNSURE 34: Xaa=Phe or Ile or Leu or Val
  UNSURE 133: Xaa=Asp or His or Asn or Tyr
gaaggcggtggtagcgcctcagtggtgtgggcctgcgccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgntttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgcnaaccgcctgtccaaggacgcccaccgctacgggatgcgaggcatgtcagcggaccctgaggagtatgacctggccgacctgagcagcctgccagagatcgacnacgccctggtggttttctgcatggccacctacggtgag

SEQ ID NO: 1447 - DNA, 476 bp, Homo sapiens
  CDS 189..476
  misc_feature 182: y=c or t
  misc_feature 284: m=a or c
  misc_feature 384: n=a, g, c or t
  misc_feature 396: r=a or g
  misc_feature 410: w=a or t
  misc_feature 427: n=a, g, c or t
  UNSURE 32: Xaa=Asp or Glu
  UNSURE 66: Xaa= *  or Glu or Lys or Gln
  UNSURE 70: Xaa=Asp or Asn
  UNSURE 74: Xaa=Asp or Glu
  UNSURE 80: Xaa=Leu or Pro or Gln or Arg
agtttgggcttggatggtaacgtttattttccttggcagagaagctgatcgtcgaagggcatctaaccaaagcggtagaagaaacaaagctttcaaaagaaaatcagacaagagcaaaagaatctgatttttcagatactctgagtccaagcaaggaaaaaagcagtgacgacactacagaygcccaaatggatgagcaagacctaaatgagcctcttgccaaagtgtcccttttaaaagatgacttgcagggtgcacagtcagaaattgaggcaaagcaagamatacagcatcttcgaaaggaattgatcgaagcccaggagctagctagaacaagtaaacaaaaatgctttgaacttcaagctcttttggaagaagaaaganaagcctatcgaratcaagttgaggawtccactaaacaaatacnggttcttcaagcccaattgcagaggttacacatcgatactgagaatctc

SEQ ID NO: 1448 - DNA, 428 bp, Homo sapiens
  CDS 164..427
  misc_feature 396: r=a or g
  UNSURE 78: Xaa=Lys or Arg
ataggtttgtaacaggaaggctgttgattctggcttcattgttgggccagtcatttgtgagctggtggccggaccacaggccacacacttcttccgtgcaaatcttcatgtattgaaactgcctgtgtattgtttttacgattggagacttggccaagaaaagatgagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacggacaaagttcagaaraaacatttacaaaatggataaatcagcatctc

SEQ ID NO: 1449 - DNA, 385 bp, Homo sapiens
  CDS 209..385
aaagatgctgatgaggggctgcagcatgcaattcacttcaccagcagtcactaaggtctgatctcttttctaaccatacctggaagatggaatgctggacccaggaaggctttgacatatcaatgcaccagggatcttaccaaactaaattttaagcacttatagctcaagattctccctctgagatgaaacatacttccaccctgtcatgtgtcagcttcagaagatatcaattgctcaagaaagtgttggacaagcagaaaagcacactgaacatttctggacttgtgaaagagctctgaatatggatctctcagggatattccatccccaccaatgctttaccaatgcgagagctggccaggctgagacatttaatgataac

SEQ ID NO: 1450 - DNA, 611 bp, Homo sapiens
  CDS 181..609
gtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgcacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagc

SEQ ID NO: 1451 - DNA, 232 bp, Homo sapiens
  CDS 75..230
attaccatggttaccaggcacagagtccagtgccccaacctggacgttccagaagaggccagggaggatctgagatggccttcttcaacttgtatctattgggatatcaaaattcctttcagaacaagaaaaggaacacaactgaagaaacaaaccagaaggaaccagagcctactaggcttccccccattatctcaaaagatgggaattattccgtgcaccagaatagcca

SEQ ID NO: 1452 - DNA, 391 bp, Homo sapiens
  CDS 179..391
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgac

SEQ ID NO: 1453 - DNA, 427 bp, Homo sapiens
  CDS 68..427
  misc_feature 371: m=a or c
  misc_feature 393: m=a or c
  misc_feature 399: m=a or c
  misc_feature 406: r=a or g
  misc_feature 424: m=a or c
  UNSURE 109: Xaa=Lys or Thr
  UNSURE 111: Xaa=Lys or Thr
  UNSURE 119: Xaa=Asp or Glu
gagaaggcgcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaataaatttcaagaattgcataaaaaacattctgaacagaaaagcacaacctcaagattcagagggaaaagamgaaaacgctccagaaaagatamattgamgaatgaraaagaattacatagtgamcgt

SEQ ID NO: 1454 - DNA, 379 bp, Homo sapiens
  CDS 148..378
agaactgcaggagactatctttctagacaaggcagttgaggaggagggagcgcttgagggggactggcctggcgtgcactccgcacctcggggacattattgcgcgtggaacggctgcttttggaagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtgg

SEQ ID NO: 1455 - DNA, 501 bp, Homo sapiens
  CDS 269..499
  misc_feature 77: s=g or c
  misc_feature 126: r=a or g
  misc_feature 135: s=g or c
  misc_feature 390: n=a, g, c or t
  UNSURE 41: Xaa=Lys or Met or Arg or Thr
agcagagaaaggaagtcctctccctggaggcctatctccctcagaactgcgcgagaagcgagaccttagaaggcagsgcttcccgcgaaggaccggaaaggagcgcctactaaggacgccgtcgargtccggggsgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacanggcctatgttgtccttggccagtttctggtgctaaagaaagatgaagacctcttccgggaatggctgaaagacacttgtggcgccaacgccaagcagtcccgggactgctt

SEQ ID NO: 1456 - DNA, 411 bp, Homo sapiens
  CDS 140..409
  misc_feature 121: r=a or g
  misc_feature 154: m=a or c
  misc_feature 159: k=g or t
  misc_feature 162: s=g or c
  misc_feature 186: y=c or t
  misc_feature 409: n=a, g, c or t
  UNSURE 5: Xaa=His or Gln
  UNSURE 7: Xaa=Leu or Trp
  UNSURE 8: Xaa=Ala or Gly
  UNSURE 16: Xaa=Ile or Thr
aaagaaagttctagtggcttgaggtatccgcaggagcggccgggtggcgggaggaaccgttacgggaactgaagttgcgggcctatgttgtccttggccagtttctggtgctaaagaaagrtgaagacctcttccgggaatggctgaaagacamttgtkggsgccaacgccaagcagtcccgggaytgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcntg

SEQ ID NO: 1457 - DNA, 459 bp, Homo sapiens
  CDS 141..458
gtcggctggaaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttaccc

SEQ ID NO: 1458 - DNA, 326 bp, Homo sapiens
  CDS 115..324
  misc_feature 3: n=a, g, c or t
  misc_feature 4: y=c or t
  misc_feature 8: n=a, g, c or t
  misc_feature 9: n=a, g, c or t
ctnytgannggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatcggcggctgatataaaaatttttttctgtagaaacagagtctccctctgttgcccaggctggagtgcagtgttactgtctcagttcactgc

SEQ ID NO: 1459 - DNA, 433 bp, Homo sapiens
  CDS 24..431
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatc

SEQ ID NO: 1460 - DNA, 426 bp, Homo sapiens
  CDS 54..425
acggcgagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattgg

SEQ ID NO: 1461 - DNA, 506 bp, Homo sapiens
  CDS 167..505
  misc_feature 99: m=a or c
  misc_feature 112: r=a or g
  misc_feature 483: r=a or g
  misc_feature 484: n=a, g, c or t
  misc_feature 498: s=g or c
  UNSURE 106: Xaa=Lys or Asn or Arg or Ser
  UNSURE 111: Xaa=Ala or Gly
tgcgagctcccggggaaaagcaacagtgtcctcctaagcctgaggccaccgcgaccgagccgagccaggctaagggaccagtgtctccctgcccccccmcccacctctaggrgctctggagccttaggaccatggacgctctcaataggaaccaaataggccctggatgccagacccagaccatggtgcagaaaggacccttggacctgatcgagacaggcaaagggctgaaagtgcaaacgacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctcctgtccggcagcctacccggctcactcarngctgcatgttgtgsctgggtca

SEQ ID NO: 1462 - DNA, 393 bp, Homo sapiens
  CDS 61..393
agaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgt

SEQ ID NO: 1463 - DNA, 428 bp, Homo sapiens
  CDS 42..428
  misc_feature 12: m=a or c
  misc_feature 13: y=c or t
agttccagaaamyaggactgaccaagaagcagaaaagcaagatgaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtg

SEQ ID NO: 1464 - DNA, 358 bp, Homo sapiens
  CDS 63..356
  misc_feature 13: y=c or t
  misc_feature 14: n=a, g, c or t
  misc_feature 23: s=g or c
  misc_feature 206: m=a or c
  misc_feature 267: y=c or t
  misc_feature 327: k=g or t
  UNSURE 48: Xaa=Asp or Glu
  UNSURE 69: Xaa=His or Tyr
  UNSURE 89: Xaa=Ala or Ser
gttttaagaatayntcagcgtastagaggatttaagcagatcgctttgcctactttaattatatgaaataccaggaggtcagatgtttaacctctttcaacatatctgtttcttttcctgcagaaacagatgattatgctgagattatagatgaagaagatacttacaccatgccctcaaccagggattatgagattcaaagagamagaatagaacttggacgatgtattggagaaggccaatttggagatgtacatcaaggcattyatatgagtccagagaatccagctttggcggttgcaattaaaacatgtaaaaactgtactkcggacagcgtgagagagaaatttcttcaaga

SEQ ID NO: 1465 - DNA, 460 bp, Homo sapiens
  CDS 217..459
  misc_feature 383: n=a, g, c or t
  misc_feature 416: n=a, g, c or t
  UNSURE 56: Xaa=Ile or Asn or Ser or Thr
  UNSURE 67: Xaa=Ile or Asn or Ser or Thr
acacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcancgctgtcattgtgggtacaatccttggatttancctccgaccatacagaatgagctaccgggaagtcaagtacttct

SEQ ID NO: 1466 - DNA, 366 bp, Homo sapiens
  CDS 75..365
attctgctgccaaaaatcttcaagctgagagcgaaaagcagattctttcactacaagagaagaacaaggagctgatggatgaatataatcatttaaaagaaagaatggatcaatgtgagaaagagaaagcaggaagaaaaattgaccttacagaagcacaggaaactgtaccttcacgatgtctacatctggatgcagagaatgaagttcttcaacttcaacagacattattctctatgaaagcaatacaaaagcaatgtgaaacactacagaagaataagaagcagctgaaacaagaagtagtaaacctcaaaagttatatggaaagaaatatgttagaacgtggtaagctgaatggcataaact

SEQ ID NO: 1467 - DNA, 362 bp, Homo sapiens
  CDS 28..360
  misc_feature 146: k=g or t
  misc_feature 147: k=g or t
  misc_feature 285: s=g or c
  misc_feature 286: m=a or c
  misc_feature 340: w=a or t
  UNSURE 40: Xaa=Cys or Phe or Leu or Trp
  UNSURE 86: Xaa=Asp or Glu
  UNSURE 87: Xaa=His or Asn
  UNSURE 105: Xaa=Ser or Thr
gagctcggcggcggcgggcgcgggaagatggcggcagcggcggcggcggctgcagaacagataacacttgttatttgggccgtgattcgcattggaccaaatggctgtgatagtatggagtttcatgaaagtggcctgcttcgatkkaagcaagtatctgacatgggagtgatccaccctctttataaaagcacagtaggaggaaggcgaaatgaaaatttggtcatcactggcaacaaccagcctattgtttttcagcaagggacaacaaagctcagtgtagasmacaacaaaacttctattacaagtgacatcggcatgcagttttttgacccgaggwctcaaaatatcttattcagcac

SEQ ID NO: 1468 - DNA, 403 bp, Homo sapiens
  CDS 136..402
  misc_feature 224: k=g or t
  misc_feature 252: s=g or c
  misc_feature 253: r=a or g
  misc_feature 307: k=g or t
  misc_feature 308: w=a or t
  UNSURE 30: Xaa=Ile or Ser
  UNSURE 39: Xaa= *  or Tyr
  UNSURE 40: Xaa=Gly or Arg
  UNSURE 58: Xaa= *  or Glu or Leu or Val
aaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgakccaagctatccacaagtacaatgcttasrgaaaagcagcatctgttatagcaaaatacccacacaaaataaagagtggagctkwagctaagaaattgcctggagtaggaacaaaaattgctgaaaagattgatgagtttttagcaactggaaaattacgtaaactggaaaagattcggc

SEQ ID NO: 1469 - DNA, 388 bp, Homo sapiens
  CDS 121..387
cccgttccaccgcggaccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtg

SEQ ID NO: 1470 - DNA, 503 bp, Homo sapiens
  CDS 100..501
  misc_feature 136: n=a, g, c or t
  UNSURE 13: Xaa= *  or Gly or Arg
agcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcngaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggt

SEQ ID NO: 1471 - DNA, 764 bp, Homo sapiens
  CDS 56..763
  misc_feature 36: k=g or t
  misc_feature 491: n=a, g, c or t
  misc_feature 536: n=a, g, c or t
  UNSURE 146: Xaa= *  or Glu or Lys or Gln
  UNSURE 161: Xaa=Ala or Pro or Ser or Thr
aggagagcaggcggctgcggttgctgcagccttcaktctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgnaatgtcattggagaaacctattgatgaaagaggtcccatcaaaancaaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtg

SEQ ID NO: 1472 - DNA, 223 bp, Homo sapiens
  CDS 56..223
  misc_feature 198: n=a, g, c or t
  UNSURE 48: Xaa=Ala or Glu or Gly or Val
aggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctggtaagtgcttttctgnaggagctaacgttccattttgccgc

SEQ ID NO: 1473 - DNA, 440 bp, Homo sapiens
  CDS 239..439
  misc_feature 157: m=a or c
  misc_feature 374: s=g or c
  UNSURE 46: Xaa=Ala or Pro
aacttgggactgccaagagctgaaggagagtggtgagcaaaggaatgaagggagagagagagaaactaaactggaagcttgagttttgtgtagcttcttgaaaccttatgaatggattactagaagctgagagccaggagagacctataggggatgmaagatccctacacattaaaagggggagaaaagcaggcggaattcttcttcctggctgtgttatccctccttcctgaaatgaatggaacccacaagactcccagaaggtgaagttaagagctcccagactcataaggttattagaacagcaaactggcaccccaaagaactttacggagacttgcaacctatcaacaagttggatgagggattaaaascttcaacaaccaacaaccccaagcatcaaactgaaggaaacattctaaccttcacagacagactgg

SEQ ID NO: 1474 - DNA, 437 bp, Homo sapiens
  CDS 27..437
  misc_feature 412: w=a or t
  misc_feature 414: r=a or g
  UNSURE 129: Xaa=Glu or Val
  UNSURE 130: Xaa=Asp or Asn
cacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgwaratggaggggtgatcctagagagt

SEQ ID NO: 1475 - DNA, 322 bp, Homo sapiens
  CDS 33..320
  misc_feature 19: n=a, g, c or t
  misc_feature 25: s=g or c
  misc_feature 43: s=g or c
  UNSURE 4: Xaa=Pro or Arg
ccacgtcagagggaaccgngcggasggccaacatggcggaacscaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagt

SEQ ID NO: 1476 - DNA, 483 bp, Homo sapiens
  CDS 105..482
cactgaccctcgtcccgcccccgccattcgccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggtt

SEQ ID NO: 1477 - DNA, 338 bp, Homo sapiens
  CDS 137..337
  misc_feature 3: n=a, g, c or t
  misc_feature 64: r=a or g
  misc_feature 129: k=g or t
  misc_feature 282: n=a, g, c or t
  misc_feature 333: n=a, g, c or t
  UNSURE 49: Xaa=His or Leu or Pro or Arg
  UNSURE 66: Xaa=Ala or Asp or Gly or Val
ganaacaagatggcgggttcgtggtgagaagccgtcaagcaggagtagaaattggtatgcttaraagcagattctaaaagcagtttctcttcagaacatcttttttcataccacttgataagcatcttkaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcntgctctgacttctgatggcaggacaatagtatgctaccacccttctgtggncattc

SEQ ID NO: 1478 - DNA, 266 bp, Homo sapiens
  CDS 99..266
  misc_feature 85: s=g or c
agctgagcctagagtccggctgttggctagagtgggcgcggatctggtgtggggaaggcggcgggactcaggcctgcctgcgaasattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacga

SEQ ID NO: 1479 - DNA, 411 bp, Homo sapiens
  CDS 120..410
  misc_feature 398: r=a or g
  misc_feature 399: n=a, g, c or t
  UNSURE 94: Xaa=Ala or Pro or Ser or Thr
acaacggctcgcggaggcttacgcgtagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagarncgaccatcttgc

SEQ ID NO: 1480 - DNA, 457 bp, Homo sapiens
  CDS 88..456
ttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagata

SEQ ID NO: 1481 - DNA, 428 bp, Homo sapiens
  CDS 276..428
tggaattctctttaacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcga

SEQ ID NO: 1482 - DNA, 207 bp, Homo sapiens
  CDS 48..206
atgcctgcctagacgggccagaaaagccaaacttaagaaatctgcctatgtacagaacaagtcaactaaggggtccatggaggctgaggcgggagaattgcttgggcccgggaggtggaggttgcagtgagccaccgcactccagcctgggggacagagtgagattccgtctcaggagaaataaaaaaactagatggacagataagt

SEQ ID NO: 1483 - DNA, 422 bp, Homo sapiens
  CDS 114..422
  misc_feature 35: k=g or t
agagggctcttccggcgccttcccaggcggggatkctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtg

SEQ ID NO: 1484 - DNA, 511 bp, Homo sapiens
  CDS 230..511
  misc_feature 493: s=g or c
  UNSURE 88: Xaa=Arg or Ser
aagcgtaggggaggggaccggagaggaggggttgagcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagsttaagcccaggaggggaa

SEQ ID NO: 1485 - DNA, 272 bp, Homo sapiens
  CDS 117..272
  misc_feature 16: k=g or t
  misc_feature 35: k=g or t
aactgcctccctgtgkgactgggtgagtccatatkctctctttgggtctcaattttgccttccctaatgaaggggtaagattggactaggtaagcatcttacaaccatttgtggtcatgagagctggggtggggaaggattgtcacttgacccccccagctctgtttcaagtgctgaaagagctccaggctatgctacgggaggagaagccagctactgaggaaaagccagctactgagaaaaagcggagtgatttaccattctcctccccc

SEQ ID NO: 1486 - DNA, 412 bp, Homo sapiens
  CDS 196..411
  misc_feature 2: r=a or g
  misc_feature 4: w=a or t
  misc_feature 16: w=a or t
  misc_feature 20: r=a or g
  misc_feature 23: w=a or t
  misc_feature 52: w=a or t
  misc_feature 66: w=a or t
  misc_feature 331: y=c or t
  misc_feature 382: n=a, g, c or t
  misc_feature 383: w=a or t
  UNSURE 46: Xaa=Phe or Leu
  UNSURE 63: Xaa=Asp or Phe or His or Ile or Leu or Asn or Val or Tyr
argwtctccaaatcawtgcragwtccgaataccctcggccacacctggcctwctccatgctcggawtaacttcctgcagcgaccaacaggctaaagagggggaagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggagytcaaacagaacactcctttcctcaactggaaagcaattattgagggtgcgnwcgcgtcatcactgcagaaacgtgcaggca

SEQ ID NO: 1487 - DNA, 590 bp, Homo sapiens
  CDS 374..589
  misc_feature 2: r=a or g
  misc_feature 4: w=a or t
  misc_feature 194: y=c or t
  misc_feature 509: y=c or t
  misc_feature 560: n=a, g, c or t
  misc_feature 561: w=a or t
  UNSURE 46: Xaa=Phe or Leu
  UNSURE 63: Xaa=Asp or Phe or His or Ile or Leu or Asn or Val or Tyr
argwtctccaaatcattgcgtagttccgaataccctcggccacacctggccttctccatgctcggaataacttcctgcagcgaccaacaggctaaagagggggaaggtctggaggttggaaagaggactggaatctgattggggttccaacaaatctgtaacaccgctgggaacgactgggtcccctttaagtycctttaggacagcgtttgaaatcttgctttcccctgcagggatccagcaccggctcctcctccggcaaccacggtgggagcggcggaggaaatggacataaacccgggtgtgaaaagccagggaatgaagcccgcgggagcgggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggagytcaaacagaacactcctttcctcaactggaaagcaattattgagggtgcgnwcgcgtcatcactgcagaaacgtgcaggca

SEQ ID NO: 1488 - DNA, 321 bp, Homo sapiens
  CDS 126..320
  misc_feature 124: n=a, g, c or t
aaaaaactacaactcccagggcgtcccggagcaggccaacgggactacgggaagcagcgggcagcggcccgcgggaggcacctcggagatctgggtgcaaaagcccagggttaggaaccgtagncatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatg

SEQ ID NO: 1489 - DNA, 306 bp, Homo sapiens
  CDS 66..305
aaaagccccaccccggtgcgcgggtatggcggccagcctgtggatgggcgcacctggaaccctacatggatgagaacttcatctccagagcctttgccaccatgggggagaccgtaatgagcgtcaaaattatccgaaaccgcctcactgggatcccagctggctactgctttgtagaatttgcagatttggccacagctgagaagtgtttgcataaaattaatgggaaaccccttccaggagccacacctgcgaaacgttttaaactgaactatgccacttacgggaaacaaccagataacagcc

SEQ ID NO: 1490 - DNA, 472 bp, Homo sapiens
  CDS 213..470
  misc_feature 462: s=g or c
  UNSURE 84: Xaa=Ala or Pro
agtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaagcgccaccagcggaagtacaggcgctactcgcggtcatactcgcggascggtcgcgat

SEQ ID NO: 1491 - DNA, 419 bp, Homo sapiens
  CDS 62..418
  misc_feature 177: m=a or c
  misc_feature 399: r=a or g
  UNSURE 39: Xaa=Asn or Thr
  UNSURE 113: Xaa= *  or Trp
agtgcgcggccgcggtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacamcatcaaccagtggactgcaagcatagtggaacaatccttaacacacctggttaagttgggaaaagcctataaatatattgtgacctgtgcagtggtccagaagagcgcatatggctttcacacagccagctcctgtttttgggataccacatctgatggaacctgtaccgtaagatgggagaaccggacggggtcgggcacggaggtctcgctgcggatgtrgatcacggtggacgtcgggg

SEQ ID NO: 1492 - DNA, 395 bp, Homo sapiens
  CDS 149..394
  misc_feature 301: n=a, g, c or t
  misc_feature 346: r=a or g
gcagttcttgagttccacatgcagagcagatgcgacagctagaagtgagtggggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggaccnagcaatgtacctaagtttgggtccccaaagccacctgtggcagtraaccttcttctgaggaaaagcctgacaaggaacccaagcccccgtttct

SEQ ID NO: 1493 - DNA, 503 bp, Homo sapiens
  CDS 137..502
  misc_feature 432: m=a or c
  misc_feature 471: m=a or c
  UNSURE 99: Xaa=Asn or Thr
  UNSURE 112: Xaa=Asn or Thr
tagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccamcccacaggatctgccccagagaaagtcctcgctcgtcamcagcaagcttgcgggtggccagttgaatgatg

SEQ ID NO: 1494 - DNA, 428 bp, Homo sapiens
  CDS 54..428
  misc_feature 306: w=a or t
  misc_feature 310: n=a, g, c or t
  UNSURE 85: Xaa=Asn or Tyr
  UNSURE 86: Xaa= *  or Leu or Ser or Trp
gactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggagwactngacgagcacgcgctggtggagctggagttgcaccgcggcagctccatggaaatcaatctgggggagaaggacactgcatcccagatcgaggccggtcagtgtggcctcgccaggccgt

SEQ ID NO: 1495 - DNA, 443 bp, Homo sapiens
  CDS 24..443
  misc_feature 106: y=c or t
  UNSURE 28: Xaa=Ala or Val
atttccgggtcactgtagatgcgatggcgccgattccaaagactgtggggcggatcaagctagactgctctctacggcccagctgcccactggaggtcgctgctgyacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatgattacctcctgggccacttggatgatgaagggaaatcaactggacagagtgacaggggcaagggggctgagggactgggcacctactgtggtctccgcaagtccttcctgtatcctccccaagagtctgagccctgccctcaaagcccctctgcctctgccaccttccccagtgtctcagacagcctg

SEQ ID NO: 1496 - DNA, 405 bp, Homo sapiens
  CDS 251..403
  misc_feature 227: n=a, g, c or t
  misc_feature 228: m=a or c
agttgtctctgccgctggggaaggtaaagcggcgacggcgtcctcaggagctgtggggtcccctgctagaagtgggggactcggcgggggagtcatttaatacttcatgattagaacaaatatgtgaaagttcccaccaaccagtgagaatttcttccttcagacggttttggatcttactgcacagctttctgagaagttcttttggtgccatgttttgtggcttnmatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaaga

SEQ ID NO: 1497 - DNA, 280 bp, Homo sapiens
  CDS 47..280
  misc_feature 23: s=g or c
  misc_feature 175: m=a or c
  misc_feature 179: r=a or g
  misc_feature 180: k=g or t
  misc_feature 191: m=a or c
  UNSURE 43: Xaa=Lys or Asn
  UNSURE 45: Xaa=Gly or Ile or Ser or Val
  UNSURE 49: Xaa=Lys or Gln
tttgggctgtgggcggtgcgcasggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaattctaaaaaagaamcgarktggtgctagcmaaacagctgttgttgagcgaattgttagaacatcttctggagaaggacatcatcaccttggaaatgagggagctcatccaggccaaagt

SEQ ID NO: 1498 - DNA, 390 bp, Homo sapiens
  CDS 129..389
acacagttgttgcaaagtgctcagcactaagggagccagcgcacagcacagccaggaaggcgagcgagcccagccagcccagccagcccagccagcccggaggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaaacctggcc

SEQ ID NO: 1499 - DNA, 367 bp, Homo sapiens
  CDS 211..366
atttgaatggggacttggatgaactttctccttgaactatatatgtgatggaaggagttttctaatcacataaatagaggaagattttaagagtaatgatggatttaaaagctacttttcaaaggttttaggagaaatcggaagcatagaagagatctgggctcattcagctcaatcacagtgagagttacccaaagctcagcatccgtgatggtctacggggcttccgaggcgatcgggcagcatcagtcttcagctgctaagccgagaaggagtcagtcagagagcctcgggccagagttccaggggatctgggagtggctgccagactgggacactggtcttctccttcctttggactcagact

SEQ ID NO: 1500 - DNA, 584 bp, Homo sapiens
  CDS 277..582
  misc_feature 129: s=g or c
gtggccgctctaggcagcggggaggtcgcggggttgaggggggttgtgaaaggagagcggcctctcctctatggtcacggggccggggcacgcttcccccactctgtcttgttacttccggtagcgaasctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatgggatgccattgaaaagttatttcctgatgccattagactgagatttgaagacattcagcagaataatgacatagtccaaagtcttgcagcctttcagaaatatgggaatgatcagattcctttagc

SEQ ID NO: 1501 - DNA, 275 bp, Homo sapiens
  CDS 63..275
cttgttcctcaagcggccgctgggggcgccagagcaggaccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggag

SEQ ID NO: 1502 - DNA, 423 bp, Homo sapiens
  CDS 210..422
  misc_feature 122: k=g or t
  misc_feature 134: r=a or g
  misc_feature 188: n=a, g, c or t
gtcggccggctccgcccggctgccgcctaggatgaatatcatggacttcaacgtgaagaagctggcggccgacgcaggcaccttcctcagtcgcgccgtgcagttcacagaagaaaagcttkggccaggctgaraagacagaattggatgctcacttagagaacctccttagcaaagctgaatgtacnaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacag

SEQ ID NO: 1503 - DNA, 257 bp, Homo sapiens
  CDS 84..257
  misc_feature 92: y=c or t
agactggattaggatgcctcgcgactaggggtccagagacagaggcctccagttcccaggcacttcgggaagaggaggctgaaatgatgcaycagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctg

SEQ ID NO: 1504 - DNA, 394 bp, Homo sapiens
  CDS 90..392
  misc_feature 29: s=g or c
  misc_feature 48: s=g or c
  misc_feature 268: r=a or g
  UNSURE 60: Xaa=Asp or Gly
tctgtccggacggaagcaggaagcgggasgtagggccacgcctgcggsctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgrtattactgtaccgttagaagtttttgaatatatagatcaaggtcgaaatccccagctctacaccaaagagtgcctggagagggctctagctaaaaatgagcaagttaaaggcaagatcgacaccat

SEQ ID NO: 1505 - DNA, 282 bp, Homo sapiens
  CDS 28..282
  misc_feature 27: k=g or t
ggaaaagaggtgggatcgtttgtcgckatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtac

SEQ ID NO: 1506 - DNA, 482 bp, Homo sapiens
  CDS 329..481
  misc_feature 358: r=a or g
  misc_feature 451: w=a or t
  misc_feature 461: r=a or g
  UNSURE 45: Xaa=Ile or Val
agtgggggaggctgacatcaccacggcggcagccctttaagcgccccatcctgtctgtccgaacccagacacaagtcttcactccttcctgcgagccctgaggaagccttctttccccagacatggccaacaagggtccttcctatggcatgagccgcaattctaccagaggtacaaggaggaactggtaccattccttctgaaattattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaratactggcaaaccgaatccagcagcacatcaaaaagcttatccatcatgatcaagtgggcttcatccctgggatgcaaggctggttcaatatwcgcaaatcartaaatgtaatccagcacataa

SEQ ID NO: 1507 - DNA, 887 bp, Homo sapiens
  CDS 290..886
  misc_feature 329: n=a, g, c or t
  misc_feature 330: n=a, g, c or t
  UNSURE 14: Xaa= *  or Ala or Glu or Gly or Lys or Leu or Met or Pro or Gln or Arg or Ser or Thr or Val or Trp
aggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagagnngcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacagggagctcccaggcgggcatgacagggtacgggatgcccaggcagatcatgtag

SEQ ID NO: 1508 - DNA, 687 bp, Homo sapiens
  CDS 90..686
agccatatcccagccccgtctgcagggagccggaggtgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacagggagctcccaggcgggcatgacagggtacgggatgcccaggcagatcatgtag

SEQ ID NO: 1509 - DNA, 427 bp, Homo sapiens
  CDS 156..425
ccgctgggcccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactca

SEQ ID NO: 1510 - DNA, 479 bp, Homo sapiens
  CDS 120..479
  misc_feature 21: k=g or t
taagataggtataagaggcakggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtct

SEQ ID NO: 1511 - DNA, 226 bp, Homo sapiens
  CDS 21..224
  misc_feature 33: r=a or g
  misc_feature 34: r=a or g
  UNSURE 5: Xaa=Glu or Gly or Lys or Arg
tgaaagatttccaggacctaatgcttgccagtrrggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcag

SEQ ID NO: 1512 - DNA, 599 bp, Homo sapiens
  CDS 202..597
  misc_feature 548: m=a or c
  misc_feature 549: n=a, g, c or t
  UNSURE 116: Xaa=Ala or Asp or Glu
gtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggmnaatgagaaacttcataaagaaattgaacaaaaggacaatgaaattgcccg

SEQ ID NO: 1513 - DNA, 442 bp, Homo sapiens
  CDS 45..440
  misc_feature 391: m=a or c
  misc_feature 392: n=a, g, c or t
  UNSURE 116: Xaa=Ala or Asp or Glu
attgttttttaattactagtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggmnaatgagaaacttcataaagaaattgaacaaaaggacaatgaaattgcccg

SEQ ID NO: 1514 - DNA, 731 bp, Homo sapiens
  CDS 334..729
  misc_feature 285: n=a, g, c or t
  misc_feature 680: m=a or c
  misc_feature 681: n=a, g, c or t
  UNSURE 116: Xaa=Ala or Asp or Glu
gtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttnacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggmnaatgagaaacttcataaagaaattgaacaaaaggacaatgaaattgcccg

SEQ ID NO: 1515 - DNA, 285 bp, Homo sapiens
  CDS 10..285
  misc_feature 13: y=c or t
  misc_feature 96: m=a or c
  misc_feature 110: y=c or t
  misc_feature 157: r=a or g
  misc_feature 163: r=a or g
  misc_feature 168: y=c or t
  misc_feature 169: n=a, g, c or t
  misc_feature 186: k=g or t
  misc_feature 196: w=a or t
  misc_feature 198: n=a, g, c or t
  misc_feature 200: n=a, g, c or t
  misc_feature 201: y=c or t
  misc_feature 240: r=a or g
  misc_feature 265: k=g or t
  UNSURE 2: Xaa=Cys or Arg
  UNSURE 29: Xaa=His or Gln
  UNSURE 34: Xaa=Ala or Val
  UNSURE 50: Xaa=Gly or Ser
  UNSURE 52: Xaa=Ala or Thr
  UNSURE 54: Xaa=Cys or Gly or Arg or Ser
  UNSURE 59: Xaa=His or Gln
  UNSURE 63: Xaa=Phe or Ile or Leu or Met
  UNSURE 64: Xaa=Ala or Asp or Gly or Val
  UNSURE 86: Xaa=Ala or Ser
gttctataaatgygtcacaagaatggcttccctcaggaaggcggcattaccgctgcctttctgcagaaaaggaaactaaggctcagcaagaaccamcgcccagccagagycaaggtcacagagcacgtccgtggcacgcgtccagggtcgtgccacrgcaggrccggyngcttcggacgcgggcakccgggtcccwtngnyttgacagatggggaaaccgaggcccggccggctgccgargctcctcgcacctaccccagcaackcaaattcaccacctcggact

SEQ ID NO: 1516 - DNA, 406 bp, Homo sapiens
  CDS 111..404
  misc_feature 80: k=g or t
gagatcaaagggcgtcgcccaaagcgggacaggtccagcggttgttctgtgtgaagtcgcgcggcttccacccacgcagkttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagcc

SEQ ID NO: 1517 - DNA, 372 bp, Homo sapiens
  CDS 164..370
gtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatg

SEQ ID NO: 1518 - DNA, 465 bp, Homo sapiens
  CDS 87..464
cccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttcca

SEQ ID NO: 1519 - DNA, 441 bp, Homo sapiens
  CDS 188..439
acaagtatgttacgatggctcgattgcttttgcctagcggaaaccattcactaaggaccgagcaccaaataaccaaggaaaaggaagtgagttaggacgtactcgtcttggtgagagcgtgagtgctgagatttgggagtctgcgctaggcccgcttggagttctgagccgatggaagagttcactcatgtttgcacccgcggtgatgcgtgcttttcgcaagaacaagactctcggctatggagtccccatgttgatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaatccagaaagccttaagactaagacaacttgactctgc

SEQ ID NO: 1520 - DNA, 314 bp, Homo sapiens
  CDS 21..314
atggttccgagggcaggactatgggaggctgccctgtacggaaaagaagaagaaatggcagtaaagagggcaaccatcattccacccagcccaaaaggaataagagaaaccctatctttcaggattctcaagatacagaggtattttcatggagtgataatgaaaggagcagcagccgcattaatatcccagagagagcaagtggaccagaaggcaacttaaaccagattgttactgaacccgatgcaaactttccccagttcttgcatgaggggtatgtaccatgccaaggtctttactcccatatcaaccag

SEQ ID NO: 1521 - DNA, 404 bp, Homo sapiens
  CDS 178..402
  misc_feature 321: m=a or c
  misc_feature 398: m=a or c
  UNSURE 48: Xaa=Asp or Glu
  UNSURE 74: Xaa=Asn or Thr
atcattacgcgctcttaaggtttctccgtggtgttttggaaggtcccggcacggctaccgtcgccccacgctaggaaattttttttttattttcaacctttgttacatagcactgaggctacaagatcatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggamgttagcagggcaaacactcctgattcagatataactgaaaaaacagaagattctagtgttccagaaactccagatamtgaaag

SEQ ID NO: 1522 - DNA, 421 bp, Homo sapiens
  CDS 12..419
accttagcaagatggcggctccctgggcgtccctgcgcctggtcgcccccatgtggaatgggcgtatcaggggcatccatcgcctgggtgcggcagtggccccagagggcagtcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctcccacgtggacgactg

SEQ ID NO: 1523 - DNA, 461 bp, Homo sapiens
  CDS 165..461
  misc_feature 428: n=a, g, c or t
  misc_feature 429: r=a or g
  misc_feature 459: m=a or c
  misc_feature 460: n=a, g, c or t
  misc_feature 461: s=g or c
  UNSURE 88: Xaa=Asp or Glu
  UNSURE 89: Xaa=Gly or Arg
  UNSURE 99: Xaa=His or Ile or Lys or Leu or Met or Asn or Pro or Gln or Arg or Ser or Thr
agtggaataacccccttctgaaaaatggtttcacccgctccgtctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctganrgggctgtcatcagcactgtgcggccacagmns

SEQ ID NO: 1524 - DNA, 290 bp, Homo sapiens
  CDS 128..289
gtgagagttccccatctgaggcgtttgttgcagctacctgcacttctagatgctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccc

SEQ ID NO: 1525 - DNA, 510 bp, Homo sapiens
  CDS 223..510
  misc_feature 10: m=a or c
  misc_feature 13: r=a or g
  misc_feature 310: r=a or g
  UNSURE 30: Xaa=Asp or Asn
atagattggmacrcgctggtgagctggcaccctccgcttcgcctgctctcccctcctctctgcgcatcttccccctagcacagagaagagagtacagcagctcgggggtgagcagagctagggctgggaaggtggagtgaggacgcagagacctagagccagggagatgagtggcaacaggaggcagcccagccgtagggccagacccgggaaaaggagaagatgaaggaagccaaggatgcccgctataccaatgggcacctcttcaccaccatttcagtttcaggcatgaccatgtgctatgcctgtracaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggcc

SEQ ID NO: 1526 - DNA, 332 bp, Homo sapiens
  CDS 135..332
cttcctaaatagaggggcctgggaaactgaaatgcccacatccaggaagtcctaggagctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagac

SEQ ID NO: 1527 - DNA, 457 bp, Homo sapiens
  CDS 64..456
ctctctctgccgggttccgggaaaaggagctcctgctgccactgctcttccggagcctgcagcatggggcccctgccgcgcaccgtggagctcttctatgacgtgctgtccccctactcctggctgggcttcgagatcctgtgccggtatcagaatatctggaacatcaacctgcagttgcggcccagcctcataacagggatcatgaaagacagtggaaacaagcctccaggtctgcttccccgcaaaggactatacatggcaaatgacttaaagctcctgagacaccatctccagattcccatccacttccccaaggatttcttgtctgtgatgcttgaaaaaggaagtttgtctgccatgcgtttcctcaccgccgtgaacttggagcatccagagatgctggagaaagcgtcccgggagctgtggatgcgcgtctggtcaaggaatgaagaca

SEQ ID NO: 1528 - DNA, 402 bp, Homo sapiens
  CDS 220..402
  misc_feature 7: s=g or c
  misc_feature 33: r=a or g
  misc_feature 41: s=g or c
  misc_feature 267: r=a or g
  misc_feature 399: r=a or g
  misc_feature 400: m=a or c
  misc_feature 401: w=a or t
  UNSURE 60: Xaa=Ile or Met
  UNSURE 61: Xaa=His or Ile or Leu or Asn
gacgtasatctcatgtgaccaggagtcgacgtrtgcagaastcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgarccaaagcatgaggaagagccaaagcctgaggaaaagccagaagaggaggagaagctagaggaggaggccaaagcaaaaggaacttttagagaaaggctgattcaatctctccaggagtttaaagaagatatrmwc

SEQ ID NO: 1529 - DNA, 396 bp, Homo sapiens
  CDS 199..396
atcatttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggcggctaaagcagttactcaggaagggttctacagggacaaaggagatggaacttcccccagagccccaggccaatggggaggcagtgggagctgggggtgggcccatctactacatctatgaggaagaggaa

SEQ ID NO: 1530 - DNA, 379 bp, Homo sapiens
  CDS 97..378
  misc_feature 92: m=a or c
atagggaggcggctgaacaaggttgtgggggtaggaagctagggttagaggcaacccgtgaggctagaaccccgaacgtggtcggttggagmaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatg

SEQ ID NO: 1531 - DNA, 417 bp, Homo sapiens
  CDS 52..417
  misc_feature 361: m=a or c
  UNSURE 104: Xaa=Lys or Gln
cttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaacgtaagtcctcagcaggaamaacacaaacaaaattttgctccatttaatgtcttggtgcctcgatttaagaactac

SEQ ID NO: 1532 - DNA, 477 bp, Homo sapiens
  CDS 290..475
  misc_feature 318: n=a, g, c or t
  UNSURE 10: Xaa=Cys or Phe or Ser or Tyr
atcttgtgttgttgaggctgaggactgactggggttctgagactccctgtcccggaccgcagcgttaaaaggatctgaacaaagtctgctcaaatctcctgctgtgaaccagcagaatttttgaacagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactntgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttct

SEQ ID NO: 1533 - DNA, 469 bp, Homo sapiens
  CDS 90..467
atgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtgacagg

SEQ ID NO: 1534 - DNA, 401 bp, Homo sapiens
  CDS 90..401
  misc_feature 157: k=g or t
  misc_feature 158: n=a, g, c or t
  misc_feature 248: y=c or t
  misc_feature 249: n=a, g, c or t
  misc_feature 265: r=a or g
  misc_feature 396: n=a, g, c or t
  UNSURE 23: Xaa= *  or Cys or Phe or Leu or Trp
  UNSURE 54: Xaa=Asp or His or Asn or Tyr
  UNSURE 59: Xaa=His or Arg
  UNSURE 103: Xaa= *  or Gly or Arg
atgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactknccactactgcagggatcccttgcaggggaagaagtatgtgcaaaaggatggccaccactgcaagcattgcgtgaagtgcaacaaggccaynacatctggaggaatcrcttaccaggatcagccctggcatgccgattgctttgtgtgtgttacctgataagaagctggctgggcagcgtttcaccgctgtggaggaccagtattactgcgtggattgctacaagaactttgtggccangaagt

SEQ ID NO: 1535 - DNA, 411 bp, Homo sapiens
  CDS 192..410
ataacgaccttaacagccataacggccgtaactgccataacggccggctgcgcgaggcccttccagcatttccactttcgtcaggtactggagagggctgccggccggatgccagggcagaggggcagggcggacggctaggagttcaagaaacatcctggtctgagggaaaggctgcagcctgcaccgccatgaataagcttttcagcttctggaagaggaagaatgagacccgcagccagggctacaaccttcgagaaaaggatttaaagaaacttcacagagctgcttcagtcggggatttgaagaagctgaaggaataccttcagatcaagaaatatgatgtaaatatgcaggacaaaaaatacagtgttgtccaatcttctagatggcttttatcctacaccactc

SEQ ID NO: 1536 - DNA, 466 bp, Homo sapiens
  CDS 286..465
  misc_feature 2: y=c or t
cycttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggaggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaag

SEQ ID NO: 1537 - DNA, 376 bp, Homo sapiens
  CDS 110..376
  misc_feature 345: r=a or g
  UNSURE 79: Xaa=Lys or Arg
agagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgargaactgtggccaccgcttccacatccttgtg

SEQ ID NO: 1538 - DNA, 592 bp, Homo sapiens
  CDS 356..592
  misc_feature 159: s=g or c
  misc_feature 311: m=a or c
cacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtmtggcacccccaaacccaaacgcccagcgatccttacctaccacgatgtgggactcaactataaatcttgcttccagccactgtttcagttcgaggacatgcaggaaatcattcagactttgtgcgggttcatgtggatgcccctggaatggaagagggagccctgtgttccctttgggatatcagtacccatctctggaccagcttgcagacatgatcccttgcgtcctgcagtacctaaatttctctacaataattggagtggtgttggagctggagcct

SEQ ID NO: 1539 - DNA, 391 bp, Homo sapiens
  CDS 114..389
  misc_feature 122: s=g or c
  misc_feature 385: m=a or c
  UNSURE 3: Xaa=Asp or Glu
  UNSURE 91: Xaa=Asn or Thr
aaaaggcaagtgaaggtggaagcggccgcggcggcagcagaccccagagtcagaaggagtgagaaccctgacccctaatcccactgcatccagccaataggagcccagccaccatggcggastgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcaatgtggatgcccctggaamtggaag

SEQ ID NO: 1540 - DNA, 441 bp, Homo sapiens
  CDS 149..439
cccggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagca

SEQ ID NO: 1541 - DNA, 369 bp, Homo sapiens
  CDS 92..367
  misc_feature 213: n=a, g, c or t
  UNSURE 41: Xaa= *  or Leu or Ser or Trp
cccggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagtngaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagca

SEQ ID NO: 1542 - DNA, 501 bp, Homo sapiens
  CDS 149..499
cccggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggtgagctatgcccgtggtcctcagggccgggacccgggcccagcccaggctcctttcgatgttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagca

SEQ ID NO: 1543 - DNA, 500 bp, Homo sapiens
  CDS 33..500
  misc_feature 457: n=a, g, c or t
  UNSURE 142: Xaa=Ala or Asp or Gly or Val
ctctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgntatgatgaggagaggaaaacaaactttcagcagttgttgcagc

SEQ ID NO: 1544 - DNA, 343 bp, Homo sapiens
  CDS 159..341
cgtccgggctagttcctggcgcgacggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcactgaggagcgggaggattgtaagatactgtgcctttgctccagggcatttgtggaggatcgaaaattgtacaatttgggattaaaaggctattacatcagagacagtggcaacaattcaggagaccaggcgacagaaga

SEQ ID NO: 1545 - DNA, 502 bp, Homo sapiens
  CDS 65..502
  misc_feature 46: n=a, g, c or t
gtgagaggcggtagggcggcggcggcggtggtatcggcggcagtgntgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagataga

SEQ ID NO: 1546 - DNA, 261 bp, Homo sapiens
  CDS 55..261
gtttacttccgggtttattactactgaaggaagaactaggctttcatccccgccatggcggagctgatccagaagaagctacagggagaagtggagaaatatcaacagctacagaaggacttaagtaaatccatgtcggggaggcagaaacttgaagcacaactaacagaaaataatatcgtgaaagaggaactggccctgctggatgggtccaacgtggtctttaaacttctgggtccggtgctagtcaaacaggagctg

SEQ ID NO: 1547 - DNA, 258 bp, Homo sapiens
  CDS 26..256
  misc_feature 112: y=c or t
  misc_feature 122: w=a or t
  misc_feature 126: w=a or t
  misc_feature 128: n=a, g, c or t
  misc_feature 164: m=a or c
  UNSURE 33: Xaa=Ser or Thr
  UNSURE 34: Xaa= *  or Leu
  UNSURE 35: Xaa=Ala or Pro or Ser or Thr
  UNSURE 47: Xaa=Lys or Gln
gcttggtgcgcccgctgtcaccgccatggctgccccgtgtttgctgcggcaaggacgagccggggcgctgaagactatgctccaggaagcccaggtgtttcgaggacttgcytctacggttwcttwgnctgcggaatcagggaagagtgaaaagggtcagccamagaattccaagaagcaaagtccaccaaaaaagccagccccagtgcctgctgagccgtttgacaacactacctacaagaacctgcagcatcatga

SEQ ID NO: 1548 - DNA, 360 bp, Homo sapiens
  CDS 111..359
  misc_feature 31: k=g or t
  misc_feature 116: m=a or c
cattttgatggcaggaagagtccggttctgkgacagctggagacagtggtggtgactgaaataactttaccaaaggaaagctattttgcgaactatcttctccagcggagatggcmaatgtgctttgtaacagagccagactggtttcctatctcccaggattttgctctttagttaaaagggttgtcaatcccaaagccttttcgactgcaggatcatcaggttcggatgagtctcatgtggctgctgcacctccagatatatgctctcgaacagtgtggcctgatgaaactatgggaccctttggacctcaagatcagaggttccagcttcctgggaacataggttttgattgtcacc

SEQ ID NO: 1549 - DNA, 341 bp, Homo sapiens
  CDS 179..340
tattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtac

SEQ ID NO: 1550 - DNA, 328 bp, Homo sapiens
  CDS 148..327
  misc_feature 61: m=a or c
  misc_feature 70: m=a or c
  misc_feature 131: m=a or c
  misc_feature 133: r=a or g
  misc_feature 134: m=a or c
  misc_feature 321: r=a or g
ctcctcacttccggcttcgctgctcttggttctggttctggaggctgggttgagaggtcgmcggtccgamtgtcctcggcggttggtcagtgtgaatttgtgacagctgcagttgctccccgcccccgagmarmcgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagarggtgtta

SEQ ID NO: 1551 - DNA, 282 bp, Homo sapiens
  CDS 103..282
  misc_feature 94: s=g or c
acctggtcaaggccgttccttcagtgttttcagacgccctgggaacgcggctgcagggtccggtcttcggtttgcacagctagaggccgcgcasagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaag

SEQ ID NO: 1552 - DNA, 507 bp, Homo sapiens
  CDS 339..506
  misc_feature 4: r=a or g
  misc_feature 243: s=g or c
agaracagacttgtgaaaaagagttatgcccactttggggagacttcgaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgcccaggcgctacgcgaastctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcaacaagcctcgtgtgatccgggaagtgcgggctgactctgtggggaagttggtaactgtgc

SEQ ID NO: 1553 - DNA, 458 bp, Homo sapiens
  CDS 93..458
atcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgttatttcaaacgtttttatcttaataactcagtaatggaatatcaccccaggataataatgctcacttgtgcatttttggcctgcaaagtagatgaattcaatgtatctagtcct

SEQ ID NO: 1554 - DNA, 316 bp, Homo sapiens
  CDS 19..315
gagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcag

SEQ ID NO: 1555 - DNA, 288 bp, Homo sapiens
  CDS 96..287
  misc_feature 115: m=a or c
  misc_feature 118: k=g or t
  misc_feature 122: y=c or t
  misc_feature 124: m=a or c
  misc_feature 125: m=a or c
  misc_feature 132: w=a or t
  UNSURE 7: Xaa=Lys or Thr
  UNSURE 8: Xaa=Leu or Trp
  UNSURE 10: Xaa= *  or Ser or Tyr
  UNSURE 13: Xaa= *  or Lys
gcagtcagtttccaagttttgctttgcaatcagtagttttcaagggagcttttaaagctgaactgaaatgtttgaaatgtggaacactcttgaccatgaaatatgttctacttamatkgccytmmagccttwaaaaagttctttgcattagagtcaaggattacattcttcctggagccaagcatggggccagctgtaaacaagccgcatttctccttggggagactgataatttaaaaggtttgttgtgtcagaaacattcccagcttcatcaccaaccctttcctt

SEQ ID NO: 1556 - DNA, 483 bp, Homo sapiens
  CDS 140..481
  misc_feature 2: w=a or t
  misc_feature 430: r=a or g
gwtttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacgatgaagggaactggcttcatgccattaaacgtaggaaagaaattcttcttgaaggctgtgctgagaaaagtaaacagctgaaggatgaaggagccagtttggctgaaaataaaagatatcgggaggcaattcagaagtgggatgaagcactacagttaactccaaatgatgctaccctatacgaratgaaatcacaggtgctaatgtctcttcatgaaatgtttcccagcagtacatg

SEQ ID NO: 1557 - DNA, 422 bp, Homo sapiens
  CDS 60..422
  misc_feature 42: r=a or g
  misc_feature 49: y=c or t
  misc_feature 74: y=c or t
  misc_feature 370: r=a or g
  misc_feature 406: y=c or t
  UNSURE 104: Xaa=Lys or Arg
  UNSURE 116: Xaa=Ile or Thr
attgctcttatagcctgtgagggaggaagaaacatttgccarccaggcyagtgacagaaatggattcgaaataycagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaraaatcttcaattggattatgttgacctctaccttaytcattttccagtgtct

SEQ ID NO: 1558 - DNA, 387 bp, Homo sapiens
  CDS 71..385
  misc_feature 227: r=a or g
  UNSURE 53: Xaa=Met or Val
atgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacrtggttagtggcaacctggtgaccccccttcctgtgattttaggccatgaggcagccggcatcgtggagagtgttggagaaggggtgactacagtcaaaccaggtacaggattcacactcagggaacacgtgtggttcaccatccaggatttcccagcctg

SEQ ID NO: 1559 - DNA, 520 bp, Homo sapiens
  CDS 75..518
  misc_feature 474: n=a, g, c or t
  misc_feature 476: y=c or t
  misc_feature 477: s=g or c
  UNSURE 134: Xaa=Asp or His or Asn or Tyr
  UNSURE 135: Xaa=Leu or Val
acttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactatnaystcatcttctttttcggaagtgactttgaaaactacataaagac

SEQ ID NO: 1560 - DNA, 557 bp, Homo sapiens
  CDS 134..556
  misc_feature 337: s=g or c
  UNSURE 68: Xaa=Lys or Asn
atctcggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaastgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcaggtctgtatgtgaaatgttctcagatgtttggaaattccacctgcccattaaggaatgtggtgtgg

SEQ ID NO: 1561 - DNA, 396 bp, Homo sapiens
  CDS 123..395
  misc_feature 177: k=g or t
  misc_feature 178: n=a, g, c or t
  misc_feature 198: w=a or t
  UNSURE 19: Xaa=Ala or Cys or Asp or Phe or Gly or Ser or Val or Tyr
  UNSURE 26: Xaa=Cys or Ser
gctggctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctkntgatgattttcaagagagtwgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgg

SEQ ID NO: 1562 - DNA, 328 bp, Homo sapiens
  CDS 55..327
aattacccagcctaaccatttctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggagaatacatctacaaggggaagaaattcaacgctcggaaggagacggtgcagaacgaggtctacctgggcctgcccatcttccgcttttacatcaagtgcacgcgctgcctggcagagatcaccttcaagacag

SEQ ID NO: 1563 - DNA, 350 bp, Homo sapiens
  CDS 131..349
  misc_feature 13: n=a, g, c or t
  misc_feature 314: r=a or g
  misc_feature 343: n=a, g, c or t
  UNSURE 62: Xaa=Met or Val
agtcgtgcgacancgtcacttacggccggagctgtttgtgctgggagctggtggcgcggtgcagggctcttaagaacgaacggcttgggcgcggactggtatccggggactgtgacttgcagggtccgccatggagccagagcagatgctggagggacaaacgcaggttgcagaaaatcctcactctgagtacggtctcacagacaacgttgagagaatagtagaaaatgagaagattaatgcagaaaagtcatcaaagcagaaggtagatctccagtctttgccaactcgtgcctacctggatcagacagttrtgcctatcttattacagggacttgctgtngcttgca

SEQ ID NO: 1564 - DNA, 395 bp, Homo sapiens
  CDS 83..394
aacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaacagctgccccttggtgactataacagcaatgcca

SEQ ID NO: 1565 - DNA, 518 bp, Homo sapiens
  CDS 132..518
  misc_feature 166: y=c or t
  misc_feature 439: r=a or g
  misc_feature 440: k=g or t
  misc_feature 472: n=a, g, c or t
  misc_feature 473: n=a, g, c or t
  misc_feature 474: n=a, g, c or t
  misc_feature 479: n=a, g, c or t
  UNSURE 12: Xaa=Ala or Val
  UNSURE 103: Xaa=Asp or Glu or Gly
  UNSURE 114: Xaa=Ala or Asp or Glu or Gly or Val
  UNSURE 115: Xaa=Phe or Ile or Leu or Val
  UNSURE 116: Xaa=Phe or Leu
aatattctcacagtctgatttgagcataaggcatcagattgaatttgtgaaagctttcaagacagcttttctcctgtgactttgactttcttcattatatttgtggatttttgtttctggaagaatccgtcatgactctactggaacctgagatgttaatgatggyagtacagtcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgrkgacctcaatgagaagattgcacagaggcctgnnnttttngagctggtggagaagaacatccttcctgttgagtccagc

SEQ ID NO: 1566 - DNA, 345 bp, Homo sapiens
  CDS 79..345
  misc_feature 53: s=g or c
gaaagtgtctcttgcgtgcgtgggccggaggttagtgtgcggggcccgccggsggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagag

SEQ ID NO: 1567 - DNA, 351 bp, Homo sapiens
  CDS 117..350
  misc_feature 69: s=g or c
  misc_feature 148: s=g or c
  misc_feature 162: n=a, g, c or t
  misc_feature 165: y=c or t
  misc_feature 167: k=g or t
  misc_feature 168: r=a or g
  UNSURE 11: Xaa=Ala or Gly
  UNSURE 16: Xaa=Asp or His or Asn or Tyr
  UNSURE 17: Xaa=Pro or Ser
  UNSURE 18: Xaa=Glu or Lys
gggtccttgcacgcttcgctccaactcctgcagagctgagccggaggggaatccggaagggacacgctsaacaggaacagaaatgaataaaagtcgctggcagagtagaagacgacatgggagaagaagccaccagcagaacccttgsttcagactccgtgnatyckraagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaacc

SEQ ID NO: 1568 - DNA, 235 bp, Homo sapiens
  CDS 67..234
gaagctcactgagaattatcctgagctgtgttaacaaactgacagaacacagaatttttactcaaaatggattggttaaacgtctttaaagattttttcagcattggaaaagtgaaaagaaaacctagtgtgccagattctgcatctcctgctgatgatagttttgttgacccaggggaacgtctctatgacctcaacatgcccgcttatgtgaaatttaactacatggctgaca

SEQ ID NO: 1569 - DNA, 548 bp, Homo sapiens
  CDS 153..548
  misc_feature 12: s=g or c
  misc_feature 13: s=g or c
  misc_feature 136: s=g or c
  misc_feature 173: w=a or t
  misc_feature 196: m=a or c
  misc_feature 197: m=a or c
  misc_feature 236: m=a or c
  misc_feature 237: m=a or c
  UNSURE 7: Xaa=Asp or Glu
  UNSURE 15: Xaa=Ala or Asp or Glu
  UNSURE 28: Xaa=Asp or Glu
  UNSURE 29: Xaa=Pro or Thr
ctcaagtggaassggatgatgaggccgcattcctggagcgcctggctcggcgtgaggaaagacgccaaaaacgccttcaggaggctctggagcggcagaaggagttcgacccaacaataacagatgcaagtctgtsgctcccaagcagaagaatgcaaaatgacacagcagawaatgaaactaccgagaaggaagmmaaaagtgaaagtcgccaagaaagatacgagatagaggammcagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagag

SEQ ID NO: 1570 - DNA, 492 bp, Homo sapiens
  CDS 175..492
gtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagcaagactctggagatggcgccgtgggatctagac

SEQ ID NO: 1571 - DNA, 523 bp, Homo sapiens
  CDS 26..523
  misc_feature 301: m=a or c
  misc_feature 304: r=a or g
  misc_feature 306: r=a or g
  misc_feature 307: w=a or t
  misc_feature 402: r=a or g
  UNSURE 92: Xaa=Asp or Glu
  UNSURE 94: Xaa=Asp or Glu or Gly
  UNSURE 126: Xaa=His or Arg
caaagaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaagtgaatttcctactgaagcagatctggaagacttcacagaagcagctgtggatgaggatgatgaggatgaggaagaaggggaggaagtggtggaggamcgrgrwtactactatgacaccttcaaaggagatgactacaatgaggagaatcctactgaacccggcagcgacggcaccatgtcagacaaggaaattactcrtgatgtcaaagctgtctgctcccaggaggcgatgacggggccctgccgggccgtgatgcctcgttggtacttcgacctctccaagggaaagtgcgtgcgctttatatatggtggctgcggc

SEQ ID NO: 1572 - DNA, 392 bp, Homo sapiens
  CDS 193..390
  misc_feature 31: y=c or t
  misc_feature 122: m=a or c
  misc_feature 371: n=a, g, c or t
  UNSURE 60: Xaa=Ala or Glu or Gly or Val
gtgagggggcgtggccaagatggccgcgtgygggatcctcgggtaccgggagcgaacgaggaggttctggctcagtgcatccactctgggagagcgtggacctggttcctgggggcgatcgmcagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaacgcagtcaaatttgaaaactttgaggatgcagcactggaagaaaatggtttggctgtgataggagtatttttaaaggnaaattctcagtctcccttgaa

SEQ ID NO: 1573 - DNA, 499 bp, Homo sapiens
  CDS 108..497
  misc_feature 428: k=g or t
  UNSURE 107: Xaa=Lys or Asn
agcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaakcggcggatgcagtacaaccggcgctttgtcaacgttgtgccacctttggcaagaagaagggcccaatgcaa

SEQ ID NO: 1574 - DNA, 468 bp, Homo sapiens
  CDS 184..468
ttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttc

SEQ ID NO: 1575 - DNA, 498 bp, Homo sapiens
  CDS 54..497
  misc_feature 170: w=a or t
  UNSURE 39: Xaa=Asp or Glu
ctctggaacggttgccatggcagcggctgggcgtgctgcttagcaggggaaagatggcggtgacgggctggttggagagtctgcggacagcccagaagactgcgctgctgcaggacgggagaaggaaggttcactatttattcccagacggcaaggaaatggctgaagawtatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagtactacaagaagttctccattcctgatctagatagacacc

SEQ ID NO: 1576 - DNA, 533 bp, Homo sapiens
  CDS 49..531
ttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaa

SEQ ID NO: 1577 - DNA, 560 bp, Homo sapiens
  CDS 297..560
acaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgac

SEQ ID NO: 1578 - DNA, 332 bp, Homo sapiens
  CDS 17..331
  misc_feature 145: k=g or t
  UNSURE 43: Xaa=Ile or Met
aagcgcgaggagaaagatggcggcgatggcggtcgggggtgctggtgggagccgcgtgtccagcgggagggacctgaattgcgtccccgaaatagctgacacactaggggctgtggccaagcaggggtttgatttcctctgcatkcctgtcttccatccgcgtttcaagagggagttcattcaggaacctgctaagaatcggcccggtccccagacacgatcagacctactgctgtcaggaagggactggaatacgctaattgtgggaaagctttctccatggattcgtccagactcaaaagtggagaagattcgcaggaactccgaggcgg

SEQ ID NO: 1579 - DNA, 390 bp, Homo sapiens
  CDS 162..389
  misc_feature 357: r=a or g
  UNSURE 66: Xaa=Glu or Lys
gcgttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtraatgtagagtcattaacaaggagcatgtactgc

SEQ ID NO: 1580 - DNA, 294 bp, Homo sapiens
  CDS 112..294
aaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtgg

SEQ ID NO: 1581 - DNA, 488 bp, Homo sapiens
  CDS 308..487
  misc_feature 254: r=a or g
  misc_feature 420: s=g or c
  misc_feature 458: n=a, g, c or t
  misc_feature 475: r=a or g
  UNSURE 38: Xaa=Cys or Ser
  UNSURE 51: Xaa=Cys or Gly or Arg or Ser
cccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatrgtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggacctacctggaactstgcggggtgctacataaatatatcaagccagggaaaangtgctggtgattgggtrtggcactcagaac

SEQ ID NO: 1582 - DNA, 455 bp, Homo sapiens
  CDS 78..455
  misc_feature 223: r=a or g
  misc_feature 405: r=a or g
  UNSURE 49: Xaa=Glu or Gly
  UNSURE 110: Xaa=Glu or Lys
ggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatggraagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagraaaagaagaaaaagagaaaaatggtgaatgatgctgagcctgatacgaaa

SEQ ID NO: 1583 - DNA, 293 bp, Homo sapiens
  CDS 125..292
  misc_feature 135: w=a or t
  UNSURE 4: Xaa=Lys or Met
atcttggattgcgaactgggtcgctacgcttcacgccaggggcggagtggcggcccttctgttacccgccacacacgtcgccgctggggactgggaaatcagggcatcggagagtgccacattaatggatgccawggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgccca

SEQ ID NO: 1584 - DNA, 399 bp, Homo sapiens
  CDS 89..397
  misc_feature 10: r=a or g
  misc_feature 27: m=a or c
  misc_feature 51: m=a or c
  misc_feature 227: w=a or t
  UNSURE 47: Xaa=Ser or Thr
gaggattgarggaagggaacccgcgcmgccggaaggagccgctcgcttcamggcgctgggacccgggctggaaggcagggcatcagctatggaacaacctgggcaggatcccacctcagacgacgtcatggactcgttcctggaaaagttccagagccagccttaccgtggcggctttcatgaggaccagtgggagaaggaatttgaaaaggtccccctatttatgwcgagagcgccatcagaaattgatcccagggagaatcctgacttggcttgtctccagtcaattatttttgatgaggagcgttctccagaagaacaggccaagacctataaagatgagggcaatgattactttaaagaaaaagactacaagaaagctgtaatttcatacactga

SEQ ID NO: 1585 - DNA, 426 bp, Homo sapiens
  CDS 200..424
gttctcggaggagcgatctgcaggtaggggtgcgcgcgaccgctccccggcgggagccagcgaaggtttccatgtcagaggccgatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgc

SEQ ID NO: 1586 - DNA, 556 bp, Homo sapiens
  CDS 151..555
  misc_feature 455: m=a or c
  misc_feature 463: w=a or t
  misc_feature 464: w=a or t
  misc_feature 556: k=g or t
  UNSURE 102: Xaa=Lys or Thr
  UNSURE 105: Xaa= *  or Lys or Leu or Met
tattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattamagagcccwwgagtgttttccgtactgggcggattagtactagttctatctgggaaaagcccgggttggaagaagctgtggagagtgcgtgtgcaatgcgak

SEQ ID NO: 1587 - DNA, 457 bp, Homo sapiens
  CDS 110..457
agactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcct

SEQ ID NO: 1588 - DNA, 428 bp, Homo sapiens
  CDS 175..426
atcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggcagctccctgaagcactccaccactctcaccaaccggcagcgagggaacgaggtgtcagctctgcc

SEQ ID NO: 1589 - DNA, 290 bp, Homo sapiens
  CDS 114..290
acacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaaccc

SEQ ID NO: 1590 - DNA, 374 bp, Homo sapiens
  CDS 133..372
  misc_feature 205: y=c or t
  misc_feature 208: s=g or c
  misc_feature 329: s=g or c
  UNSURE 25: Xaa=Cys or Arg
  UNSURE 26: Xaa=Gly or Arg
  UNSURE 66: Xaa=Ala or Gly
aagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggcygtsgtcgtggaatgagaagccgtggcagaggtttccagtttgtttcctcgtctcttccagatatttgttatcgctgtggtgagtctggtcatcttgccaaggattgtgatcttcaggaggatgstaagtatttaacacttccttttcatacccctctagagcttggaga

SEQ ID NO: 1591 - DNA, 697 bp, Homo sapiens
  CDS 488..697
  misc_feature 194: n=a, g, c or t
  misc_feature 200: k=g or t
  misc_feature 308: n=a, g, c or t
  misc_feature 309: n=a, g, c or t
  misc_feature 358: k=g or t
  misc_feature 360: m=a or c
  misc_feature 362: y=c or t
  misc_feature 563: s=g or c
  UNSURE 26: Xaa=Gly or Arg
aagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctantggtgkcggccgtggtcgtggaatgagaagccgtggcagaggtggttttacctcggatagaggtttccagtttgtttcctcgtctcttccagatatttgttatcgctgtggtgnngtctggtcatcttgccaaggattgtgatcttcaggaggatgcctgctakamcygcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtsgtcgtggaatgagaagccgtggcagaggtttccagtttgtttcctcgtctcttccagatatttgttatcgctgtggtgagtctggtcatcttgccaaggattgtgatcttcaggaggatgctgctataactgcg

SEQ ID NO: 1592 - DNA, 439 bp, Homo sapiens
  CDS 233..439
  misc_feature 12: n=a, g, c or t
  misc_feature 13: w=a or t
  misc_feature 14: m=a or c
  misc_feature 15: r=a or g
  misc_feature 25: s=g or c
attcgaaccccnwmrcgcccctttstgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactact

SEQ ID NO: 1593 - DNA, 530 bp, Homo sapiens
  CDS 128..529
  misc_feature 137: m=a or c
  misc_feature 151: r=a or g
  misc_feature 162: y=c or t
  misc_feature 329: n=a, g, c or t
  misc_feature 330: n=a, g, c or t
  misc_feature 332: w=a or t
  misc_feature 351: s=g or c
  misc_feature 352: k=g or t
  misc_feature 353: r=a or g
  misc_feature 369: r=a or g
  misc_feature 385: n=a, g, c or t
  misc_feature 386: n=a, g, c or t
  UNSURE 12: Xaa=Leu or Pro
  UNSURE 68: Xaa= *  or Ala or Glu or Gly or Ile or Lys or Leu or Pro or Gln or Arg or Ser or Thr or Val
  UNSURE 69: Xaa=Cys or Ser
  UNSURE 75: Xaa=Pro or Arg
  UNSURE 76: Xaa=Ile or Val
  UNSURE 81: Xaa=Lys or Arg
  UNSURE 87: Xaa=Ala or Pro or Ser or Thr
acttccggccagggagggggataggctcagacacaaggagaggcttggagagagcagacgccttctggattcaagaagacgaggcccattcccctcaggctcacctgttactcggcctcccagaaagatggataggmgaaatgactacggrtatagggtgcytctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagnnawgcaagaccaagaaggcccskrtaaagactattactarggctgcacctgctgcnnctccagtcccagctgccaatgagattgccaccaacaagcccaaaataacttggcaggctttaaacctgccagtcattacccagatcagccaggctttacctaccactgaggtaaccaatactcaggcttcttcagtcactgctc

SEQ ID NO: 1594 - DNA, 818 bp, Homo sapiens
  CDS 113..817
  misc_feature 320: y=c or t
  misc_feature 400: y=c or t
  misc_feature 425: m=a or c
  misc_feature 439: r=a or g
  misc_feature 450: y=c or t
  misc_feature 617: n=a, g, c or t
  misc_feature 618: n=a, g, c or t
  misc_feature 620: w=a or t
  misc_feature 639: s=g or c
  misc_feature 640: k=g or t
  misc_feature 641: r=a or g
  misc_feature 657: r=a or g
  misc_feature 673: n=a, g, c or t
  misc_feature 674: n=a, g, c or t
  UNSURE 70: Xaa=His or Tyr
  UNSURE 113: Xaa=Leu or Pro
  UNSURE 169: Xaa= *  or Ala or Glu or Gly or Ile or Lys or Leu or Pro or Gln or Arg or Ser or Thr or Val
  UNSURE 170: Xaa=Cys or Ser
  UNSURE 176: Xaa=Pro or Arg
  UNSURE 177: Xaa=Ile or Val
  UNSURE 182: Xaa=Lys or Arg
  UNSURE 188: Xaa=Ala or Pro or Ser or Thr
acttccggccagggagggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagayacaaggagaggcttggagagagcagacgccttctggattcaagaagacgaggcccattcccctcaggctcacctgttacycggcctcccagaaagatggataggmgaaatgactacggrtatagggtgcytctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagnnawgcaagaccaagaaggcccskrtaaagactattactarggctgcacctgctgcnnctccagtcccagctgccaatgagattgccaccaacaagcccaaaataacttggcaggctttaaacctgccagtcattacccagatcagccaggctttacctaccactgaggtaaccaatactcaggcttcttcagtcactgctc

SEQ ID NO: 1595 - DNA, 408 bp, Homo sapiens
  CDS 154..408
tagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactacc

SEQ ID NO: 1596 - DNA, 481 bp, Homo sapiens
  CDS 126..479
  misc_feature 235: y=c or t
  misc_feature 428: s=g or c
  misc_feature 450: m=a or c
  UNSURE 37: Xaa=Ile or Thr
  UNSURE 101: Xaa=Asp or Glu
  UNSURE 109: Xaa=Pro or Thr
cgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcayactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgascagaggtttcgattcccttcamccatcttaaaagtccaatatcatccacgaga

SEQ ID NO: 1597 - DNA, 222 bp, Homo sapiens
  CDS 30..221
  misc_feature 200: k=g or t
  UNSURE 57: Xaa=Asp or Glu
agtgacccaagccccagcttcgcgcagggatggagccggaagaggggacgcccttgtggcggctgcagaagctgccggccgagctgggcccgcagcttcttcacaaaataattgatggcatttgtggtcgagcttatcctgtgtaccaagattatcacactgtttgggaatcagaagaatggatgcacgttttagaagakattgccaaatttttcaaagcca

SEQ ID NO: 1598 - DNA, 298 bp, Homo sapiens
  CDS 23..298
agtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcaccta

SEQ ID NO: 1599 - DNA, 454 bp, Homo sapiens
  CDS 15..452
  misc_feature 8: s=g or c
gaaaagasttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgt

SEQ ID NO: 1600 - DNA, 370 bp, Homo sapiens
  CDS 52..369
gcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcg

SEQ ID NO: 1601 - DNA, 470 bp, Homo sapiens
  CDS 109..468
  misc_feature 252: s=g or c
  misc_feature 435: m=a or c
  misc_feature 442: m=a or c
  misc_feature 451: r=a or g
  UNSURE 48: Xaa=Arg or Ser
  UNSURE 112: Xaa=Lys or Gln
  UNSURE 115: Xaa=Gly or Ser
accccccccaacctgtgcagctgaggacttcccctccgtggtgacagcctctgggtcctcggtcggtacagtctctgcacctcgcgccccagcaggtaaactaacattatggatttttccaagctacccaaaatactcgatgaagataaagaaagcacatttggttatgtgcatggggtctcaggacctgtggttacagcctgtgacatggcgggtgcagccatgtatgagctggtgagagtgggccacagsgaattggttggagagattattcgattggagggtgacatggctactattcaggtgtatgaagaaacttctggtgtgtctgttggagatcctgtacttcgcactggtaaacccctctctgtagagcttggtcctggcattatgggagccatttttgatggtattcaaagacctttgtcggatatmagcagtmagacccaargcatctacatccccagagg

SEQ ID NO: 1602 - DNA, 513 bp, Homo sapiens
  CDS 58..513
tatggctgtgtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtg

SEQ ID NO: 1603 - DNA, 377 bp, Homo sapiens
  CDS 205..375
  misc_feature 335: m=a or c
  misc_feature 337: m=a or c
  UNSURE 44: Xaa=Ala or Asp
  UNSURE 45: Xaa=Lys or Gln
cccgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccccccaccagctcggctttggactgtgtcctcagctccttccagatgaccaacgagacggtcaacatctggactcacttcctgcccacctggtgaggggaggctccgmcmaggccgcggccttgagctcagagggggtaccaggcgggca

SEQ ID NO: 1604 - DNA, 403 bp, Homo sapiens
  CDS 141..401
  misc_feature 287: w=a or t
  misc_feature 362: w=a or t
cccgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacwgtcaacatctggactcacttcctgcccacctgtttcctggagctggaaagccctgggctcagtaagagtcctccwgcacaggagccttcgcctatccaattcctgttcgacaacct

SEQ ID NO: 1605 - DNA, 419 bp, Homo sapiens
  CDS 247..417
  misc_feature 377: m=a or c
  misc_feature 379: m=a or c
  UNSURE 44: Xaa=Ala or Asp
  UNSURE 45: Xaa=Lys or Gln
cccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccccccaccagctcggctttggactgtgtcctcagctccttccagatgaccaacgagacggtcaacatctggactcacttcctgcccacctggtgaggggaggctccgmcmaggccgcggccttgagctcagagggggtaccaggcgggca

SEQ ID NO: 1606 - DNA, 445 bp, Homo sapiens
  CDS 183..443
  misc_feature 329: w=a or t
  misc_feature 404: w=a or t
cccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacwgtcaacatctggactcacttcctgcccacctgtttcctggagctggaaagccctgggctcagtaagagtcctccwgcacaggagccttcgcctatccaattcctgttcgacaacct

SEQ ID NO: 1607 - DNA, 354 bp, Homo sapiens
  CDS 58..354
  misc_feature 237: n=a, g, c or t
  misc_feature 343: n=a, g, c or t
  misc_feature 344: k=g or t
  misc_feature 348: n=a, g, c or t
  misc_feature 349: n=a, g, c or t
  UNSURE 60: Xaa=Lys or Asn
  UNSURE 96: Xaa=Cys or Phe or Gly or Ile or Leu or Arg or Ser or Val
  UNSURE 97: Xaa=Ile or Met
  UNSURE 98: Xaa= *  or Glu or Lys or Gln
ataggtcccggcccgagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaantactttgtgaaatttaaagttggagaagaatttgatgaagataacagaggcctggacaacagaaaatgcaagagtttggttatctgggacaatgacaggctcaccnktatnnagaag

SEQ ID NO: 1608 - DNA, 371 bp, Homo sapiens
  CDS 134..370
aacaacccggcggtcgacgcttagcggaagttcgtcaagtcgcagttgcccccgcacagcggatgtgggtcgcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctg

SEQ ID NO: 1609 - DNA, 425 bp, Homo sapiens
  CDS 223..423
  misc_feature 373: s=g or c
  UNSURE 51: Xaa=Glu or Gln
agagaatccaagatagatcaactctccctaaaggctgacagtgaactcttggggccgttttattctctgcaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaaagacaccccaatccatttasagaaaagaatacatccccttcccagaccacagaccagaccagatctccaggt

SEQ ID NO: 1610 - DNA, 441 bp, Homo sapiens
  CDS 260..439
  misc_feature 313: y=c or t
  misc_feature 405: n=a, g, c or t
  misc_feature 406: r=a or g
  misc_feature 414: r=a or g
  UNSURE 49: Xaa=Ile or Lys or Met or Arg or Thr
  UNSURE 52: Xaa=Asp or Gly
taatctctgcggcagtcttctgtcggaagtgacgttgctatcccagaatcctcagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaaygagaagaaacttcaagaggttgatagtttatggaaagaatttgaaactccagagaaagcaaacaaaatagtaaagctaaaacattttgaganrtttcaggrtacagcagaagcattagcagcatcaca

SEQ ID NO: 1611 - DNA, 387 bp, Homo sapiens
  CDS 59..385
gccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggccaccaccaaccccaatgcatccaaatttgcc

SEQ ID NO: 1612 - DNA, 274 bp, Homo sapiens
  CDS 116..274
ccatacgaaagataggtttgagaccaagactgggtggagggaggtcggtgaagatgttacagaatactcagcagaagatgttgaagggcttcaagtaggtgagtagtgggtagagatggagataggagaccattttcaaaatatattaaggagtccattgagtagacaggggggactgagagaaatcagggatgacttccagttttctggcttggaaaatggtgttactagccaatttaggttttggagggaagatgtttggttttggacatgc

SEQ ID NO: 1613 - DNA, 295 bp, Homo sapiens
  CDS 63..293
tcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcacc

SEQ ID NO: 1614 - DNA, 532 bp, Homo sapiens
  CDS 273..530
  misc_feature 129: n=a, g, c or t
  misc_feature 130: h=a or c or t
  misc_feature 376: b=c or g or t
  misc_feature 459: n=a, g, c or t
  misc_feature 460: n=a, g, c or t
  UNSURE 35: Xaa=Ala or Gly or Val
  UNSURE 63: Xaa= *  or Ala or Glu or Gly or Ile or Lys or Leu or Pro or Gln or Arg or Ser or Thr or Val
accgcctgcgccgcggcgagtgaggcgtcgtccgtactggaggctagctcttgtcgcggccgcggcgagttaacatcgtttttccaatctgtccgcggctgccgccacccaagacagagccagaatgtnhaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatgbtgaagattctttgactcatacagatgtcagctctttccagacaatggaccaaatggtgtcaaatatgagaaactatatgcagnnattagaaagaaacttcggtcaactttcagtggatccaaatggacattcattttgttcttcctcagttatgac

SEQ ID NO: 1615 - DNA, 583 bp, Homo sapiens
  CDS 324..581
  misc_feature 56: s=g or c
  misc_feature 180: n=a, g, c or t
  misc_feature 181: h=a or c or t
  misc_feature 427: b=c or g or t
  misc_feature 510: n=a, g, c or t
  misc_feature 511: n=a, g, c or t
  UNSURE 35: Xaa=Ala or Gly or Val
  UNSURE 63: Xaa= *  or Ala or Glu or Gly or Ile or Lys or Leu or Pro or Gln or Arg or Ser or Thr or Val
aatgtccaatgggaaagcagctcggtgtcacgcacctcctatcccggcgggcaccsctacgccgcggcgagtgaggcgtcgtccgtactggaggctagctcttgtcgcggccgcggcgagttaacatcgtttttccaatctgtccgcggctgccgccacccaagacagagccagaatgtnhaggatgctgaacagcagttttgaggatgaccccttcttctcacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatgbtgaagattctttgactcatacagatgtcagctctttccagacaatggaccaaatggtgtcaaatatgagaaactatatgcagnnattagaaagaaacttcggtcaactttcagtggatccaaatggacattcattttgttcttcctcagttatgac

SEQ ID NO: 1616 - DNA, 459 bp, Homo sapiens
  CDS 125..457
  misc_feature 303: b=c or g or t
  misc_feature 386: n=a, g, c or t
  misc_feature 387: n=a, g, c or t
  UNSURE 60: Xaa=Ala or Gly or Val
  UNSURE 88: Xaa= *  or Ala or Glu or Gly or Ile or Lys or Leu or Pro or Gln or Arg or Ser or Thr or Val
accgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctctgagtccattcttgcacaccgagaaaatatgcgacagatgataagaagtttttctgaaccctttggaagagacttgctcagtatctctgatggtagagggagagctcataatcgtagaggacataatgatgbtgaagattctttgactcatacagatgtcagctctttccagacaatggaccaaatggtgtcaaatatgagaaactatatgcagnnattagaaagaaacttcggtcaactttcagtggatccaaatggacattcattttgttcttcctcagttatgac

SEQ ID NO: 1617 - DNA, 553 bp, Homo sapiens
  CDS 294..551
  misc_feature 56: s=g or c
  misc_feature 114: s=g or c
  misc_feature 121: w=a or t
  misc_feature 129: w=a or t
  misc_feature 170: s=g or c
  misc_feature 191: r=a or g
  misc_feature 192: s=g or c
  misc_feature 271: n=a, g, c or t
  misc_feature 347: w=a or t
  misc_feature 361: k=g or t
  misc_feature 397: b=c or g or t
  misc_feature 480: n=a, g, c or t
  misc_feature 481: n=a, g, c or t
  UNSURE 18: Xaa=Arg or Ser
  UNSURE 23: Xaa=Ile or Arg
  UNSURE 35: Xaa=Ala or Gly or Val
  UNSURE 63: Xaa= *  or Ala or Glu or Gly or Ile or Lys or Leu or Pro or Gln or Arg or Ser or Thr or Val
aatgtccaatgggaaagcagctcggtgtcacgcacctcctatcccggcgggcaccsctacgccgcggcgagtgaggcgtcgtccgtactggaggctagctcttgtcgcggccgsgcgagtwaacatcgwttttccaatctgtccgcggctgccgccacccaagacagagscagaatgttcaggatgctgarsagcagttttgaggatgaccccttcttctcgtgagttacgggagccaggagtccggggtcgcgcgggaattaagtgagtncattcttgcacaccgagaaaatatgcgacagatgataagaagtttttctgaaccctttggaagagacttgctcagwatctctgatggtakagggagagctcataatcgtagaggacataatgatgbtgaagattctttgactcatacagatgtcagctctttccagacaatggaccaaatggtgtcaaatatgagaaactatatgcagnnattagaaagaaacttcggtcaactttcagtggatccaaatggacattcattttgttcttcctcagttatgac

SEQ ID NO: 1618 - DNA, 449 bp, Homo sapiens
  CDS 26..448
atcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatact

SEQ ID NO: 1619 - DNA, 561 bp, Homo sapiens
  CDS 121..561
  misc_feature 10: r=a or g
  misc_feature 11: s=g or c
  misc_feature 533: w=a or t
  UNSURE 138: Xaa=Ile or Asn
actctcgcgrsatccctactggctataaaggcagctccccggagagctcttgcgcgtcttgttcttgcctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaaggcatctcgttcaggggcctttttatcattgatgataagggtawtcttcggcagatcactgtaaatgacctc

SEQ ID NO: 1620 - DNA, 474 bp, Homo sapiens
  CDS 15..473
  misc_feature 435: n=a, g, c or t
  UNSURE 141: Xaa= *  or Glu or Lys or Gln
aaaaaatattcaaaatggcggacggaggagcagcgagtcaagatgagagttcagccgcggcggcagcagcagcagactcaagaatgaacaatccgtcagaaaccagtaaaccatctatggagagtggagatggcaacacaggcacacaaaccaatggtctggactttcagaagcagcctgtgcctgtaggaggagcaatctcaacagcccaggcgcaggctttccttggacatctccatcaggtccaactcgctggaacaagtttacaggctgctgctcagtctttaaatgtacagtctaaatctaatgaagaatcgggggattcgcagcagccaagccagccttcccagcagccttcagtgcaggcagccattccccagacccagcttatgctagctggaggacagataactgggcttactttgacgcctgccnagcaacagttactactccagcaggcacaggcacaggcac

SEQ ID NO: 1621 - DNA, 450 bp, Homo sapiens
  CDS 115..450
  misc_feature 230: k=g or t
  UNSURE 39: Xaa=Leu or Arg
aaggctggagaaggaaaagccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgckggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactct

SEQ ID NO: 1622 - DNA, 491 bp, Homo sapiens
  CDS 118..489
  misc_feature 97: s=g or c
  misc_feature 265: r=a or g
  misc_feature 347: n=a, g, c or t
  misc_feature 348: n=a, g, c or t
  misc_feature 388: n=a, g, c or t
  misc_feature 390: m=a or c
  UNSURE 50: Xaa=Asp or Asn
  UNSURE 77: Xaa= *  or Cys or Phe or Leu or Ser or Trp or Tyr
  UNSURE 91: Xaa= *  or Cys or Gly or Arg or Ser
agcagcggcggctcctgcagcggtggtcggctgttgggtgtggagtttcccagcgcccctcgggtccgaccctttgagcgttctgctccggcgccasctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctratatctttgggacacctgaagaaaatcaagcttcttgggccaagtcagcaggtgccaagtctagtggtggcagggaagactnngagtcatctggactgcagagaaggaactcctctgaagcangmtccggagacttcttagatctgaagggagaaggtgatattcatgaaaatgtggacacagacttgccaggcagcctggggcagagtgaagagaagccgtgcct

SEQ ID NO: 1623 - DNA, 414 bp, Homo sapiens
  CDS 175..414
  misc_feature 147: r=a or g
  misc_feature 348: k=g or t
  misc_feature 359: r=a or g
  UNSURE 62: Xaa= *  or Trp
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtrcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcktctctggcttrgctgactgaggaggagccagaaccagcagaggtcacaagcacctcccagagccct

SEQ ID NO: 1624 - DNA, 464 bp, Homo sapiens
  CDS 169..462
  misc_feature 388: n=a, g, c or t
  misc_feature 412: m=a or c
  misc_feature 413: w=a or t
  misc_feature 426: m=a or c
  UNSURE 74: Xaa= *  or Glu or Lys or Gln
  UNSURE 82: Xaa=His or Ile or Leu or Asn
caggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcgnagatcccgctccctcctattctgmwcggcaggctgggmtccgacccacagaagaagaccgtgtgcatttacgggca

SEQ ID NO: 1625 - DNA, 409 bp, Homo sapiens
  CDS 114..407
  misc_feature 333: n=a, g, c or t
  misc_feature 357: m=a or c
  misc_feature 358: w=a or t
  misc_feature 371: m=a or c
  UNSURE 74: Xaa= *  or Glu or Lys or Gln
  UNSURE 82: Xaa=His or Ile or Leu or Asn
caggacacgtggtacggaaccggcgccgcgcttgctgctggtaacagggccttgcctagtgggccttccttcccagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcgnagatcccgctccctcctattctgmwcggcaggctgggmtccgacccacagaagaagaccgtgtgcatttacgggca

SEQ ID NO: 1626 - DNA, 331 bp, Homo sapiens
  CDS 94..330
  misc_feature 39: y=c or t
agaagttaggggctgcagcggcgctggctttaggtgaaygacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtg

SEQ ID NO: 1627 - DNA, 371 bp, Homo sapiens
  CDS 49..369
  misc_feature 333: n=a, g, c or t
  UNSURE 95: Xaa=Lys or Asn
gatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaangttaaatttccatcacaggagaaagaaatcaagtcaaa

SEQ ID NO: 1628 - DNA, 279 bp, Homo sapiens
  CDS 113..277
agagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccgggtaggtactgggcaccacctctctcgcctgctgagtgccttgctttccatgacatt

SEQ ID NO: 1629 - DNA, 542 bp, Homo sapiens
  CDS 130..540
gcccctttcaggcctagcaggaaacgaagcggctctttccgctatctgccgcttgtccaccggaagcgagttgcgacacggcaggttcccgcccggaagaagcgaccaaagcgcctgaggaccggcaacatggtgcggtcggggaataaggcagctgttgtgctgtgtatggacgtgggctttaccatgagtaactccattcctggtatagaatccccatttgaacaagcaaagaaggtgataaccatgtttgtacagcgacaggtgtttgctgagaacaaggatgagattgctttagtcctgtttggtacagatggcactgacaatcccctttctggtggggatcagtatcagaacatcacagtgcacagacatctgatgctaccagattttgatttgctggaggacattgaaagcaaaatccaaccaggttctcaacaggctgacttcctggatgcactaatcgtgagcatggatgtgattcaacatgaaacaataggaaagaagtttgagaagaggcatattgaaatattcactgacct

SEQ ID NO: 1630 - DNA, 431 bp, Homo sapiens
  CDS 44..430
  misc_feature 310: k=g or t
  UNSURE 89: Xaa=Ile or Met
ctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatkcttggagagaatgaagatgatgaggaggaagaggaagaagaggaggaggaggaggaggaggaagaaacacctgagcaacccactgcgggcgatgtatttgtattggagatggttctcaatc

SEQ ID NO: 1631 - DNA, 387 bp, Homo sapiens
  CDS 137..385
  misc_feature 266: n=a, g, c or t
  misc_feature 356: n=a, g, c or t
  UNSURE 44: Xaa=Leu or Met or Val
  UNSURE 74: Xaa=Ala or Pro or Ser or Thr
atgtgctgaaaatcgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccantggttgtggaacccatctctgatgaagactggtatctgttctgtggggacacggtggagatcctagaaggcaaggatgccgggaagcagncaaagtggttcaagttatccggcagcgaaac

SEQ ID NO: 1632 - DNA, 401 bp, Homo sapiens
  CDS 63..401
gcagtccgcgcgggttctcgcacgcagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacacccccc

SEQ ID NO: 1633 - DNA, 473 bp, Homo sapiens
  CDS 148..471
atttgaaaaacctcacctactctcgcgggtcctcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaa

SEQ ID NO: 1634 - DNA, 557 bp, Homo sapiens
  CDS 148..555
atttgaaaaacctcacctactctcgcgggtcctcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcccatttcaatggaaaatccttataaagaacctcttaagaaatgtatcttgtgtggaaagcatgtagattataagaatgtacagcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaa

SEQ ID NO: 1635 - DNA, 281 bp, Homo sapiens
  CDS 34..279
  misc_feature 251: w=a or t
  misc_feature 261: k=g or t
  UNSURE 73: Xaa=Lys or Met
  UNSURE 76: Xaa=Asp or Glu
agcgggcggcgaaggcggcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagawgaggtatgakaagcagctggcgcagatcga

SEQ ID NO: 1636 - DNA, 380 bp, Homo sapiens
  CDS 60..380
  misc_feature 12: s=g or c
acgacgcgccgsaaagcaacggcaagggccgcagccagcaccgggcggagagggctaccatggggaaaatcgcgctgcaactcaaagccacgctggagaacatcaccaacctccggcccgtgggcgaggacttccggtggtacctgaagatgaaatgtggcaactgtggtgagatttcggacaagtggcagtacatccggctgatggacagtgtggcactgaaggggggccgtggcagtgcttccatggtccagaagtgcaagctgtgtgcaagagaaaattccatcgagattttaagcagcaccatcaagccttacaatgctgaagacaatgagaacttcaagacaatagtggagtttgagtgccggggcacgggggat

SEQ ID NO: 1637 - DNA, 506 bp, Homo sapiens
  CDS 190..504
  misc_feature 401: n=a, g, c or t
  misc_feature 437: y=c or t
  misc_feature 449: n=a, g, c or t
  misc_feature 468: y=c or t
  UNSURE 71: Xaa=Ile or Asn or Ser or Thr
  UNSURE 83: Xaa=Ile or Thr
  UNSURE 87: Xaa=Lys or Met or Arg or Thr
gcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgancccctgcattgggggtgtcatcctcttccatgagayactctaccaganggcggatgatgggcgtccyttcccccaagttatcaaatccaagggcggtgttgtggg

SEQ ID NO: 1638 - DNA, 521 bp, Homo sapiens
  CDS 205..519
  misc_feature 483: n=a, g, c or t
accacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtccnttcccccaagttatcaaatccaagggcggtgttgtggg

SEQ ID NO: 1639 - DNA, 557 bp, Homo sapiens
  CDS 241..555
  misc_feature 46: m=a or c
  misc_feature 113: s=g or c
  misc_feature 519: y=c or t
aaaccagggctccagagaatcagaacagccaccatcaccgcaggamgtcaagggaggagggagattagagaaggagccagggagggtggcagggaggccacgtgatccgagtsccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtccyttcccccaagttatcaaatccaagggcggtgttgtggg

SEQ ID NO: 1640 - DNA, 573 bp, Homo sapiens
  CDS 257..571
  misc_feature 468: n=a, g, c or t
  misc_feature 504: y=c or t
  misc_feature 516: n=a, g, c or t
  misc_feature 535: y=c or t
  UNSURE 71: Xaa=Ile or Asn or Ser or Thr
  UNSURE 83: Xaa=Ile or Thr
  UNSURE 87: Xaa=Lys or Met or Arg or Thr
accacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccgcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgancccctgcattgggggtgtcatcctcttccatgagayactctaccaganggcggatgatgggcgtccyttcccccaagttatcaaatccaagggcggtgttgtggg

SEQ ID NO: 1641 - DNA, 609 bp, Homo sapiens
  CDS 293..607
  misc_feature 46: m=a or c
  misc_feature 113: s=g or c
  misc_feature 504: n=a, g, c or t
  misc_feature 540: y=c or t
  misc_feature 552: n=a, g, c or t
  misc_feature 571: y=c or t
  UNSURE 71: Xaa=Ile or Asn or Ser or Thr
  UNSURE 83: Xaa=Ile or Thr
  UNSURE 87: Xaa=Lys or Met or Arg or Thr
aaaccagggctccagagaatcagaacagccaccatcaccgcaggamgtcaagggaggagggagattagagaaggagccagggagggtggcagggaggccacgtgatccgagtsccctcacccctttccttcccacaggtccctggccaaagatttatttctcttgacaaccaagggcctccgtctggatttccaaggaagaatttcctctgaagcaccgcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgancccctgcattgggggtgtcatcctcttccatgagayactctaccaganggcggatgatgggcgtccyttcccccaagttatcaaatccaagggcggtgttgtggg

SEQ ID NO: 1642 - DNA, 395 bp, Homo sapiens
  CDS 111..395
gatatttgctgcgacccgcagcgctatccgctgccgggttctggcgcgccctttcagttctgcttgctgtccgcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagca

SEQ ID NO: 1643 - DNA, 503 bp, Homo sapiens
  CDS 346..501
  misc_feature 383: s=g or c
  UNSURE 13: Xaa=Ser or Thr
aaggacgcgtcccgagggcgggtggcagccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacaggcascatcctggagtacctcaccgcagaggtacttgaactggcaggaaatgcatcaaaagacttaaaggtaaagcgtattacccctcgtcacttgcaacttgctattcgtggagatgaagaatt

SEQ ID NO: 1644 - DNA, 471 bp, Homo sapiens
  CDS 77..469
  misc_feature 469: y=c or t
acttagaatcggcaaatcatagagagaagctaaatgctctcagctgcactataccaaatcaaagctgagatgaataatgaacttaattttccataaagacattctgtttggcattccagctaataaggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaatctccaatgaacactcacccaaactccagatccggagtcatagttacctgagggcagtgagtgaagtctccatcaaccggagcctggacagcctggacctgcagcttgctcacatcaccaaagtycg

SEQ ID NO: 1645 - DNA, 295 bp, Homo sapiens
  CDS 64..294
aaaaaactgtttaattctcagttgagatgtggttggctcttatacatttggaataaagcatttatggcacatctcagggttccacaagatgaatggacagggtacaccccacgaggtaaagatgatgaaattccatgccgaagaatgcggagtggcagttatatcaaggccatgggggatgaagacagtggagactcagacacgagtcctaagccttctccaaaagttgctgcgcggagagaaagctatctcaaggctactcagccatcccttacagaactcaccacactcaaaa

SEQ ID NO: 1646 - DNA, 457 bp, Homo sapiens
  CDS 228..455
  misc_feature 40: w=a or t
  misc_feature 53: n=a, g, c or t
  misc_feature 54: n=a, g, c or t
  misc_feature 77: k=g or t
  misc_feature 398: n=a, g, c or t
  misc_feature 399: n=a, g, c or t
  UNSURE 58: Xaa= *  or Glu or Lys or Gln
attttccggtgggggcgccgcgcccagtgagggcccggawgtgggtcgcgcgnngattgctgggcggttcttgccgkaagcggagagcggctgatcgcagtccggaggtgaggcggaactctgagcgtggtccattatggctgacatgcaaaatctggtagaaagattggagagggcagtgggccgcctggaggcagtatctcatacctctgacatgcaccgtgggtatgcagacagtccttcaaaagcgagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggtnnagcttctcagtgtcaacagccagcagaaaataagctttccgatttgttggcacccatc

SEQ ID NO: 1647 - DNA, 441 bp, Homo sapiens
  CDS 119..439
  misc_feature 40: w=a or t
  misc_feature 53: n=a, g, c or t
  misc_feature 54: n=a, g, c or t
  misc_feature 382: n=a, g, c or t
  misc_feature 383: n=a, g, c or t
  UNSURE 89: Xaa= *  or Glu or Lys or Gln
attttccggtgggggcgccgcgcccagtgagggcccggawgtgggtcgcgcgnngattgctgggcggttcttgccggaagcggagagcggctgatcgcagtccggagcgtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggtnnagcttctcagtgtcaacagccagcagaaaataagctttccgatttgttggcacccatc

SEQ ID NO: 1648 - DNA, 549 bp, Homo sapiens
  CDS 114..548
gccttttctcgctaacaccgctcgccctctccgagtcagttccgcggtagaggtgacctgactctctgaggctcattttgcagttgttgaaattgtccccgcagttttcaatcatgtctgaaccaatcagagtccttgtgactggagcagctggtcaaattgcatattcactgctgtacagtattggaaatggatctgtctttggtaaagatcagcctataattcttgtgctgttggatatcacccccatgatgggtgtcctggacggtgtcctaatggaactgcaagactgtgcccttcccctcctgaaagatgtcatcgcaacagataaagaagacgttgccttcaaagacctggatgtggccattcttgtgggctccatgccaagaagggaaggcatggagagaaaagatttactgaaagcaaatgtgaaaatcttcaaatcccagggtgcagccttagataaatacgccaagaagtcagttaaggttattgttgtgggtaatccagccaataccaactgcctgactgcttccaagtcagctccat

SEQ ID NO: 1649 - DNA, 416 bp, Homo sapiens
  CDS 140..415
agagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcc

SEQ ID NO: 1650 - DNA, 378 bp, Homo sapiens
  CDS 61..378
gttccgaggcgccgccgggagctgccacgtccgagacctggagcagccaccgccgcaatcatggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtg

SEQ ID NO: 1651 - DNA, 274 bp, Homo sapiens
  CDS 108..272
  misc_feature 18: s=g or c
  misc_feature 43: k=g or t
  misc_feature 45: s=g or c
  misc_feature 52: r=a or g
  misc_feature 54: k=g or t
  misc_feature 60: r=a or g
  misc_feature 62: y=c or t
  misc_feature 128: r=a or g
gcgggtcccggtagcgcsaggcggtgcagggcgggaaggggaktsgtggcgrckgcggcrgyagggacagcaggagcagtggtgctgtcagcgcggccgtcggagacatgggagacccggggtcggarataatagaatctgtccctccagctggccctgaggcatctgagtcaacaacggatgaaaatgaagacgacattcagtttgtcagtgaaggaccatcgagacctgttcttgaatacatcgatctggtctgtggtgatgatgaaaaccc

SEQ ID NO: 1652 - DNA, 219 bp, Homo sapiens
  CDS 45..218
atcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagca

SEQ ID NO: 1653 - DNA, 402 bp, Homo sapiens
  CDS 90..401
  misc_feature 354: w=a or t
  misc_feature 355: r=a or g
  UNSURE 89: Xaa=Cys or Asn or Ser or Tyr
gttttttcctccaggctaagtccatcttccggcttgggcagacgctgccgcggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgcwrtactggagcacttgaagttaaaaggaaagagcttttgaaatacttga

SEQ ID NO: 1654 - DNA, 412 bp, Homo sapiens
  CDS 224..412
aagtcaggtggttgtcggattttagaggaaggcgctcggttacattggagaactggagtggtctggagttccacggtgtagtggaccagaggccacctctcctgggcttctcagtgtctcgccggcggggttcggcctgagctggattgacatagcccttggcggatttaaacaacctaaacattaagcagtacagctgcctcaaacctttgggattttcagaatgactgacactgccgaagctgttccaaagtttgaagagatgtttgctagtagattcacagaaaatgacaaggagtatcaggaatacctgaaacgccctcctgagtctcctccaattgttgaggaatggaatagcagagctggtgggaacaaagaaacagaggcaatcggttgcaagacaacagacagt

SEQ ID NO: 1655 - DNA, 530 bp, Homo sapiens
  CDS 80..529
  misc_feature 389: n=a, g, c or t
  misc_feature 390: n=a, g, c or t
  UNSURE 104: Xaa= *  or Ala or Glu or Gly or Ile or Lys or Leu or Pro or Gln or Arg or Ser or Thr or Val
agactgtgcggtcacttccggcccgggagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagagnnagatgatgttgagggcaaaattagacaaatcattccacctggattttgcacaaacacgaatgatttcctttctttactggaaaaggaagttgatttcaagccattcggaaccttacttcatacctactcagttctcagtc

SEQ ID NO: 1656 - DNA, 513 bp, Homo sapiens
  CDS 171..512
  misc_feature 14: s=g or c
  misc_feature 507: k=g or t
  UNSURE 113: Xaa= *  or Gly
gcggcccagcgcasctcggcgtttccgccatgcgcctgcagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagakgaagag

SEQ ID NO: 1657 - DNA, 454 bp, Homo sapiens
  CDS 56..454
agagggaaagcgagagggagacggacgttgagagaacgaggaggaaggagagaaaatggcgtccacggattacagtacctatagccaagctgcagcgcacagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagcca

SEQ ID NO: 1658 - DNA, 338 bp, Homo sapiens
  CDS 155..337
  misc_feature 266: r=a or g
  misc_feature 276: r=a or g
  UNSURE 38: Xaa=Asp or Asn
  UNSURE 41: Xaa=Asn or Ser
aagagactctccgaggcggcggcagagacagaagagcggggtcggggccggctgaccaggaacctgggcgagcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagratgaaataartggaaattggatttcagcatcctccattaacgaagctagaattaatgccaaggcaaaaaggc

SEQ ID NO: 1659 - DNA, 350 bp, Homo sapiens
  CDS 48..350
aaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatca

SEQ ID NO: 1660 - DNA, 492 bp, Homo sapiens
  CDS 248..490
  misc_feature 203: r=a or g
  misc_feature 237: r=a or g
  misc_feature 278: k=g or t
  misc_feature 302: k=g or t
  misc_feature 303: s=g or c
  misc_feature 342: r=a or g
  misc_feature 388: r=a or g
  misc_feature 393: r=a or g
  misc_feature 417: w=a or t
  misc_feature 440: y=c or t
  misc_feature 469: k=g or t
  misc_feature 482: k=g or t
  misc_feature 488: r=a or g
  UNSURE 11: Xaa= *  or Glu
  UNSURE 19: Xaa= *  or Ala or Gly or Ser
  UNSURE 32: Xaa=Glu or Gly
  UNSURE 49: Xaa=His or Arg
  UNSURE 57: Xaa=His or Leu
  UNSURE 65: Xaa=Pro or Ser
  UNSURE 79: Xaa=Ala or Ser
  UNSURE 81: Xaa=Asp or Asn
tcttcgcattgtgagctctcgcggtaagaggctgaggagccggcctgcaacctgccggggcggctccgctacgcgcagcgcctcagtggcttcctccacagccacctccggagggatctggctgaggaggaagtggaggtgtcactggccccggcctttgccccaatcttgtgtgggcactgaagggggactacaggttcgaratacttcctcgcgtattgctaaaggaggagttgrccacaccaaaatgagtctacatggtgctagtgggggacatkagagatcaagagatagacgaaggksaagtgacagatcacgagattcatctcatgaaagaacggrgtctcagctcactccttgtattagaaatgtgacttctccaacacgrcagcrccatgttgaacgagaaaaagatcwcagttcctctcgtccaagcagtycgcgtcctcaaaaagcatccccaaatggktccattagcagtkctgggracag

SEQ ID NO: 1661 - DNA, 372 bp, Homo sapiens
  CDS 99..371
  misc_feature 78: y=c or t
  misc_feature 91: r=a or g
  misc_feature 95: r=a or g
  misc_feature 257: s=g or c
  misc_feature 295: n=a, g, c or t
  misc_feature 296: r=a or g
  UNSURE 53: Xaa=Asp or Glu
  UNSURE 66: Xaa=Ile or Lys or Met or Arg or Thr
gtggtacttttgcagctttggtgggctccggcttccttcactccagccccccgcgtccgagagacttagcagggcgtyaaactggcagagrcggraggatggaaccttttattctcaggtggagaggattaagctttgcggtgttagcagaaaatgatcgagctccagaaaatgatttggaggtcagattcgattttaaagtagtactaacaggccgggcgcggtgcctcacgcctgtaatcctagcactttgggasgccgaggtgggcggatcacctgaggttaggagttcganrccaggcctgaccaacatggtgaaacccgtctctactaaaaatacaaatattagccgggcgtggtggcgggcgtttg

SEQ ID NO: 1662 - DNA, 221 bp, Homo sapiens
  CDS 27..221
gtttgttgtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgac

SEQ ID NO: 1663 - DNA, 476 bp, Homo sapiens
  CDS 90..476
  misc_feature 417: n=a, g, c or t
  UNSURE 110: Xaa=Ala or Pro or Ser or Thr
atttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaancctatgtggaggaaggtttacacccccagatcatcattcgagctttccgcacagccacc

SEQ ID NO: 1664 - DNA, 552 bp, Homo sapiens
  CDS 92..550
  misc_feature 87: r=a or g
gtatttctattgcgcgaggcattgtgggttgctgggcggcccggtctcggagaagaggggagagtggagggccgctgaataagcttrcaaaatgatggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatcttaagaggacaatgatggcctgtggaggctcaatccagaccagtgtgaatgctctgtcagcagatgtgctgggtcgatgccaggtgtttgaagagacccagattggaggcgagaggta

SEQ ID NO: 1665 - DNA, 401 bp, Homo sapiens
  CDS 37..399
taggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgat

SEQ ID NO: 1666 - DNA, 477 bp, Homo sapiens
  CDS 96..476
  misc_feature 113: y=c or t
  misc_feature 435: n=a, g, c or t
  UNSURE 114: Xaa= *  or Glu or Lys or Gln
gacgtcctcccaagatggcggagacagagtgaagaaactgtgttccccccttgggttgctatcgatcaagggtaaaattccattctgatatcaaaatgcagtattcgcaccaytgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaatanagatggaagattttgcttttattgctaatccttcttctacag

SEQ ID NO: 1667 - DNA, 364 bp, Homo sapiens
  CDS 100..363
  misc_feature 304: k=g or t
  UNSURE 69: Xaa=Ala or Ser
agcgtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaagcctttaacttcctttaggcaaaggaaaggtggctcaaackccagttccccttccagacgccgagggagtcgatcaaggtcacgctcccgatcccctggtc

SEQ ID NO: 1668 - DNA, 234 bp, Homo sapiens
  CDS 9..233
gactgaaaatgccgtcggtttcgaaagcggcggcagcggcgctgagcgggtcccccccgcagacggagaagccgacccactacaggtacctgaaggagttcaggacggagcagtgccccctgttttcacagcacaagtgcgcgcagaccggccgttcacctgcttccactggcacttcctcaaccagcggcgccgcaggccctccgcaggcgcgacggcaccttcaactacagc

SEQ ID NO: 1669 - DNA, 508 bp, Homo sapiens
  CDS 189..506
aagtcacgtggcagccggaaagcgtggcggctgctgctagagcctttccctttaccgcacccaaggagctggagcgacaacaacgacgtcgtttccgtttccaccacctcttcctgttcccgtccttgaggacgccgtgccgggtcagtgttagcctccagccctggttgtggaaggcgacagaagtcatggcgatgtttgagcagatgagagccaacgtgggcaagttgctcaagggtatcgacaggtacaatcctgagaacctggccaccctggagcgctatgtagagacgcaggccaaggaaaatgcctatgatctggaagccaacctggctgtcctgaagctgtaccagttcaacccagccttctttcagaccacggtcaccgcccagatcctgctgaaggccctcaccaacttgccgcacacagacttcaccctgtgcaagtgcatgatcgaccaggcacatcaagaagaacggccaatccgacagattttgtactcggggac

SEQ ID NO: 1670 - DNA, 462 bp, Homo sapiens
  CDS 120..461
  misc_feature 30: s=g or c
  misc_feature 31: n=a, g, c or t
gaggttctagtctgttctgtcttgcggcasncgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaa

SEQ ID NO: 1671 - DNA, 332 bp, Homo sapiens
  CDS 149..331
  misc_feature 103: r=a or g
  misc_feature 312: m=a or c
  UNSURE 55: Xaa=Asn or Thr
cagtaatttatccttctctgtctctgcccagaagctttgcgaaggtaacagcctgcctcaggtctgagagccttgagcagctatggggtttaacgcgtcctcrcatcctacgtaatttccaatacagtggcccagtgggaggcagaaaatgctgctgggaggggacagatgccctctggagctctgcatctctcagtactcccagaggactctccttccttcctctccattccccaacccctcgtccaacctactcagaacccaaaatcaaaggcctgggaatgtaggattgctttctctccctaactccamtgggccccaccctcccctgc

SEQ ID NO: 1672 - DNA, 289 bp, Homo sapiens
  CDS 130..288
  misc_feature 222: m=a or c
  UNSURE 31: Xaa=Lys or Asn
aagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaamagaatacatactacagcagaaaaatatagagaatatgaagcccgggagcaaacagatcaaactcaaa

SEQ ID NO: 1673 - DNA, 382 bp, Homo sapiens
  CDS 216..380
acacacacacacagcacctgcacgcagatgcacacatctctagtcaaatgaggctctcagctttttgataggggctttttgatacgtgtataaccaatactttattctcactgtagtcaaggactcattgcaattcagaaatgagaagctgatccggaactccactacagctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccg

SEQ ID NO: 1674 - DNA, 404 bp, Homo sapiens
  CDS 12..404
gatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcat

SEQ ID NO: 1675 - DNA, 345 bp, Homo sapiens
  CDS 116..343
aggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatccaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcc

SEQ ID NO: 1676 - DNA, 439 bp, Homo sapiens
  CDS 96..437
aactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaacgtagcaactgaaggaaccagtaccca

SEQ ID NO: 1677 - DNA, 367 bp, Homo sapiens
  CDS 35..367
atcccggcgcttgagaggacgcggggctgcgcaaatggcttgtcccgctctcggtctggaagctcttcagcccctgcagcccgagccgccccccgagcccgccttctccgaggcgcagaagtggattgagcaagtaactggcagaagttttggtgataaagattttcggacaggtttagaaaatggaatcctcctctgcgagttgctgaatgctataaagccaggacttgttaaaaagatcaatagattgcctacccccattgcaggactggacaatattatcttattcttgagaggttgtaaagagctcggccttaaagaatctcaactttttgacccgagtgacctccaggatacatccaacaga

SEQ ID NO: 1678 - DNA, 396 bp, Homo sapiens
  CDS 79..396
  misc_feature 342: w=a or t
  UNSURE 88: Xaa=His or Gln
agcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggctaagtcagcctttaaagtccagaatgccaccacaaaaggcccawatggtgtctatgatttctctcaggctcataatgccaaggatgtgcccaacacac

SEQ ID NO: 1679 - DNA, 380 bp, Homo sapiens
  CDS 223..378
cagtataagtcttgtaggctgagtactaaacctttactcacctgcttacagccatgatatctttacaggtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacattcaacaacagagcctattctaaaaacaaaaaaggc

SEQ ID NO: 1680 - DNA, 287 bp, Homo sapiens
  CDS 20..286
  misc_feature 5: k=g or t
ctttktttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgccca

SEQ ID NO: 1681 - DNA, 307 bp, Homo sapiens
  CDS 20..307
  misc_feature 5: k=g or t
ctttktttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagcgtaaaaccaagactaccaactttccaaggctaacaacaacaacagta

SEQ ID NO: 1682 - DNA, 411 bp, Homo sapiens
  CDS 36..410
ttttctttctttgctttctctctttagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactcca

SEQ ID NO: 1683 - DNA, 497 bp, Homo sapiens
  CDS 74..496
  misc_feature 285: r=a or g
  UNSURE 71: Xaa=Cys or Tyr
aggctggactaaccattaaaaatgtctctaccttcaggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctrtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctactaagatgcagaagaaagtcctctccctccgcctgccctgtgaatttgggg

SEQ ID NO: 1684 - DNA, 444 bp, Homo sapiens
  CDS 108..443
  misc_feature 214: n=a, g, c or t
  misc_feature 256: n=a, g, c or t
  UNSURE 36: Xaa=Ile or Asn or Ser or Thr
  UNSURE 50: Xaa=Ala or Asp or Gly or Val
gacaagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccanctgggatattctcaacctggcagatgcgttactagagcaggncatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggca

SEQ ID NO: 1685 - DNA, 407 bp, Homo sapiens
  CDS 31..405
aatgcgacctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacgactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgcatccaccatccactgt

SEQ ID NO: 1686 - DNA, 369 bp, Homo sapiens
  CDS 10..369
  misc_feature 37: w=a or t
  misc_feature 38: n=a, g, c or t
  UNSURE 10: Xaa= *  or Lys or Leu or Met or Arg or Ser or Thr or Trp
actttcaaaatggcggagtgtggagcgagcggcacgwngagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatagaagaccatctcgtcaacacagagaccaaggtcatc

SEQ ID NO: 1687 - DNA, 360 bp, Homo sapiens
  CDS 143..358
  misc_feature 2: r=a or g
  misc_feature 71: m=a or c
  misc_feature 72: m=a or c
  misc_feature 169: n=a, g, c or t
  misc_feature 174: r=a or g
  misc_feature 186: n=a, g, c or t
  misc_feature 197: r=a or g
  misc_feature 219: s=g or c
  misc_feature 335: r=a or g
  UNSURE 9: Xaa=Asp or Glu
  UNSURE 11: Xaa=His or Arg
  UNSURE 15: Xaa=Ile or Lys or Arg or Thr
  UNSURE 19: Xaa=Ile or Val
  UNSURE 26: Xaa=Ala or Gly
  UNSURE 65: Xaa=Gly or Arg
artcagttccggcgggtgacggtgcggacgggtcaggagcgtagaggcggcggcaaaatggcggcgcctgmmggagcgggatctaacccaggagcagacagagaagctgctgcagtttcaggatctcactggcatcgaatctatggatcagtgtcgccatacctgggancagcrtaactggaacanagaggctgctrtacaggacagattgaatgaggsagagggcgtacctagtgttttcaacccacctccatcacgacccctgcaggttaatacagctgaccacaggatctacagctatgttgtctcaagacctcaaccaagggggctgcttrgatggggttattacttgataatgct

SEQ ID NO: 1688 - DNA, 428 bp, Homo sapiens
  CDS 134..427
  misc_feature 88: s=g or c
  misc_feature 97: r=a or g
  misc_feature 98: s=g or c
  misc_feature 172: m=a or c
  misc_feature 177: m=a or c
  misc_feature 194: w=a or t
  misc_feature 268: m=a or c
  misc_feature 305: n=a, g, c or t
  misc_feature 306: n=a, g, c or t
  misc_feature 307: n=a, g, c or t
  misc_feature 320: w=a or t
  misc_feature 321: r=a or g
  misc_feature 342: m=a or c
  misc_feature 367: w=a or t
  UNSURE 15: Xaa=Ala or Asp
  UNSURE 21: Xaa=Phe or Ile
  UNSURE 45: Xaa=Asp or Glu
  UNSURE 58: Xaa=any one of the twenty amino acids
  UNSURE 63: Xaa= *  or Lys or Arg
  UNSURE 70: Xaa=Pro or Gln
  UNSURE 78: Xaa= *  or Tyr
agagatccagggctcgggatgcgaatgtccctgtctacgatggggctgccgttacagccttcctcccggggctctggagacgcgccastctttgacrsctctcctgcgctaaggaagagttggtttacagaaaatgcaccaattccagctggacatcactgtgaaaatgggmcgggmtaaagtccgagaaatgwttatgaagaatgcccatgtcacagaccccagggtggttgatcttctggtcattaagggaaagatcgaactggamgaaacaattaaaagtatggaagcagcggacacatgtnnngcggttcttccawraaaacagaagcgccaaggccmaaaggatttcctatccaagttctawgttggccacgaatccatgaagtcattcagtggaaagatgcacgttgatactattttagagc

SEQ ID NO: 1689 - DNA, 303 bp, Homo sapiens
  CDS 19..303
  misc_feature 225: n=a, g, c or t
  UNSURE 69: Xaa=His or Gln
gtagcgggagggcgaaagatggcggcggcagtactgggacagttgggtgcgttatggatacataacctgaggagccgggggaagctggccttgggtgttttacctcaatcatatatccacacaagtgcttctcttgacatttctcgaaaatgggagaagaagaataaaattgtttatcctccacaactgcctggagaacctcggagaccagcagaaatctaccantgtcgaagacaaataaaatatagcaaagacaagatgtggtatttggcaaaattgatacgaggaatgtctattgaccag

SEQ ID NO: 1690 - DNA, 580 bp, Homo sapiens
  CDS 103..579
  misc_feature 65: w=a or t
  misc_feature 460: r=a or g
  UNSURE 120: Xaa=Ala or Thr
ctggcctcatctagccccgccccaggcgagggcgccgcacccacaccgcgctgcgcagttttgtwctgctccagctgttcgaaggtgatccagggacaggagatgccctggaggggaaggcgcttccggctctgcagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcccttcttattttttctagctgttggaggtgtttaccacccgcgtatagcttctggcctgggcttggcctggattgttggacgagttctttatgcttatggctattacrcgggagaacccagcaagcgtagtcgaggagccctggggtccatcgccctcctgggcttggtgggcacaactgtgtgctctgctttccagcatcttggttgggttaaaagtggcttgggca

SEQ ID NO: 1691 - DNA, 395 bp, Homo sapiens
  CDS 52..393
  misc_feature 254: r=a or g
  misc_feature 364: r=a or g
  UNSURE 68: Xaa=Asn or Ser
  UNSURE 105: Xaa=Asp or Asn
catccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcartgcatacaatgaaccaaacagcacaaagtttgttttcatgttaagcacgcgtgctggtggtcttggcatcaatcttgcgactgctgatgtagtaattttgtatgattctrattggaatccccaagtagatcttcaggctat

SEQ ID NO: 1692 - DNA, 309 bp, Homo sapiens
  CDS 135..308
  misc_feature 258: n=a, g, c or t
  UNSURE 42: Xaa=Cys or Gly or Arg or Ser
tgtgctacaaggtaaaatggtgtatgacaataacgtgcaggaaatcatttgttatatgcatttgctaagttatgagacaaatttagtactcaggtatttctaaagattcctaagaatagcatgattcctaatatatgattgttcaaatggagactcacatgctgcataaagatattcctgtggaacatggatctatggcagcagacagacagccccccctcagtgccccagcctcagctctgcgcacagcggtccccngcatgtccgcactcctgttctgtactgcacgctcgccagagacagagcccc

SEQ ID NO: 1693 - DNA, 383 bp, Homo sapiens
  CDS 113..382
ttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagc

SEQ ID NO: 1694 - DNA, 301 bp, Homo sapiens
  CDS 69..299
attcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagta

SEQ ID NO: 1695 - DNA, 318 bp, Homo sapiens
  CDS 41..316
  misc_feature 280: m=a or c
aagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtacgtgtggcctcccaggmcccccttaccattccttggccctccaccctgggaatca

SEQ ID NO: 1696 - DNA, 354 bp, Homo sapiens
  CDS 71..352
  misc_feature 2: r=a or g
argcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaata

SEQ ID NO: 1697 - DNA, 412 bp, Homo sapiens
  CDS 31..411
  misc_feature 313: n=a, g, c or t
  misc_feature 314: n=a, g, c or t
  UNSURE 95: Xaa=Ala or Cys or Asp or Phe or Gly or His or Ile or Leu or Asn or Pro or Arg or Ser or Thr or Val or Tyr
ccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctnntcgagcgcaacccaagatggtcacaagaacaaagaaaatatttgtaggcgggttatctgcgaacacagtagtggaagatgtaaagcaatatttcgagc

SEQ ID NO: 1698 - DNA, 412 bp, Homo sapiens
  CDS 29..412
  misc_feature 385: y=c or t
gcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactygggaacaagtgtgatgtgaatgacaag

SEQ ID NO: 1699 - DNA, 346 bp, Homo sapiens
  CDS 132..344
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggc

SEQ ID NO: 1700 - DNA, 434 bp, Homo sapiens
  CDS 92..433
ctataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtg

SEQ ID NO: 1701 - DNA, 422 bp, Homo sapiens
  CDS 91..420
atatatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacag

SEQ ID NO: 1702 - DNA, 411 bp, Homo sapiens
  CDS 213..410
  misc_feature 303: n=a, g, c or t
  UNSURE 31: Xaa=Gly or Arg or Trp
actggccaggggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtcnggtgtttgaacctgaagagccccacagccccacctgacctctacttccaggactcggggctctcacgctttctgctcaagtcctgtcctcttctgaccaaagaataca

SEQ ID NO: 1703 - DNA, 534 bp, Homo sapiens
  CDS 222..533
  misc_feature 154: n=a, g, c or t
  misc_feature 156: n=a, g, c or t
ataaagtcctggcctcgggacagcctgcacagctgcccagcctgcggagacgggacagccctgtcccactcactctttcccctgccgctcctgccggcagctccaaccatgggaggccgcgtctttctcgcattctgtgtctggctgactctgncngggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctg

SEQ ID NO: 1704 - DNA, 317 bp, Homo sapiens
  CDS 136..315
  misc_feature 114: w=a or t
  misc_feature 280: s=g or c
  UNSURE 49: Xaa=Ala or Pro
ctatatacgggtaaagtggcttctgggcggaaggtacactataggctcggggaggtagaattgggctatttgctgaagcttcttggtggcccttgctagcccaggaagaaactwacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaasctcctcacagaggaagactgaaggggatttgcaagga

SEQ ID NO: 1705 - DNA, 527 bp, Homo sapiens
  CDS 92..526
  misc_feature 439: r=a or g
  misc_feature 440: r=a or g
  misc_feature 441: k=g or t
  misc_feature 449: r=a or g
  UNSURE 117: Xaa=Gly or Ile or Ser or Val
  UNSURE 120: Xaa=Glu or Lys
gcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttrrktgcaaaaragattcatccacagaccatcatagcgggttggagagagccacgaggctgcagagaggcgctgttgagttctgcagttg

SEQ ID NO: 1706 - DNA, 330 bp, Homo sapiens
  CDS 41..328
acatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttg

SEQ ID NO: 1707 - DNA, 414 bp, Homo sapiens
  CDS 103..414
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggt

SEQ ID NO: 1708 - DNA, 487 bp, Homo sapiens
  CDS 170..487
  misc_feature 308: n=a, g, c or t
  misc_feature 309: n=a, g, c or t
  misc_feature 310: r=a or g
  misc_feature 404: k=g or t
  UNSURE 47: Xaa= *  or Ala or Glu or Gly or Ile or Lys or Leu or Met or Pro or Gln or Arg or Ser or Thr or Val or Trp
  UNSURE 79: Xaa=Asp or Tyr
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagnnrctattgggtttaggacagaaacatctggtgatgggggatattccagcagctgtcaatgcattccaggaagcagctagtcttttaggtaagaagkatggagagacagctaatgagtgtggagaagccttctttttctatgggaaatcacttctggagttggcaagaatggagaatggt

SEQ ID NO: 1709 - DNA, 393 bp, Homo sapiens
  CDS 229..393
  misc_feature 360: y=c or t
  misc_feature 368: m=a or c
  UNSURE 47: Xaa=Asn or Thr
acattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcaagaagcygtatggamctctgtgtgggtactatcttggtcg

SEQ ID NO: 1710 - DNA, 516 bp, Homo sapiens
  CDS 294..515
attttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggca

SEQ ID NO: 1711 - DNA, 509 bp, Homo sapiens
  CDS 187..507
  misc_feature 436: n=a, g, c or t
  misc_feature 449: n=a, g, c or t
  UNSURE 84: Xaa= *  or Glu or Lys or Gln
  UNSURE 88: Xaa=Ala or Asp or Gly or Val
agtacaaggtccacattacaagccaaagctcagaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatcccnaaaactgtcaggncttccttggatcaccagaactcatcaactggaaacagcatttacagattcaaagttcaca

SEQ ID NO: 1712 - DNA, 244 bp, Homo sapiens
  CDS 34..243
aaggtaaaatttcccactgcgaggcaggcagtgatgctgcggccgcttcgcactgtggctcctgccgaccgccaggcgctgttacagtggatgcgaactaaccgtaagtcattatatcgtactgcagaaaccagctcaactatgcaaaactaccaccaggactggccgacaccaggagggattccagagaccacactgcagggagcatacagaaagaaaattaagagatcagatgcagcagcag

SEQ ID NO: 1713 - DNA, 394 bp, Homo sapiens
  CDS 53..394
ctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacat

SEQ ID NO: 1714 - DNA, 318 bp, Homo sapiens
  CDS 62..316
gcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttca

SEQ ID NO: 1715 - DNA, 471 bp, Homo sapiens
  CDS 113..469
  misc_feature 428: n=a, g, c or t
  UNSURE 106: Xaa= *  or Glu or Lys or Gln
gattttcttctcgggctgcaaacaaagggaagcctgcaacaagttaagctgaagaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcacctggaaggtgatgtttgtggtgtggagctcctggcccaggagacacagtagtccagggagactgcagnagacacgtgtgacaggcctgggacagacacacaggactggaag

SEQ ID NO: 1716 - DNA, 355 bp, Homo sapiens
  CDS 56..355
atgctgggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctact

SEQ ID NO: 1717 - DNA, 411 bp, Homo sapiens
  CDS 14..409
  misc_feature 390: k=g or t
  UNSURE 126: Xaa=Gly or Val
agtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagcgaagatactatcagkattctccctgatgacccccga

SEQ ID NO: 1718 - DNA, 554 bp, Homo sapiens
  CDS 78..554
  misc_feature 124: r=a or g
  UNSURE 16: Xaa=Glu or Gly
atactgcgccggacagacccagttgcctggtgctgcggcccggcgtgggcctcgtgggcagagccagagccagagccatggacagcctcttcgtggaggaggtggccgcctccttggtcagggrgttcctcagcagaaagggcttaaagaagacatgtgtgaccatggaccaggaacgcccacgctctgacctcagcataaacaacagaaatgatcttcgaaaggttttgcatcttgaatttctctataaggagaacaaggcaaaggaaaatcctctaaaaacaagccttgaactcatcaccagatactttctggatcactttggaaatacggctaacaatttcactcaagataccccaatccctgcactctcagttccaaagaaaaataacaaagtgccatcaagatgctcagagactacactggtaaatatatatgacctttcagatgaagatgcaggatggagaacatcattgtcagaaacaagcaaagccagacatgacaatcttgatggagatgtacttggtaattttgtatcatctaaaaggcccccg

SEQ ID NO: 1719 - DNA, 427 bp, Homo sapiens
  CDS 55..426
  misc_feature 347: m=a or c
  UNSURE 98: Xaa=Lys or Thr
aggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgamaatcaatgagaagccacaggtgatcgcggactatgagagcggacgggccatacccaataaccaggtgcttggcaaaatcg

SEQ ID NO: 1720 - DNA, 703 bp, Homo sapiens
  CDS 159..701
  misc_feature 85: n=a, g, c or t
  misc_feature 87: m=a or c
ggaaacatttctaggtccgagccagcggcctaactggagtgtgcgcattcgaccgagcacagacacgttgcccaccgctcctctncmgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtggtggtaactggttttacattactgcaag

SEQ ID NO: 1721 - DNA, 334 bp, Homo sapiens
  CDS 44..334
gcaggaacatggcgcaactctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacacactaatggccgagttcagcaagctctgcagccagatggaacagctg

SEQ ID NO: 1722 - DNA, 459 bp, Homo sapiens
  CDS 290..457
  misc_feature 335: k=g or t
  UNSURE 16: Xaa=Asp or Tyr
attgttgcaagatggccgcgcccagtgatggattcaagcctcgtgaacgaagcggtggggagcaggcacaggactgggatgctctgccacccaagcggccccgactaggggcaggaaacaagatcggaggccgtaggttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggttkatatccatacacagaagaatgttctgattgaagtgaatccccagacccgaattcccagaacctttgaccgcttttgtggcctcatggttcaacttttacacaagctcagtgttcgagcagctga

SEQ ID NO: 1723 - DNA, 463 bp, Homo sapiens
  CDS 137..463
tttccggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaatacgggatatgagagactggatttggttactgtgccatgtgtttatcctaaactgagacaatgccttgtttttttc

SEQ ID NO: 1724 - DNA, 489 bp, Homo sapiens
  CDS 119..487
  misc_feature 238: m=a or c
  misc_feature 370: r=a or g
aaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcmgtgctagaaagcctggtggggagggacctgcttcccagaggtactggaattgtcacccggagacctctcattctgcaactggtccatgtttcacaagaagataaacggaaaacaacaggagaagaaaatggrgtggaagcagaagaatggggtaaatttcttcacaccaaaaataagctttacacggattttgatgaaattcgacaagaaattgaaaatgaaacagaaagaatttcaggaaataataaggg

SEQ ID NO: 1725 - DNA, 560 bp, Homo sapiens
  CDS 69..560
  misc_feature 84: r=a or g
  UNSURE 6: Xaa=Ile or Val
aggtggctcaaccccgcctctcagttgaggactctgaaggctgtttctgtggcgcttcccctgcgaggatggctaccctggttrtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacagg

SEQ ID NO: 1726 - DNA, 349 bp, Homo sapiens
  CDS 16..348
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagcgatctgaagataaaggttggggacaggcacatcagtgctcacaagtttgtcctggcagcccgcagtgacagctggagtctggctaacttgtcttccactaaagagttggacctgtcagatgctaatcctg

SEQ ID NO: 1727 - DNA, 294 bp, Homo sapiens
  CDS 105..293
  misc_feature 50: r=a or g
  misc_feature 136: y=c or t
  UNSURE 11: Xaa=Ala or Val
agtgacaattaaagatggctgcgcccatgtaacatcactagcgaccggtracctctttttcccccttgcctggctcctgtggtggcaggctgggcacgaggaccatgctgggccggagcctccgagaagtttctgyggcactgaaacaaggccaaattacaccaacagagctctgtcaaaaatgtctctctcttatcaagaagaccaagtttctaaatgcctacattactgtgtcagaagaggtggccttaaaacaagctgaagaatcagaaaagagatataagaatggacagc

SEQ ID NO: 1728 - DNA, 290 bp, Homo sapiens
  CDS 128..289
  misc_feature 85: y=c or t
tagagggggaagttggcgcatgcgcctaaagctgacgggtttgaaatggcttcgatgttagccgggacccgactcagatcgatgytatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttacca

SEQ ID NO: 1729 - DNA, 227 bp, Homo sapiens
  CDS 7..225
  misc_feature 48: s=g or c
  UNSURE 14: Xaa=Asp or Glu
acagagatggagggaggatcagagagagagggaaaaccagagatagasggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacacgatatgaatttcagcaatgaggacatgataag

SEQ ID NO: 1730 - DNA, 291 bp, Homo sapiens
  CDS 131..289
atccaatgcttgatccataacgggctctccataaacaataatataatttttttaccaccatgaagccctccaaccctccccaaatgctgttaggttggacctctcaatcctatccttgtgtaattcgcttatgaaatgtaaatgtggcatttttacatttattcctatgaagttccaacagtacttcacttcagtttatgatttttttaaccttttaataataataatcagtcacatttttgtcatttgtattttcaacaagtctttaagaactatattgaacaagacacc

SEQ ID NO: 1731 - DNA, 412 bp, Homo sapiens
  CDS 127..411
  misc_feature 51: r=a or g
  misc_feature 290: r=a or g
  UNSURE 55: Xaa=Glu or Gly
cctctccccctcctccgccgaccgagcagtgacttaagcaacggagcgcgrtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgrggaaacagtattttatgggttgcagtacattcttaataagtacttaaaaggtaaagtagtaaccaaagagaaaatccaggaagccaaagatgtctacaaagaacatttccaagatgatgtct

SEQ ID NO: 1732 - DNA, 428 bp, Homo sapiens
  CDS 90..428
  misc_feature 425: n=a, g, c or t
  UNSURE 112: Xaa=His or Gln
accacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccanact

SEQ ID NO: 1733 - DNA, 363 bp, Homo sapiens
  CDS 183..362
  misc_feature 116: s=g or c
agaacaaagataaggcatcacggacaccacaccgggcacgagctcacaggcaagtcaagctgggaggaccaaggccgggcagccgggagcacccaaggcaggaaaatgctggctgsttcctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgc

SEQ ID NO: 1734 - DNA, 341 bp, Homo sapiens
  CDS 135..341
  misc_feature 277: n=a, g, c or t
  misc_feature 301: s=g or c
  UNSURE 48: Xaa= *  or Leu or Ser or Trp
  UNSURE 56: Xaa=Ser or Thr
tgcagctgcgggactcagaggcgaacttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaaggggctgaggcaacaggctgtgatggccatcagccaggagctgaaccggagggccctggggggccccacccctagcacgtngattaaccaggttcggcggcggastctctactcggttctcggctggaagagactctctacagtg

SEQ ID NO: 1735 - DNA, 263 bp, Homo sapiens
  CDS 96..263
  misc_feature 73: w=a or t
agggagccacgccccgcacagttaacagacgggcgctcagggagctagggagctgtgaagctgctggaggagwtggcgtccggggagcaagggccatggccaccgtgcaggagaaggctgctgcgctgaacctctcggctctccacagccccgcgcacaggcctccgggtttcagtgtagctcagaagccatttggagccacgtatgtatggagcagcatcataaacactcttcaaacacaagtggaagtgaaaaaacgaagg

SEQ ID NO: 1736 - DNA, 625 bp, Homo sapiens
  CDS 241..624
  misc_feature 58: s=g or c
  misc_feature 480: n=a, g, c or t
  misc_feature 481: s=g or c
  misc_feature 558: m=a or c
  UNSURE 80: Xaa= *  or Tyr
  UNSURE 81: Xaa=Leu or Val
  UNSURE 106: Xaa=Lys or Asn
agcatgcacttgggatctgactcgtttggtaggaaaaggactggctctgactcttcasccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttanstggaggccattcacaacttcgtggaggtcttaaacgaatatttccacaatgtctgtgaactggacctggtgttcaamtttctacaaggtttacacggtcgtggacgagatgttcctggctggcgaaatccgagagaccagccag

SEQ ID NO: 1737 - DNA, 461 bp, Homo sapiens
  CDS 81..461
  misc_feature 326: k=g or t
ctgctccgcttgaggagaagcgccaagtgcgcatggggacgctatagcaattcgtttgctgtccttcctctccttcgaagatgacaaggcctaccatcgtttcttcctgcctttgggccgtcaggagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagtkggacagatattctacatttcctcatttctctacaccgtcaattacatctggtatttgtacacagagctgaggatgaaacacacccagagtggacagagcacatctccactggtgatagattatacttgtcgagtt

SEQ ID NO: 1738 - DNA, 281 bp, Homo sapiens
  CDS 30..281
gaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaagga

SEQ ID NO: 1739 - DNA, 280 bp, Homo sapiens
  CDS 91..279
  misc_feature 246: s=g or c
  UNSURE 52: Xaa=Lys or Asn
aggaaagttgatgaactagtacgggatggctcagacttgtaaagtgtctaagtcacaacgctgcagagccagcttccgggtagcaatggcatggcctcagctgtgccaaggctacaactggagcttccttactcgcatctgaggcaaacacagcaaggctggcccaggccgcccacagtcaacagatgttcacgggagatggatcagcccctcttttgcttgttctatcaaggaaagagatctaascatgggcaagggtggaacacacccggttcaggcc

SEQ ID NO: 1740 - DNA, 476 bp, Homo sapiens
  CDS 72..476
  misc_feature 446: r=a or g
aagattccggaaaggggaagagcagccaacatggcggcggaacgggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggargcgctaacagagctggagattctagatatt

SEQ ID NO: 1741 - DNA, 485 bp, Homo sapiens
  CDS 310..483
  misc_feature 300: w=a or t
  misc_feature 322: n=a, g, c or t
  misc_feature 348: w=a or t
  misc_feature 383: n=a, g, c or t
  misc_feature 384: n=a, g, c or t
  misc_feature 386: s=g or c
  misc_feature 411: r=a or g
  misc_feature 434: m=a or c
  misc_feature 446: m=a or c
  misc_feature 460: m=a or c
  UNSURE 5: Xaa= *  or Glu or Lys or Gln
  UNSURE 13: Xaa=Asp or Glu
  UNSURE 25: Xaa= *  or Cys or Phe or Leu or Ser or Trp or Tyr
  UNSURE 26: Xaa=Ser or Trp
  UNSURE 42: Xaa=Asn or Thr
  UNSURE 46: Xaa=Ala or Asp
  UNSURE 51: Xaa=Lys or Gln
acatgctgccaggggggaactgaactcagggaatggggcccccagctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacawccctcatcaatggttgactgcnaagaagtgagaaagccaagcttagawtcatgctcatgcctgaacaccctgagagcctggtnntsgagggctgggtatccccttggcctrccaccagcaactgcacccaacamccaggctggagmcacgctctggcacmagaaggtggccttgatttctcaggc

SEQ ID NO: 1742 - DNA, 454 bp, Homo sapiens
  CDS 226..453
ctttttgtgactcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggc

SEQ ID NO: 1743 - DNA, 404 bp, Homo sapiens
  CDS 28..402
agaccccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcg

SEQ ID NO: 1744 - DNA, 519 bp, Homo sapiens
  CDS 73..519
  misc_feature 402: n=a, g, c or t
  misc_feature 404: r=a or g
  UNSURE 111: Xaa=Glu or Gly
ttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccngrggcactcatctggggcatttacttcgccattctctctttcctgcacatctgggcagttgtaccatgcattaagagcttcctgattgagattcagtgcatcagccgtgtctattcc

SEQ ID NO: 1745 - DNA, 641 bp, Homo sapiens
  CDS 288..641
  misc_feature 161: n=a, g, c or t
  misc_feature 166: y=c or t
  misc_feature 168: n=a, g, c or t
  misc_feature 353: s=g or c
  misc_feature 524: n=a, g, c or t
  misc_feature 526: r=a or g
  UNSURE 22: Xaa=Lys or Asn
  UNSURE 80: Xaa=Glu or Gly
aggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcanttttycntcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaascgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccngrggcactcatctggggcatttacttcgccattctctctttcctgcacatctgggcagttgtaccatgcattaagagcttcctgattgagattcagtgcatcagccgtgtctattcc

SEQ ID NO: 1746 - DNA, 388 bp, Homo sapiens
  CDS 78..386
  misc_feature 343: n=a, g, c or t
  misc_feature 344: n=a, g, c or t
  misc_feature 359: s=g or c
  UNSURE 89: Xaa=His or Leu or Pro or Gln or Arg
  UNSURE 94: Xaa=Asp or Glu
ctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacacnntttaacctgcaggasgagatggaggaaggccactttgatgccga

SEQ ID NO: 1747 - DNA, 258 bp, Homo sapiens
  CDS 105..257
atacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggagtttctacagcagtataatcactacaaatccaatgtggagattttcaaattgcaaccaaataaac

SEQ ID NO: 1748 - DNA, 397 bp, Homo sapiens
  CDS 183..395
agtcagttcctttccgctttgtaaaatgctgctgacagatttagcagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaaggtcg

SEQ ID NO: 1749 - DNA, 468 bp, Homo sapiens
  CDS 127..468
aatgcggtcgggaggcggggctcgggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatggaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgag

SEQ ID NO: 1750 - DNA, 570 bp, Homo sapiens
  CDS 127..570
  misc_feature 368: s=g or c
  UNSURE 81: Xaa=Ser or Thr
aatgcggtcgggaggcggggctcgggtgtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggccaggataacaccaccaactatgggtatggtatggccacttcacactcttgggaaatgcctagctctgacacaaatgcaaacactastgcctcgggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggtcaggctatgactacagcgag

SEQ ID NO: 1751 - DNA, 309 bp, Homo sapiens
  CDS 139..309
  misc_feature 297: y=c or t
agagtgcattccggaacccggggcgcggcgcactgcgaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatcctycagatcagcacc

SEQ ID NO: 1752 - DNA, 375 bp, Homo sapiens
  CDS 37..375
  misc_feature 25: s=g or c
  misc_feature 132: m=a or c
  misc_feature 134: r=a or g
  misc_feature 136: s=g or c
  misc_feature 143: s=g or c
  misc_feature 163: r=a or g
  misc_feature 169: y=c or t
  misc_feature 188: k=g or t
  misc_feature 214: s=g or c
  UNSURE 32: Xaa=Asp or Glu
  UNSURE 33: Xaa=Lys or Arg
  UNSURE 34: Xaa=Ala or Pro
  UNSURE 36: Xaa=Ala or Gly
  UNSURE 43: Xaa=Gly or Arg
  UNSURE 45: Xaa=Pro or Ser
  UNSURE 51: Xaa=Cys or Phe
  UNSURE 60: Xaa=Leu or Val
ttcgccactgcaggggtggagactsgctctgatcggatgccggccgggggggagaggtgcaatcctctcctcgcggctggtggttgcgaccacccccactcccccaaaggcaggctccggaggcggcgggamarascgcctgsgaccccagtcggtgctccgrggaggycacctgacgaggaggtatktgaggagcagcgctgtgaggaggaastcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccac

SEQ ID NO: 1753 - DNA, 491 bp, Homo sapiens
  CDS 313..489
  misc_feature 167: k=g or t
  misc_feature 355: n=a, g, c or t
  misc_feature 358: s=g or c
  misc_feature 362: n=a, g, c or t
  misc_feature 365: y=c or t
  misc_feature 371: n=a, g, c or t
  misc_feature 374: s=g or c
  misc_feature 375: m=a or c
  misc_feature 383: m=a or c
  misc_feature 392: k=g or t
  UNSURE 15: Xaa= *  or Gly or Arg
  UNSURE 16: Xaa=Asp or His
  UNSURE 17: Xaa=Ala or Asp or Gly or Val
  UNSURE 18: Xaa=Leu or Ser
  UNSURE 20: Xaa=Cys or Phe or Ser or Tyr
  UNSURE 21: Xaa= *  or Cys or Ser
  UNSURE 24: Xaa=His or Pro
  UNSURE 27: Xaa=Cys or Phe
aaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccakgccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgctngasatgnctyaacctnttsmcaaatgcmttctgtttkccaaaggagtggtcaagcccttgcccagagctctctattctggaagagcggtccaggtggggccgggcactggccactgaattatgccagggcgcactt

SEQ ID NO: 1754 - DNA, 472 bp, Homo sapiens
  CDS 309..470
  misc_feature 231: s=g or c
  misc_feature 342: m=a or c
  misc_feature 374: n=a, g, c or t
  misc_feature 375: n=a, g, c or t
  UNSURE 12: Xaa=Pro or Thr
  UNSURE 23: Xaa=Leu or Met or Val
atacaaccgtggagccagggcaagggagagacagaaggagcaagtgacccagggcagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaasatttgcttcctctcccctgctaagctccaggtcctgagattgaattaggggctggagctcactgcactccagcagtcatgggacccaggatagggccagcgggtgaggtamcccaggtaccagacaaggaaaccaaagccacnntgggcacagaaaacacactggaggcaaagccagcccagaccctcaggacgtgcggcaagtgtgttccatacatcaagctgttcgttctgtgcacagc

SEQ ID NO: 1755 - DNA, 273 bp, Homo sapiens
  CDS 76..273
aagcacccttcagcagttccacacactcgcttctggaacgtctgagattatcaataagctcctagtccagacgccatgggtcatttcacagaggaggacaaggctactatcacaagcctgtggggcaaggtgaatgtggaagatgctggaggagttcaggcagtgaagggattaatgcagccataccatccactatgcacacaaaatcaacgaagtctttatgggttaacagctgagcatgggcaaaggggagcagaggccaaagcactaagg

SEQ ID NO: 1756 - DNA, 454 bp, Homo sapiens
  CDS 92..454
agggctgggcataaaagtcagggcagagccatctattgcttacatttgcttctgacacaactgtgttcactagcaacctcaaacagacaccatggtgcacctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaa

SEQ ID NO: 1757 - DNA, 241 bp, Homo sapiens
  CDS 77..241
ctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagag

SEQ ID NO: 1758 - DNA, 225 bp, Homo sapiens
  CDS 60..224
attcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggc

SEQ ID NO: 1759 - DNA, 396 bp, Homo sapiens
  CDS 66..395
gagcctgggtagcggcgcgagggccgggagaaccgttcgcggaggaaaggcgaactagtgttgggatggccaccaactgggggagcctcttgcaggataaacagcagctagaggagctggcacggcaggccgtggaccgggccctggctgagggagtattgctgaggacctcacaggagcccacttcctcggaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccagcaccatcaaacaggatgactttaccgctcgtctctttgacatccacaagcaagtcc

SEQ ID NO: 1760 - DNA, 434 bp, Homo sapiens
  CDS 213..434
  misc_feature 359: r=a or g
agcagtcagcccagggctctcggatgcagggagcctgggcccaaacagcagcttccggagtcggaaggagctgaggaagaagacagactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggrcataagtatcaccttaaatttgctgttgaagaaattatacaaaaacaagttaaggtgaactgcacagctgaagta

SEQ ID NO: 1761 - DNA, 433 bp, Homo sapiens
  CDS 57..431
  misc_feature 409: n=a, g, c or t
  misc_feature 422: w=a or t
  UNSURE 118: Xaa=Cys or Phe or Ser or Tyr
aacaccctgcagcgtttgaaatctgaggggaaaagactgtagtcagcccttagtggatgagagcgcctatgctccagaaacagcaggctcccaggatggacaccccgccccctgaagaacgcttagagaagcaaaatgaaaaactgaacaaccaggaagaggagacggagtttaaggaactggacggtctgagggaagccttggcaaacctccggggactgtcagaggaggagaggagcgagaaggctatgcttcgctcccgcattgaagagcagtcccagctcatctgcatcctgaagcggaggtcagatgaggccctggagcgctgccagatcctagagctgctcaatgcagagctggaggagaagatgatgcaggaggctgagaagctcaaggcccagggtgagtncagtcggaaactwgaggaacgctt

SEQ ID NO: 1762 - DNA, 458 bp, Homo sapiens
  CDS 60..458
  misc_feature 12: n=a, g, c or t
agagcaaggcgnaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacg

SEQ ID NO: 1763 - DNA, 247 bp, Homo sapiens
  CDS 50..247
agatctttcgtggttctgtcagggagacccttaggcactccggactaagatggcggcgacggccaggcggggctggggagctgcggctgttgccgccgggctgcgcaggcggttctgtcataagttgaagaatccatacaccattaagaaacagcctctgcatcagtttgtacaaagaccacttttcccactacctgcagccttttatcacccagtgagatacatgtttattcaaacacaagatacc

SEQ ID NO: 1764 - DNA, 320 bp, Homo sapiens
  CDS 99..320
actgccactcccgctctctcagcgccgccgtcgccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcg

SEQ ID NO: 1765 - DNA, 253 bp, Homo sapiens
  CDS 34..252
agttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgag

SEQ ID NO: 1766 - DNA, 468 bp, Homo sapiens
  CDS 49..468
tttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatg

SEQ ID NO: 1767 - DNA, 350 bp, Homo sapiens
  CDS 109..348
aacacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagactgagtatggcaagacagtgaccgtgaaggaggaccaggtgatgcagcagaaccc

SEQ ID NO: 1768 - DNA, 230 bp, Homo sapiens
  CDS 77..229
acagctctgtcctgctctgtgtctttccctgctgctctcaggtcccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgc

SEQ ID NO: 1769 - DNA, 427 bp, Homo sapiens
  CDS 23..427
actgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctatttta

SEQ ID NO: 1770 - DNA, 348 bp, Homo sapiens
  CDS 62..346
  misc_feature 15: m=a or c
  misc_feature 17: m=a or c
gagttcgctgctgtmcmggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcct

SEQ ID NO: 1771 - DNA, 391 bp, Homo sapiens
  CDS 33..389
  misc_feature 97: y=c or t
  misc_feature 212: n=a, g, c or t
  misc_feature 243: n=a, g, c or t
  UNSURE 22: Xaa=Leu or Pro
  UNSURE 60: Xaa= *  or Cys or Trp
  UNSURE 71: Xaa=Leu or Met or Val
actcctgaccccggaaggactccgccttctccatgtcagactgctgctcagcgccaggcatcagctgggaagctggcgtgggcaggccagctgtacytggcctggagctccagattagaagaggagccatgtcagaagaaacagtaagtgaatcacagttttccttgaagacagcagcgctaagagtgtttgatcttcctctgacttggtgntattctctctcccagatcaaattttctccgntggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagc

SEQ ID NO: 1772 - DNA, 442 bp, Homo sapiens
  CDS 110..442
actgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcc

SEQ ID NO: 1773 - DNA, 448 bp, Homo sapiens
  CDS 251..448
  misc_feature 9: y=c or t
  misc_feature 104: k=g or t
aacaatcayatagaacgcagaccagcccaagctgacagcttgatatgccttcttctgctgcctggttttgggggctgtatgacgtactggtcggtagtaaagaktaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcag

SEQ ID NO: 1774 - DNA, 435 bp, Homo sapiens
  CDS 60..434
  misc_feature 390: r=a or g
  misc_feature 399: r=a or g
  misc_feature 413: m=a or c
  misc_feature 428: r=a or g
  UNSURE 111: Xaa=Ala or Thr
  UNSURE 114: Xaa=Ala or Thr
  UNSURE 118: Xaa=His or Gln
  UNSURE 123: Xaa= *  or Trp
gttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggactcagagtttgrccccccggrcccaatgtggccamcaccactgtcagtgrcgatgtc

SEQ ID NO: 1775 - DNA, 480 bp, Homo sapiens
  CDS 113..478
  misc_feature 7: n=a, g, c or t
  misc_feature 25: s=g or c
  misc_feature 26: s=g or c
  misc_feature 44: s=g or c
  misc_feature 204: r=a or g
  misc_feature 205: r=a or g
  misc_feature 254: w=a or t
  misc_feature 255: n=a, g, c or t
  misc_feature 256: n=a, g, c or t
  UNSURE 31: Xaa=Lys or Arg
  UNSURE 48: Xaa= *  or Cys or Phe or Ile or Lys or Leu or Met or Asn or Arg or Ser or Thr or Trp or Tyr
gtgccanccgggtctctcgcgcgassatttagtctgaggcgaasttcggagcggccggtactgttgaaagcgacaagtggaggcgccgctctagcggccgggactctgaactatggcgataatgaaggaagaaaacacaggagccggagcagaagcaaagagaaccaacttcttcttaaaacagggaagaagacatgaatccarrgataaatcctctaagaaacataagtctgaggaacataatgacaaagaawnntcttctgataaaggaagagagcgactaaattcatctgaaaatggtgaggacaggcacaaacgcaaagaaagaaagtcatcaagaggcagaagtcactcaagatctaggtctcgtgaaagacgccatcgtagtagaagcagggagcggaagaagtctcgatccaggagtagggagcggaagaaatcgagatccagaagcagagagaggaagaaatcgagatccag

SEQ ID NO: 1776 - DNA, 216 bp, Homo sapiens
  CDS 3..215
  misc_feature 42: s=g or c
  UNSURE 14: Xaa=Leu or Val
ggatgtgtgtggtggcggcggccgaagagcttgtgtgcggastgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggag

SEQ ID NO: 1777 - DNA, 285 bp, Homo sapiens
  CDS 115..285
acatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcacc

SEQ ID NO: 1778 - DNA, 563 bp, Homo sapiens
  CDS 138..563
  misc_feature 108: s=g or c
atatcagcttatggcgccggtcgctgattggctggccgctccagcctcccggcccgcttgctggctgcccagctgctaggacagtttgcagagcagtggcgtgcggasggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatactttcctctttttcactgacatgttcatctactggattcacagaggccttcatc

SEQ ID NO: 1779 - DNA, 368 bp, Homo sapiens
  CDS 131..367
gtccccgccccgttcctctttctctttttaactccttccctctttgcggattctagaacggaacctttttttaattcttcccagtagaaacgtaggaacaatttcgtgaacgcaatccggagtgcccaacatggcggcggccgtaaggtgcatgggtagagccttgatacatcatcaaaggcatagcctttccaagatggtttatcagacatcactttgttcttgttctgtaaacatccgagtgcccaacagacattttgctgctgctacaaagtctgcaaagaaaacaaaaaaaggtgctaaagaaaaaacaccagatgagaaaaaagatgaaatagaaaaaataaaagcatatccctatatggaag

SEQ ID NO: 1780 - DNA, 316 bp, Homo sapiens
  CDS 164..316
  misc_feature 9: s=g or c
  misc_feature 10: n=a, g, c or t
  misc_feature 11: k=g or t
gaaaagtgsnkccgttttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaactgcctaaaacgttgaaggagaatcaattcttcaactcaagatgtctgatttactgtgaatttgcccaatctttgatgacattgaaaacgttttggggcatacacactcaaaaagcaggatccaatacccaa

SEQ ID NO: 1781 - DNA, 419 bp, Homo sapiens
  CDS 195..419
  misc_feature 279: n=a, g, c or t
  misc_feature 337: n=a, g, c or t
  UNSURE 29: Xaa=Leu or Met or Val
  UNSURE 48: Xaa=Ala or Glu or Gly or Val
ggagtcgccgatcccgccggaagcgccaggacaatggggacccgggacgacgagtacgactacctattcaaaggtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacntgtccttcatcgagacctcagccttggattccactaacgtagaggaagcattcaaggngatcctcacagagatctaccgcatcgtgtcacagaaacagatcgcagaccgcgctgcccacgacgagtccccggggaacaac

SEQ ID NO: 1782 - DNA, 615 bp, Homo sapiens
  CDS 34..615
  misc_feature 475: n=a, g, c or t
  misc_feature 533: n=a, g, c or t
  UNSURE 148: Xaa=Leu or Met or Val
  UNSURE 167: Xaa=Ala or Glu or Gly or Val
ggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacntgtccttcatcgagacctcagccttggattccactaacgtagaggaagcattcaaggngatcctcacagagatctaccgcatcgtgtcacagaaacagatcgcagaccgcgctgcccacgacgagtccccggggaacaac

SEQ ID NO: 1783 - DNA, 417 bp, Homo sapiens
  CDS 193..417
  misc_feature 176: n=a, g, c or t
  misc_feature 389: m=a or c
  UNSURE 66: Xaa=Ser or Tyr
gtgaactagaggtaacctttatagataacggactctgttatctaattattataagaaagaatggcataagactacttctaattgctgcctccattccatgaaacatctgtctcaatttccgctcttcctggagcctcctttggtctctctacaaatccattccttctgaatctgcntcattctgacctacagatggaaaccattgaaatagccacagtgatgccttcagggaacagagagctcctcactccacccccacagcctgagaaggcccaggaagaggaagaggaggaggaatctactcccaggctgattgatggctcttctccccaggagcctgaattcacaggggttctggggccacacacaaatggactttccaacctgtmttttgtgtacttgtataagtaccaccgt

SEQ ID NO: 1784 - DNA, 301 bp, Homo sapiens
  CDS 115..300
aaagaagtcctttcaagtctctaggactggactcttcctaagcaagtccggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcgg

SEQ ID NO: 1785 - DNA, 473 bp, Homo sapiens
  CDS 127..471
ggcagtcggcgacgctcagagcggaagagggaagtgaatcaggcgccgggtagtgggttgctgggctgggcttgctgaggtagaggcagcgccaagaagaggcctttgccgctggtcgggattgggatgtcgaagaacacagtgtcgtcggcccgcttccggaaggtggacgtggatgaatatgacgagaacaagttcgtggacgaagaagatgggggcgacggccaggccgggcccgacgagggcgaggtggactcctgcctgcggcaaggaaacatgacagctgccctacaggcagctctgaagaacccccctatcaacaccaagagtcaggcagtgaaggaccgggcaggcagcattgtcttgaaggtgctcatctcttttaaagctaatgatatagaaaaggcagttcaatctctggacaagaatggtgtggatctcctaatgaagtatatttataaaggatttgagag

SEQ ID NO: 1786 - DNA, 421 bp, Homo sapiens
  CDS 194..421
tttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaatggctggaacctgtatctggtgtatcacaacgctccatttcgctgatcacacacagccagaagtgacagtcgcttctctcactgccaaggacagaggagactctggctggacaggagaaattcaggtcgaaccaagattgaagacatcattacaaagatgcaagatgacaagacagggggtgtgccatcagaacagtcaagagctttctctccaaaatcccagtgtc

SEQ ID NO: 1787 - DNA, 390 bp, Homo sapiens
  CDS 33..389
  misc_feature 217: w=a or t
  misc_feature 317: k=g or t
  UNSURE 62: Xaa=Leu or Gln
actgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacwacttcatcgcatgaatagagaagagattctggcatttattaagtcttgccaacatgaatgtggtggaataagtgctagtatcggacatgatcctcatctkttatacactcttagtgctgtccaggtaaatactaatcaaaattgcaacgatcttgatagtatgttctcttact

SEQ ID NO: 1788 - DNA, 320 bp, Homo sapiens
  CDS 60..320
  misc_feature 5: n=a, g, c or t
  misc_feature 6: n=a, g, c or t
acgtnntttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacga

SEQ ID NO: 1789 - DNA, 242 bp, Homo sapiens
  CDS 13..240
agacaaataaacatggagtccatcttccacgagaaacaagaaggctcactttgtgctcaacattgcctgaataacttattgcaaggagaatattttagccctgtggaattatcctcaattgcacacagctggatgaggaagaggatgagaatggcagaaggaggagttactagtgaagattatcgcacgtttttacaggtactgattttaaactcactaagtcacatttctttttttttttt

SEQ ID NO: 1790 - DNA, 320 bp, Homo sapiens
  CDS 45..320
  misc_feature 129: n=a, g, c or t
  UNSURE 29: Xaa=Phe or Ile or Leu or Val
gcctgacggcgagaggcagaggtgccctcggtgatagaggaaacatggccgagtatacgcggctgcacaacgccttggcgctaatccgcctccgaaacccgccggtcaacgcgatcagtacgactttantccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggca

SEQ ID NO: 1791 - DNA, 385 bp, Homo sapiens
  CDS 213..383
  misc_feature 204: r=a or g
  misc_feature 281: n=a, g, c or t
  misc_feature 282: n=a, g, c or t
  misc_feature 300: y=c or t
  misc_feature 301: n=a, g, c or t
  misc_feature 302: k=g or t
  misc_feature 313: n=a, g, c or t
  misc_feature 315: s=g or c
  misc_feature 330: n=a, g, c or t
  misc_feature 331: n=a, g, c or t
  misc_feature 332: n=a, g, c or t
  misc_feature 336: m=a or c
  UNSURE 24: Xaa= *  or Glu or Lys or Gln
  UNSURE 30: Xaa= *  or Cys or Phe or His or Leu or Pro or Gln or Arg or Ser or Trp or Tyr
  UNSURE 34: Xaa=Ile or Lys or Arg or Thr
  UNSURE 35: Xaa=Ala or Pro
  UNSURE 40: Xaa=any one of the twenty amino acids
gggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggrccctcctgatgagcttgggccccctctacgctgaacgagccttaagggtaaaagctgttaaactggagaaagaagtnnaagatttaacagtgagaynkcagagagctanasctgattgtgaaaacnnnaggmggcgaacccagagatgtgtggaagacgccaagatatttggaatccagag

SEQ ID NO: 1792 - DNA, 465 bp, Homo sapiens
  CDS 20..463
  misc_feature 268: s=g or c
  misc_feature 269: n=a, g, c or t
  misc_feature 270: n=a, g, c or t
  misc_feature 307: m=a or c
  misc_feature 325: r=a or g
  misc_feature 326: k=g or t
  UNSURE 83: Xaa=Lys or Asn
  UNSURE 84: Xaa=Ala or Cys or Asp or Phe or Gly or His or Ile or Leu or Asn or Pro or Arg or Ser or Thr or Val or Tyr
  UNSURE 96: Xaa=Phe or Leu
  UNSURE 103: Xaa=Ala or Ser
ctcttgcgccattccaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaasnntctggatattgcaagacagacagaatgttttttcttmcaaaaaagattgcagttrkctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgca

SEQ ID NO: 1793 - DNA, 370 bp, Homo sapiens
  CDS 125..370
aatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggaggcctcagctgcagcagccacagctgagctgctgaagaaacaggaggagctcaaccggaaggcagaggagttggaccgaaggaagcgagagctgcagcatgct

SEQ ID NO: 1794 - DNA, 492 bp, Homo sapiens
  CDS 90..491
  misc_feature 132: r=a or g
  UNSURE 15: Xaa=Ala or Thr
agaggagctcatgcgcagtatgtgtggttggggaattcatgtggaggtcagagtggaagcaggtgtgagagggtccagcagaaggaaacatggctgccaaagtgtttgagtccattggcaagtttggcctgrccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttg

SEQ ID NO: 1795 - DNA, 584 bp, Homo sapiens
  CDS 182..583
  misc_feature 152: s=g or c
  misc_feature 224: r=a or g
  misc_feature 263: k=g or t
  UNSURE 15: Xaa=Ala or Thr
  UNSURE 28: Xaa=Asp or Tyr
agaggagctcatgcgcagtatgtgtggttggggaattcatgtggaggtcagagtggaagcagttatcttggccccaggatgtcatccagctcctgcttccataagaagcatgtcgttcttaatacacgatgttgacaagcagtatggtgagsaggtgtgagagggtccagcagaaggaaacatggctgccaaagtgtttgagtccattggcaagtttggcctgrccttagctgttgcaggaggcgtggtgaactctgccttakataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttg

SEQ ID NO: 1796 - DNA, 289 bp, Homo sapiens
  CDS 97..288
  misc_feature 17: s=g or c
  misc_feature 18: s=g or c
  misc_feature 285: n=a, g, c or t
atctggcgctgtaaagssttagaggctggaataacgacctgccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcntggg

SEQ ID NO: 1797 - DNA, 435 bp, Homo sapiens
  CDS 56..433
gaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccat

SEQ ID NO: 1798 - DNA, 329 bp, Homo sapiens
  CDS 95..328
  misc_feature 8: n=a, g, c or t
gtgactangaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccacc

SEQ ID NO: 1799 - DNA, 393 bp, Homo sapiens
  CDS 224..391
atatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaaga

SEQ ID NO: 1800 - DNA, 388 bp, Homo sapiens
  CDS 78..386
  misc_feature 17: k=g or t
  misc_feature 314: n=a, g, c or t
  misc_feature 315: n=a, g, c or t
  misc_feature 369: m=a or c
  UNSURE 79: Xaa=Asp or Glu
  UNSURE 80: Xaa=Gly or Arg or Trp
  UNSURE 98: Xaa=Lys or Gln
gtgcgcaggcgcgccgkacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggannggtctggctgtgcgctcacagacgctgtggcaccagggaacaaaggaaggggtmagcgtggaaacacagagag

SEQ ID NO: 1801 - DNA, 485 bp, Homo sapiens
  CDS 9..485
  misc_feature 39: m=a or c
  misc_feature 71: s=g or c
  misc_feature 433: m=a or c
  UNSURE 11: Xaa=Lys or Gln
  UNSURE 21: Xaa=Asp or Glu
  UNSURE 142: Xaa=Ala or Asp
agcccaacatggcgatgcacaacaaggcggcgccgccgmagatcccggacacccggcgggagctggcggasctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggmtctggatggatctgtgcagggagtgaacctcagaaggctgcttcttctactt

SEQ ID NO: 1802 - DNA, 383 bp, Homo sapiens
  CDS 83..382
  misc_feature 336: r=a or g
  misc_feature 350: r=a or g
  UNSURE 85: Xaa=Asp or Gly
  UNSURE 90: Xaa=Asp or Asn
ccgccagctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgrctacaatttggggracattttcctaggagtggagtatatcttccatc

SEQ ID NO: 1803 - DNA, 277 bp, Homo sapiens
  CDS 27..275
  misc_feature 194: s=g or c
  UNSURE 56: Xaa=Asp or Glu
gagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggastccagctgttgtgggaagagaggaccagccggcaacttttatccagctctaaactttatttcctcccagaagacactccccag

SEQ ID NO: 1804 - DNA, 408 bp, Homo sapiens
  CDS 253..408
  misc_feature 117: s=g or c
gggacccacggcaggcgcgaatcccagcggccggcgggcggcggggatacttctacatagacataatcaagttttgactatttggaaaccaagcatcattaaaattctctcaaactsctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccg

SEQ ID NO: 1805 - DNA, 453 bp, Homo sapiens
  CDS 59..451
  misc_feature 39: r=a or g
aagcaaggctcagcctcaagattcacagcatctcagacrcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggaaaa

SEQ ID NO: 1806 - DNA, 879 bp, Homo sapiens
  CDS 221..877
  misc_feature 490: w=a or t
  misc_feature 494: w=a or t
  misc_feature 856: s=g or c
  UNSURE 90: Xaa=Arg or Ser
  UNSURE 92: Xaa=Cys or Ser
  UNSURE 212: Xaa=Asp or Glu
attcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagwgccwgcagccggtgctgtccacagggagctccagcccttctcacactcgacccgcagaaaccacccaccttcaccatgtctgacgaggaagttgaacaggtggaggagcagtacgaagaagaagaggaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggasagcagaggattcgtgcagagaag

SEQ ID NO: 1807 - DNA, 466 bp, Homo sapiens
  CDS 300..464
  misc_feature 127: y=c or t
  misc_feature 139: s=g or c
  misc_feature 455: k=g or t
  misc_feature 456: m=a or c
  UNSURE 53: Xaa=Ile or Leu
gttaagactatactttcagggatcatttctatagtgtgttactagagaagtttctctgaacgtgtagagcaccgaaaaccacgaggaagagaggtagcgttttctcctgagcgtgaagccggctttytggcgttgcttsgcgcaactgccgtcagccattgatgatcgttcttctctccgtattggggagtgagagggagagaacgcggtctgagtggtttttccttcttgatggctcaatgacagagactagctcgtaaactccggggcgtttccgggctgttcgctcctgcttggcaatgtcgcgagaaaggttttcgcctcctgtttcagcggtgacggctcttgggttttcctcggggtggctttttaattttagtcttggcgcgaggcgggggatgctgtgtggcacctcctattgtctctttttgcgttttctcccattctcgctccckmttttgtcgcc

SEQ ID NO: 1808 - DNA, 314 bp, Homo sapiens
  CDS 129..314
aaatcgctcggcctcccccatcccccggtaacggtcgctggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaa

SEQ ID NO: 1809 - DNA, 387 bp, Homo sapiens
  CDS 149..385
gtcctcccggtccgccccgcgctgcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacggg

SEQ ID NO: 1810 - DNA, 391 bp, Homo sapiens
  CDS 189..389
  misc_feature 357: r=a or g
  misc_feature 361: s=g or c
  UNSURE 57: Xaa=Glu or Lys
  UNSURE 58: Xaa= *  or Ser
agattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatragtsacaattacactgccacatatccctggatcc

SEQ ID NO: 1811 - DNA, 337 bp, Homo sapiens
  CDS 90..335
  misc_feature 88: s=g or c
gtccggcccggtcctgtcccgcagcgtcccgccagccagctccttgcacccttcgcggccgaggcgctccctggtgctccccgcgcascatggctcagcacttctccctggccgcctgcgacgtggtcggattcgacctggaccacactctgtgtcgctacaacctgcccgagagcgccctaccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatag

SEQ ID NO: 1812 - DNA, 396 bp, Homo sapiens
  CDS 31..396
actcggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctg

SEQ ID NO: 1813 - DNA, 329 bp, Homo sapiens
  CDS 149..328
  misc_feature 298: y=c or t
  misc_feature 299: y=c or t
  misc_feature 306: m=a or c
  misc_feature 307: s=g or c
  UNSURE 51: Xaa=Phe or Leu
  UNSURE 53: Xaa=Ala or Asp or Glu
actcggcttccgtccattcttccggtggagatggctgcggccgtggcggggatgctgcgcagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagtyytccaggmsgcgtcgtccgccgtagtcggtg

SEQ ID NO: 1814 - DNA, 451 bp, Homo sapiens
  CDS 203..451
  misc_feature 15: w=a or t
  misc_feature 64: s=g or c
aacgcggcgcagggwgagagcgcgcgcttgcggacgcggcggcattaaacggttgcaggcgtasagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggc

SEQ ID NO: 1815 - DNA, 467 bp, Homo sapiens
  CDS 119..466
  misc_feature 98: r=a or g
  misc_feature 348: r=a or g
  UNSURE 77: Xaa=Glu or Gly
acgtgtgaggggcggcccgaggtcacgtgacggagcgccggagcggagggagccggggctgggagttctcctgagggaagaggagtggagtagggggracgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgracttttcaatgacaagagtaatactcatgaatttgtaaacctagtgaaagaactagccttacctggagaactgactcagagcagaagttatgattttgaatttatgcaagttgaaaagc

SEQ ID NO: 1816 - DNA, 410 bp, Homo sapiens
  CDS 25..408
aacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatccgaggctactgagaacccaggggctttgattaaagacattcgggagaatgggatgaaggttggccttgccatcaaaccaggaacctcagttgagtatttggcaccatgggctaatcagatagatatggccttggttatgacagtggaccggggtttggagggcagaattcatggagatatgat

SEQ ID NO: 1817 - DNA, 434 bp, Homo sapiens
  CDS 105..434
  misc_feature 12: y=c or t
  misc_feature 13: y=c or t
  misc_feature 28: y=c or t
  misc_feature 86: k=g or t
  misc_feature 117: k=g or t
  misc_feature 290: w=a or t
  misc_feature 291: n=a, g, c or t
  misc_feature 292: n=a, g, c or t
  misc_feature 293: n=a, g, c or t
  misc_feature 317: n=a, g, c or t
  UNSURE 5: Xaa=Gly or Trp
  UNSURE 63: Xaa=any one of the twenty amino acids
  UNSURE 71: Xaa=Asp or Glu
gggtaacttgcyyttgggagccagcggyatggcgtcgggctgcaagattggcccgtccatcctcaacagcgacctggccaatttakgggccgagtgcctccgggatgctagactctkgggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggwnnnaatcagtacacctttcatctcgangctactgagaacccaggggctttgattaaagacattcgggagaatgggatgaaggttggccttgccatcaaaccaggaacctcagttgagtatttggcaccatgggctaatcagata

SEQ ID NO: 1818 - DNA, 282 bp, Homo sapiens
  CDS 122..280
atttttcagatttctttcaaatgaaggactgttaggtcaccatattgtatattaggttaatcttcaagctttgaaatatggaaggctgacacctgcgtgttattctctttcaagtgcttaaatgagctgttcatctgaaattcacgaattggtttatagatatatctggatatacataaaccagggacaatgcagaaagggtataacatctagattgcagcaaatctgtgcatgccagattagttttataagtatgcactttacaaatgatgaaataagggc

SEQ ID NO: 1819 - DNA, 373 bp, Homo sapiens
  CDS 15..371
gaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgca

SEQ ID NO: 1820 - DNA, 361 bp, Homo sapiens
  CDS 105..359
  misc_feature 304: m=a or c
  misc_feature 319: s=g or c
  misc_feature 324: r=a or g
  UNSURE 67: Xaa=Asn or Thr
  UNSURE 72: Xaa=Ala or Gly
  UNSURE 74: Xaa=Ala or Thr
agtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgamcgaggccttctttgscatgrccaagctctttcagtccaatgatcccacactccgtcg

SEQ ID NO: 1821 - DNA, 391 bp, Homo sapiens
  CDS 46..390
gattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattct

SEQ ID NO: 1822 - DNA, 458 bp, Homo sapiens
  CDS 201..458
  misc_feature 131: r=a or g
  misc_feature 293: k=g or t
  misc_feature 387: n=a, g, c or t
  misc_feature 388: n=a, g, c or t
  misc_feature 389: w=a or t
  UNSURE 63: Xaa= *  or Ala or Cys or Asp or Glu or Phe or Gly or His or Ile or Lys or Leu or Asn or Pro or Gln or Arg or Ser or Thr or Val or Tyr
agcgcagacacggtggcggcgtgtgcgcctccggggctgctgattagaataggggacttggccgtggatggaatccgggaaacccaaaccggagatggaaggatgaggctgcgtttgcagcgcgtgaatgrgacgcggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgckcccccgcagaacggtatccccgcggaatacacggcccctcatccccaccccgcgccagagtacacaggccagaccacggttcccgagcacacannwaacctgtaccctcccgcccagacgcactccgagcagagcccggcggacacgagcgctcagaccgtctct

SEQ ID NO: 1823 - DNA, 201 bp, Homo sapiens
  CDS 43..201
ctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacag

SEQ ID NO: 1824 - DNA, 357 bp, Homo sapiens
  CDS 173..355
  misc_feature 95: r=a or g
  misc_feature 96: m=a or c
  misc_feature 244: s=g or c
  misc_feature 347: s=g or c
  misc_feature 348: s=g or c
  UNSURE 24: Xaa=His or Gln
  UNSURE 59: Xaa=Ala or Gly or Pro or Arg
cctagctactataacccagccgctgttaatccaatgaaatttgctgaacaagagaaaaaaaggaaaatgctttggcagggcaagaaagaaagggrmcaaatcccaatctgctgaaatatgggaaaaattgaattttggaaacaaggaccaaaatgtcaaatttaggaaattgatgggtattaagagtgaagatgaagctggatgtagctcagttgatgaagaaagttacaagactctgaagcascaggaagaagtatttcgaaatttagatgctcagtatgaaatggcaagatcacaaacccacacacaaagaggaatgggtttgggtttcacatcttcaatgcgassaatggatgc

SEQ ID NO: 1825 - DNA, 404 bp, Homo sapiens
  CDS 74..403
  misc_feature 291: y=c or t
  misc_feature 296: k=g or t
  misc_feature 367: n=a, g, c or t
  misc_feature 368: n=a, g, c or t
  UNSURE 73: Xaa=Ile or Thr
  UNSURE 75: Xaa=Phe or Val
  UNSURE 99: Xaa=Leu or Met or Val
aaagacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaycaaaktttatcatcctaatgtagacaagttgggaagaatatgtttagatattttgaaagataagtggtccccagcnntgcagatccgcacagttctgctatcgatccaggcct

SEQ ID NO: 1826 - DNA, 432 bp, Homo sapiens
  CDS 83..430
  misc_feature 18: w=a or t
  misc_feature 174: w=a or t
  misc_feature 409: s=g or c
  UNSURE 31: Xaa=Leu or Gln
  UNSURE 109: Xaa= *  or Tyr
agagagtcacatctcttwtttggaccagtatagacagaagtaaacccagctgacttgtttcctgggacagttgagttaagggatggctttcacagagcattcaccgctgacccctcaccgtcgggacctctgtagccgctctatctggctagcaaggaagattcgttcagaccwgactgctcttacggaatcctatgtgaagcatcagggcctgaacaagaacatcaacctggactctgcggatgggatgccagtggcaagcactgatcagtggagtgagctgaccgaggcagagcgactccaagagaaccttcaagcttatcgtaccttccatgttttgttggccaggctcttagaagaccagcaggtgcattttaccccaaccgaagtgacttccatcaagctatasatacccttcttctccaagtcgct

SEQ ID NO: 1827 - DNA, 286 bp, Homo sapiens
  CDS 126..284
  misc_feature 57: k=g or t
  misc_feature 109: m=a or c
  misc_feature 112: m=a or c
  misc_feature 117: n=a, g, c or t
  misc_feature 118: s=g or c
  misc_feature 205: s=g or c
  misc_feature 206: w=a or t
  UNSURE 27: Xaa=Arg or Ser or Thr
aaagaggtgctgtgcaggaggcgggcgggcgcggttctttccggaaggattgaatckcctttagccccgcccgcctccgtagctgcctgaagtagtgcagggtcagccmgcmagttnscagggtcatggcgctggctgctcgactgtggcgccttctgcctttccgacgtggagccgccccggggtctcgtctccctgcggggaswtcgggcagccgcgggcattgcggcccctgtcgattccgcggcttcgaggtaatgggaaacccaggaactttcaaaagagg

SEQ ID NO: 1828 - DNA, 329 bp, Homo sapiens
  CDS 127..327
  misc_feature 57: k=g or t
  misc_feature 112: m=a or c
  misc_feature 117: k=g or t
  misc_feature 130: k=g or t
  misc_feature 206: s=g or c
  misc_feature 207: w=a or t
  UNSURE 2: Xaa=Ala or Ser
  UNSURE 27: Xaa=Arg or Ser or Thr
aaagaggtgctgtgcaggaggcgggcgggcgcggttctttccggaaggattgaatckcctttagccccgcccgcctccgtagctgcctgaagtagtgcagggtcagcccgcmagttkccagggtcaatgkcgctggctgctcgactgtggcgccttctgcctttccgacgtggagccgccccggggtctcgtctccctgcggggaswtcgggcagccgcgggcattgcggcccctgtcgattccgcggcttcgaggtacccccgtggtcctggctcccgctcctcacttcctactcagtaatgggaaacccaggaactttcaaaagagg

SEQ ID NO: 1829 - DNA, 433 bp, Homo sapiens
  CDS 116..433
  misc_feature 138: m=a or c
  misc_feature 285: r=a or g
  misc_feature 339: n=a, g, c or t
  misc_feature 340: n=a, g, c or t
  misc_feature 414: s=g or c
  misc_feature 415: k=g or t
  misc_feature 416: y=c or t
  UNSURE 8: Xaa=His or Pro
  UNSURE 57: Xaa=Glu or Gly
  UNSURE 75: Xaa=His or Leu or Pro or Gln or Arg
  UNSURE 100: Xaa=Pro or Arg
  UNSURE 101: Xaa= *  or Gln
attagctccattcaagcctacaaattgcatcaccctcctcctctgcccagacctgggggctccaacacctttcgctaggtctggctctggcctctgagcgaaccttccgtacagtatggcggctcccgaagccccgcmcctggacagagttttccgtacaacatggctgtctacagagtgcgattcccacccacttccgcctagctaccggaagtttctatttgaaacccaggcggccgacttagccggtggcacgacagttgctgcagggaatcttttaaacgrgagcgagaaggactgcgggcaggaccggcgggctcctggggttcagccgtgccnnctcgttacgatgaccagtgtggttaagacagtgtatagcctgcagcccccctctgcgctgagcggcggccagcskyagtacacacaaactcgg

SEQ ID NO: 1830 - DNA, 474 bp, Homo sapiens
  CDS 47..472
agcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatgg

SEQ ID NO: 1831 - DNA, 291 bp, Homo sapiens
  CDS 77..289
cttttcctccccaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccc

SEQ ID NO: 1832 - DNA, 441 bp, Homo sapiens
  CDS 254..439
ttttaaacccccagtgggctgaaggcatcagagagggtggcccaatggttagggcagtcattatggctgaatatgctcagttccctttttttccctctgggctataaagactaaaccgggctgggggctgtggctcacgcctgtaatcccagcactttgggaggccgaggcagcaggattgcttgagcccaggagttcaagaccagcctgggcaacatagtgagacctcctcatctctacagaaaatttaaacatgacaggcgtggggggcttgtcacgtgggagaagtcacatgggagaagagttgagaattggcctgaattttgaaaggccaattttgttccccacaggaacaaaaaatttaaaaagttggccaggcgtggtggctcacgcctgtaatcctagcactttgggaggccaagggggatcacaaggtcagga

SEQ ID NO: 1833 - DNA, 438 bp, Homo sapiens
  CDS 103..438
  misc_feature 120: s=g or c
  misc_feature 128: w=a or t
  misc_feature 396: r=a or g
  UNSURE 9: Xaa=Ile or Asn
aaaactgaaagtgaaatagggagctggctaccagcgttgagtcccctgtaaagccaaaccccctaaaggtctccacactgctgtttaacggcacacttgacaatggcttcagcagcacgsttgaacawtgatgtgggaggaggtcacatgccctatctgcctggaccccttcgtggagcctgtgagcatcgagtgtgccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagrcttcacctgttctgtgagaaagatgggaaggcctttgctggg

SEQ ID NO: 1834 - DNA, 421 bp, Homo sapiens
  CDS 26..421
  misc_feature 25: y=c or t
acttgcaagctgcccgcaatacgtyatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgttcgagatgaacttgggtcccccaaagaccctggaggagctggaccccgagagccgggagtactggcggcggctgcggaaacagaacatctggcgccacaaccggctg

SEQ ID NO: 1835 - DNA, 673 bp, Homo sapiens
  CDS 221..673
  misc_feature 16: k=g or t
  misc_feature 38: k=g or t
  misc_feature 130: s=g or c
  misc_feature 175: r=a or g
agatttggctttatakagcggacccgtaaggccgacckgctctaccggcgggatttgatggcgtgatgtctcacagaaagttctccgctcccagacatgggtccctcggcttcctgcctcggaagcgcasagcaggcatcgtgggaaggtgaagagcttccctaaggatgacccrtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcag

SEQ ID NO: 1836 - DNA, 647 bp, Homo sapiens
  CDS 66..647
  misc_feature 16: k=g or t
  misc_feature 38: k=g or t
  misc_feature 104: s=g or c
  misc_feature 149: s=g or c
  UNSURE 13: Xaa=His or Gln
agatttggctttatakagcggacccgtaaggccgacckgctctaccggcgggatttgatggcgtgatgacatgggtccctcggcttcctgcctcggaagcgcasagcaggcatcgtgggaaggtgaagagcttccctaaggatgacccstccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcag

SEQ ID NO: 1837 - DNA, 424 bp, Homo sapiens
  CDS 100..423
  misc_feature 344: r=a or g
  UNSURE 82: Xaa=Lys or Arg
ctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcaggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccargcagggcctgctccggcagcaggaagaactggacaggaaagctgccgagctggaacgcaaggagcgggagctgcagaaca

SEQ ID NO: 1838 - DNA, 263 bp, Homo sapiens
  CDS 88..261
  misc_feature 197: k=g or t
  misc_feature 198: k=g or t
  UNSURE 37: Xaa=Leu or Arg
aagccgtaacggaagcaagtgaaatgctcagtcttagacgactgcgtcgtgctatgaccggactttttcttgaaaggggatgacagcatgggaagcaatggctccacatgtaaacccgacactgaaagacaaggcactctctccacagcagccccaacaactagccctgcaccctgtctctctaaccaccacaacckktatctcctcatcataaagagctacagaaaatctttcatccatcccaggggaatcacttacctatg

SEQ ID NO: 1839 - DNA, 273 bp, Homo sapiens
  CDS 111..272
  misc_feature 116: m=a or c
  misc_feature 124: r=a or g
  misc_feature 149: m=a or c
  misc_feature 150: r=a or g
  misc_feature 151: n=a, g, c or t
  misc_feature 152: m=a or c
  misc_feature 161: n=a, g, c or t
  misc_feature 165: k=g or t
  misc_feature 174: m=a or c
  UNSURE 5: Xaa=Asn or Ser
  UNSURE 14: Xaa=Ala or Asp or Glu or Gly or Ile or Lys or Asn or Arg or Ser or Thr or Val
  UNSURE 17: Xaa= *  or Tyr
  UNSURE 19: Xaa=Cys or Gly
  UNSURE 22: Xaa=Pro or Thr
ctagccctgcccggccccggaggacttgcaacactccgaggccaggaacgctccgtctggaacggcgcaggtcccagcagctggggttccccctcagcccgtgagcagccatgtcmaaccccarcgccccaccaccatatgaagaccgmrnmcccctgtanccakgccctctgmcccctgggggctatgggcagccatctgtgctgccaggagggtatcctgcctaccctggctacccgcagcctggctacggtcaccctgctggctacccac

SEQ ID NO: 1840 - DNA, 266 bp, Homo sapiens
  CDS 86..265
  misc_feature 25: n=a, g, c or t
aggggagagcccgagcgctggagtnggtgctgggaaacccggggctaatgttgacaacaggctcgagattgtcctgggtcacataatgccagctgagcgtaaaaagccagcaagtatggaagaaaaagactctttaccaaacaacaaggaaaaagactgcagtgaaaggcggacagtgagcagcaaggagaggccaaaagacgatatcaagctcactgccaagaaggaggtcagcaaggcccctgaagacaagaagaagagactgg

SEQ ID NO: 1841 - DNA, 484 bp, Homo sapiens
  CDS 210..482
  misc_feature 375: n=a, g, c or t
  misc_feature 376: k=g or t
  misc_feature 426: r=a or g
  misc_feature 431: n=a, g, c or t
  UNSURE 56: Xaa=Gly or Leu or Met or Arg or Val or Trp
  UNSURE 73: Xaa=Gly or Ser
  UNSURE 74: Xaa=Arg or Ser
agatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcagnkggaaatttgtctgcattcggacccaatcaaacaggaagagaacgcgggargcagncatgtgccagcgtacttgctcctaaggtacaacgagagactagatagactatt

SEQ ID NO: 1842 - DNA, 341 bp, Homo sapiens
  CDS 79..339
  misc_feature 111: y=c or t
  misc_feature 338: n=a, g, c or t
  misc_feature 339: m=a or c
  UNSURE 87: Xaa=Ile or Lys or Asn or Arg or Ser or Thr
atcagcttcaagtgaagttaatctgaggtgaagcaaacagaaaattgtggaggttttgttggtgtgcaactgaggaacatggctcaagaaactaatcacagccaagtgccyatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcatctatgcagcccanmcc

SEQ ID NO: 1843 - DNA, 337 bp, Homo sapiens
  CDS 72..335
  misc_feature 162: m=a or c
  UNSURE 31: Xaa=Pro or Thr
agtatcctgccaagagtcctccctgaccaccagaagttccacctcaccatcaagaaaggccctggtccaggatgtgcaaggactcacagaaaccctctgtacccagtcatgggccaaagacaccgtcatgcaagggggtgaaggctccacactcgtcccggmcccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggcctacctgt

SEQ ID NO: 1844 - DNA, 243 bp, Homo sapiens
  CDS 83..241
agtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtaagtctgacggggtttcgggtgggagagggttcccaactcgcgcccctagaacccgcaagactgcgtcgcgattgccgcttcccgga

SEQ ID NO: 1845 - DNA, 355 bp, Homo sapiens
  CDS 6..353
  misc_feature 177: k=g or t
  UNSURE 58: Xaa=Phe or Val
agttaatgcgaagagggggaggggataggacgaagaaaccgaaggaaagctcagctgcagcggcgactttcagtttcatttccacggaccctcctgcctgggccgcagccgccgccgcgatgcccagtaagttcagctgccggcagctccgggaggcgggccagtgtttcgagagtktcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagact

SEQ ID NO: 1846 - DNA, 480 bp, Homo sapiens
  CDS 54..479
  misc_feature 78: s=g or c
  misc_feature 233: w=a or t
  misc_feature 234: r=a or g
  misc_feature 462: k=g or t
  UNSURE 9: Xaa=Gly or Arg
  UNSURE 61: Xaa=Ala or Thr
  UNSURE 137: Xaa= *  or Glu
gatgtctggggcgttcttgtattcggtgatcttttgcgccgtcttcttgcttgatgtctcctgagcggcggcggcgcsggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgcctwrcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagakaaaacccggtggatgaaa

SEQ ID NO: 1847 - DNA, 471 bp, Homo sapiens
  CDS 123..470
cttttccttccccagtgcgtctttcctgcgtcgttccggcgcggcgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctgtcccttgttgggaagctggagggcacccgtatgggagacaaggctcaacggaccaaaccgcagatgcaggaggaaagaagagccaagcgaagaaagcgtgatgaggaccggcatgacatcaacaagatgaagggttatactctgctgtcggagggcattgatgagatggtgggcatcatctacaagcccaaaactaaagagactcgggagacctatgaggtgctac

SEQ ID NO: 1848 - DNA, 381 bp, Homo sapiens
  CDS 195..380
  misc_feature 7: r=a or g
  misc_feature 42: s=g or c
  misc_feature 122: r=a or g
  misc_feature 144: k=g or t
  misc_feature 189: r=a or g
  misc_feature 330: w=a or t
  misc_feature 356: n=a, g, c or t
  UNSURE 46: Xaa= *  or Lys
agtgacrgctgcgtgcggcgggaatcatggctgctcgcagastctgcacttcgtattcaaagtgggaaaccgcttccagacggcgcgtttctatcgggacgtcctggggatgaaggtttctrcggcatgaggaatttgaagaakgctgcaaagctgcctgtaatgggccttatgatgggaaatggagtraaacaatggtgggatttgggcctgaggatgatcattttgtcgcagaactgacttacaattatggcgtcggagactacaagcttggcaatgactttatgggaatcacgctcgcttctagccaggctgtcagcaacgccaggwagctggagtggccactgacggaagtngcagaaggtgtttttgaaaccgagg

SEQ ID NO: 1849 - DNA, 366 bp, Homo sapiens
  CDS 84..365
  misc_feature 45: s=g or c
  misc_feature 339: k=g or t
  UNSURE 86: Xaa=Cys or Gly
acttcggtcctgagcgcttgggagttaggttgtttgccggcgtasggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaccccctataccacccgactaaccgtcggggtgatacttkgcatgatcgagatcgcattcatgttac

SEQ ID NO: 1850 - DNA, 260 bp, Homo sapiens
  CDS 39..260
  misc_feature 14: k=g or t
  misc_feature 174: n=a, g, c or t
  misc_feature 192: w=a or t
  misc_feature 193: y=c or t
  UNSURE 46: Xaa= *  or Gly or Arg
  UNSURE 52: Xaa=Ile or Leu or Ser or Thr
tagaaacttgtctkagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggangaaggtactctttgagcwyatcaaattcttccattgccgctcttctctgtgccctttatccgcacttcccagctcacagcactgac

SEQ ID NO: 1851 - DNA, 457 bp, Homo sapiens
  CDS 133..456
acacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttactt

SEQ ID NO: 1852 - DNA, 307 bp, Homo sapiens
  CDS 127..306
gactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacc

SEQ ID NO: 1853 - DNA, 384 bp, Homo sapiens
  CDS 205..384
attttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaa

SEQ ID NO: 1854 - DNA, 481 bp, Homo sapiens
  CDS 242..481
  misc_feature 158: s=g or c
  misc_feature 329: s=g or c
  misc_feature 444: n=a, g, c or t
  misc_feature 456: s=g or c
  UNSURE 30: Xaa=Glu or Gln
  UNSURE 68: Xaa=Ile or Asn or Ser or Thr
  UNSURE 72: Xaa=Ser or Thr
agttgacctttggtaagggggcaggtgcccagggccagaggcttctgcttcaggctgtagtgggcacttggctgccagcccagtgtgaaggggggaggatggagagaaagagaggcggggctggctggggaccgagtggctcagggataaatgcgcasctgagagggggtgagctgacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggcsaattccgagcagctgtgcccagtggggcttccacgggtatctatgaggctctggaactaagagacggagacaaaggccgctacctggggaaaggagtcctgaaggctgtggagancatcaacagtastctgggccctgctctgctgcaaaag

SEQ ID NO: 1855 - DNA, 362 bp, Homo sapiens
  CDS 107..361
  misc_feature 207: s=g or c
  misc_feature 360: n=a, g, c or t
  UNSURE 34: Xaa=Cys or Ser
  UNSURE 85: Xaa=Lys or Met or Arg or Thr
gatataagcccgggatcccgccgggtcaggttctctgctctggacttgggaggctccgttgcctgctcccggaggagacgcgctgccgaggagaacccagcgggtaatgaatcccccgcgcttctttgcccaggccttccccaaacctccccccggtctgcgcgggttctcctattgggctgtggtgaagacaaggtgcggcgactscagctccccaggtctgggcgctgccgggagagagtctttcccgctggggagatttagtttgttgactcaggagcacctccaacgacagctagtggcagaggacccgggagctgggaggttcggaacgcggggcgagctggggaggagggagangc

SEQ ID NO: 1856 - DNA, 298 bp, Homo sapiens
  CDS 105..296
atcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagataaatctgaatggaagagtgagccttaattttaaagaccccgaagcagtcagagctctgacgtgtactctcctaagggaagattttgg

SEQ ID NO: 1857 - DNA, 320 bp, Homo sapiens
  CDS 20..319
  misc_feature 88: s=g or c
  misc_feature 215: n=a, g, c or t
  UNSURE 23: Xaa=Asp or Glu
  UNSURE 66: Xaa=Asp or His or Asn or Tyr
gagtcattagaagcgcaagatggcgactgcggccgaaacctcggcttcagaacccgaggctgagtccaaggctgggcccaaggctgasggagaggaggatgaggttaaggcggctaggacaaggagaaaggtgttatcgcgggctgtggccgctgcgacatacaagaccatggggccagcgtgggatcagcaggaggaaggcgtgagcgagagcnatggggatgagtacgccatggcttcctccgcggagagctcccccggggagtacgagtggaatatgacgaagaggaggagaaaaaccagctggagattgagagact

SEQ ID NO: 1858 - DNA, 337 bp, Homo sapiens
  CDS 31..336
  misc_feature 25: w=a or t
ttggtttgctcgctcccttatgtgwgatcaatgctttcagaacaggggcttctgagtgactgcgggaacaattacttccaaatgacctcgtgcatcttatcagggagcattcagaccacaccccaggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagacc

SEQ ID NO: 1859 - DNA, 415 bp, Homo sapiens
  CDS 128..415
ggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaag

SEQ ID NO: 1860 - DNA, 362 bp, Homo sapiens
  CDS 56..361
  misc_feature 21: r=a or g
  misc_feature 24: s=g or c
  misc_feature 27: m=a or c
tgaggagaggagcggccggarcgsgamacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcacc

SEQ ID NO: 1861 - DNA, 360 bp, Homo sapiens
  CDS 82..360
  misc_feature 73: n=a, g, c or t
agaccgtagcgacgcgggaagtccggacgcagtagctccctgaagcggaggcgaaggggagtttaagccccancggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatatagg

SEQ ID NO: 1862 - DNA, 403 bp, Homo sapiens
  CDS 89..403
attctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgaccccagctacacccggagcgccgacctccccagcagaacaccgccttttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagtgagaatcaaggcattgccacctggggtatcgttgtcatg

SEQ ID NO: 1863 - DNA, 446 bp, Homo sapiens
  CDS 62..445
  misc_feature 331: n=a, g, c or t
  UNSURE 90: Xaa=Lys or Asn
gaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaanggaagctgcaagtggattcgaactcctgcaatcatctactctgttcacaccatgacaaccttaattccgatactctccacatttctgtttgaggatttctccaaagccaagtggt

SEQ ID NO: 1864 - DNA, 387 bp, Homo sapiens
  CDS 193..387
  misc_feature 73: s=g or c
  misc_feature 95: y=c or t
  misc_feature 117: y=c or t
  misc_feature 168: s=g or c
  misc_feature 182: s=g or c
  misc_feature 204: m=a or c
  UNSURE 4: Xaa= *  or Tyr
agaaacctggaagtggaaatctcgggcattcaccgtttgggtgaagacggaggcgggttctggacagacgtasgctgtcagggagtgtttacttygcctccacttctgttcctcccygccctggtgctgctccaggtcacatactcgtcctgagccggcttcagcctstccgcgcagaagtstcccggagccatggccgagtamtcttatgcgaagtctaccaagcttgtgctcaagggaaccaagacgaagaggtgggtcctgcacctccggcgggagcctcctcagttcttttcggacgcactccacccccctcgaatccggtggaagccgtggcgcggagagccggctttgtggcctcccaggctttgccctggcccctgtccg

SEQ ID NO: 1865 - DNA, 453 bp, Homo sapiens
  CDS 193..453
agaaacctggaagtggaaatctcgggcattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagtt

SEQ ID NO: 1866 - DNA, 484 bp, Homo sapiens
  CDS 169..483
  misc_feature 94: y=c or t
  misc_feature 423: s=g or c
  UNSURE 85: Xaa= *  or Tyr
cttccttcctgcgcctttatctgcatccgggtccgtgggattcgcgctccactggtcagctggggtcgctctcgggtggttgggtgttgcttgytcccgctgttccagcgtcgaagaaccattgggtctgccggtttgaacttgttctggaagctgtgcgtcaccgtaatgaggcttgtaattcttgataactatgacttggctagtgaatgggcagccaaatacatctgtaatcgcatcattcagttcaaacctggacaggacagatattttacactgggtttaccaacagggagtacacctttaggatgctataaaaaactaatagaatatcataagaatggacacctttcttttaaatatgtgaagacctttaatatggatgaatatgtaggacttccaagaaatcatcctgaaagctascattcttatatgtggaataatttttttaagcatatcgatatagatcctaataatgcacata

SEQ ID NO: 1867 - DNA, 432 bp, Homo sapiens
  CDS 108..431
  misc_feature 33: m=a or c
  misc_feature 392: n=a, g, c or t
  UNSURE 95: Xaa=Arg or Ser
atttagacccggtccaattgctggggctgcagmgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaaacaaaacatgatgacaagtactcgccgctgccctgcagcaaaatcatccagngggcggaggagctggtggggcaggaggtgctctacaagct

SEQ ID NO: 1868 - DNA, 447 bp, Homo sapiens
  CDS 84..446
  misc_feature 78: s=g or c
  misc_feature 101: n=a, g, c or t
  misc_feature 407: m=a or c
  UNSURE 6: Xaa=Arg or Ser
  UNSURE 108: Xaa=His or Gln
gagctcagtgggcgtcgcgcgaaggctaagggagtgtggcgggcggctccgggagccaacatgcctcggtatgcgcastggtcatgggccccgcgggcagngggaagagcacctactgtgccaccatggtccagcactgtgaagccctcaaccggtctgtccaagttgtaaacctggatccagcagcagaacacttcaactactccgtgatggctgacatccgggaactgatcgaggtggatgatgtaatggaggatgattctctgcgattcggtcccaacggaggattggtattttgcatggagtactttgccaataattttgactggctggagaactgtcttggccatgtagaggacgactatatcctttttgattgtccaggtcagattgagttgtacactcamctgcctgtgatgaacagctggtccagcagctcgagcagtg

SEQ ID NO: 1869 - DNA, 442 bp, Homo sapiens
  CDS 245..442
  misc_feature 83: y=c or t
  misc_feature 84: k=g or t
agccaagccccagcatgttgtgttctgtcctctggctggcagattcacgccacaacagtttattcatccacatgctttttggykactcttcatcacgtatttgggcttagatcttctggtgcctccctcggcgtgctacccataaggtcgaaagaaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagg

SEQ ID NO: 1870 - DNA, 393 bp, Homo sapiens
  CDS 196..393
acaaagatttcctctgctgagtaagcgtgaggccccttaacttgtgaaagcatcatccagaccgtgtgagtctgtctgtgtatgtgcagaacacagaccctcctttctccgtttgtggggaatacttccctcgggtgaaactgaagttaatttttttttttttccaaacacaagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagg

SEQ ID NO: 1871 - DNA, 412 bp, Homo sapiens
  CDS 215..412
  misc_feature 147: m=a or c
agtcagtaaaagttgattacaagtaacgataaagttagatttttagtacttaattttaaaatttctttattaaatagtaaatttgttcttaatataaatggtactatctactcttgttttattgcatatcagaaataattaaaagamcaatgtgttcaatgcagagtataatcaagcgatttatatattatggcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagg

SEQ ID NO: 1872 - DNA, 433 bp, Homo sapiens
  CDS 64..432
  misc_feature 92: m=a or c
  misc_feature 101: k=g or t
  misc_feature 161: y=c or t
  misc_feature 377: r=a or g
  misc_feature 387: n=a, g, c or t
  misc_feature 388: k=g or t
  misc_feature 403: r=a or g
  misc_feature 424: s=g or c
  misc_feature 430: s=g or c
  UNSURE 10: Xaa= *  or Ser
  UNSURE 13: Xaa=Gly or Val
  UNSURE 33: Xaa=Leu or Pro
  UNSURE 105: Xaa=Glu or Gly
  UNSURE 109: Xaa=Phe or Val
  UNSURE 114: Xaa=Gly or Arg
  UNSURE 121: Xaa=Ala or Pro
  UNSURE 123: Xaa=Ala or Pro
atacagtcatcctagcagtccccgctgaagtggagcaggtacagtcacagctgtggggacagcatgctggccaagggtcttcccccacgctmagtcctggkcaaaggctgccagacctttctgagtgcccccagggaggggctggggcgtctcagggtgcycactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgragatgtggcnktctctttaagtccgrgggcccaacccagaacgattsctcatsccg

SEQ ID NO: 1873 - DNA, 457 bp, Homo sapiens
  CDS 162..455
aaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaa

SEQ ID NO: 1874 - DNA, 828 bp, Homo sapiens
  CDS 674..826
  misc_feature 118: y=c or t
  misc_feature 570: y=c or t
  misc_feature 603: r=a or g
  misc_feature 616: n=a, g, c or t
  misc_feature 657: m=a or c
acaagcgctccgtcccttctagaggcaggcagagggaagagaaagggtctgttgtttttctctcctgtttctcgctccctctctgctgatcacaaagctgctgaccgggtcagaaagycctgatggaaatccaccagcgctgggcaggcccctcctcctccagggagcttgtccttgcctaatttttcttcgtcctgatgagaacaaaaaagagagagagaagaaaagaaaaaccacaaacttcctttgaaaaccagcttgtagtcagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcayccccttctttaaggtcactcttttgcatcccargccctggcttagncaagtccctgaggttagtaaacaccttcagtgcccctcagmcgagtcccttttgaccatggaataccatcagcctgaggatccagcccctggtaaggccgggactgcagaagcagtcatccctgaaaaccatgaggttctggcaggcccagatgagcaccctcaggacacagatgcaagagatgctgatggggaggctagagaaacgggagc

SEQ ID NO: 1875 - DNA, 533 bp, Homo sapiens
  CDS 85..531
aagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtg

SEQ ID NO: 1876 - DNA, 441 bp, Homo sapiens
  CDS 174..440
  misc_feature 54: s=g or c
  misc_feature 144: r=a or g
  misc_feature 146: m=a or c
  misc_feature 150: s=g or c
  misc_feature 409: n=a, g, c or t
  misc_feature 424: n=a, g, c or t
  misc_feature 427: n=a, g, c or t
  misc_feature 429: n=a, g, c or t
  misc_feature 436: y=c or t
  UNSURE 79: Xaa=Leu or Pro or Gln or Arg
  UNSURE 84: Xaa=Leu or Pro or Gln or Arg
  UNSURE 85: Xaa=Leu or Pro or Gln or Arg
  UNSURE 86: Xaa=Phe or Ile or Leu or Val
  UNSURE 88: Xaa=Ala or Val
atcagcaatatacaattataaaggcccaaaattaaaaaaagagagaccgaaatstccccctcccaaaatcgctccattacataaatcggggggggtgcaggagggggggtcccttccgatcctccctcctgacgccccccccargmaggscccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgcngccgccaccgccgcngcnantccccgytgccc

SEQ ID NO: 1877 - DNA, 394 bp, Homo sapiens
  CDS 70..393
  misc_feature 360: m=a or c
  UNSURE 97: Xaa=His or Gln
gtggaggaacttccggcagcggcagctcaagtggccaaggcaagatgggtcaaagtcagagtggtggtcatggtcctggaggtggcaagaaggatgacaaggaccatgaccacctctctgtaccgagctcagcagatcatccagctcaacatccaagcttcccctaaagtacgactgagcttggcaaacgaagctctgctgcccaccctcatctgcgacattgctggctattaccctggatgtggtggtgacgtggacccgagaggagctgggtggatccccagcccaagtctctggtgcctccttctccagcctcaggcaaagcgtggcaggcacctacagcatctcctcctctctcamcgcagaacctggctctgcaggtgccacttacacc

SEQ ID NO: 1878 - DNA, 214 bp, Homo sapiens
  CDS 39..212
agcgggactggaacctagtacacttcggcagttgagaaatgacttaccaggacaaatactgcttctggctcgatggtgctgcccatgaacatccgccggctctgagaacgagctgcactgtcagtgagaaaccgtgggcactgagaaacgagcggactgcaactgataactgcccacccagtgccactacgacaaagtgctgctggcactactc

SEQ ID NO: 1879 - DNA, 457 bp, Homo sapiens
  CDS 194..457
gtgccctgcgcctcagcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcac

SEQ ID NO: 1880 - DNA, 486 bp, Homo sapiens
  CDS 112..486
  misc_feature 18: r=a or g
  misc_feature 52: n=a, g, c or t
  misc_feature 53: y=c or t
accaccgctgctcctcargaggcgcctcaccagcctccacaccccttgcgcnygcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacacc

SEQ ID NO: 1881 - DNA, 348 bp, Homo sapiens
  CDS 150..347
  misc_feature 332: k=g or t
atttttttcggacctgcgacttccgaacaaccctggcaggaggagcggcgttcagccgggggaggcctgaagaaacgctccggggcccagtggctctacccctgctcctgcccgaccctgccgcctccctcacggagccagcggccggaatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgtkcgatacttgctcaggt

SEQ ID NO: 1882 - DNA, 372 bp, Homo sapiens
  CDS 138..371
  misc_feature 81: m=a or c
  misc_feature 88: n=a, g, c or t
  misc_feature 191: k=g or t
  misc_feature 371: r=a or g
  UNSURE 18: Xaa=Phe or Leu
ttgtcaaattaagggtgtcattgtgttgtgctaaacgctgggagggtacaagttggtcattcctaaatctgtgtgtgagamatggcanggtctagtttgggcattgtgattgcattgcagattactaggagaagggaatggtgggtacaccggtagtgctcttttgttcttgcttcgtttttttaaacttkaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaarg

SEQ ID NO: 1883 - DNA, 487 bp, Homo sapiens
  CDS 109..486
  misc_feature 482: w=a or t
  UNSURE 125: Xaa=His or Leu
cttcccagttaaaagtgttggcccgcggcgcgcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacaagtggtccccgggaggacwcgcat

SEQ ID NO: 1884 - DNA, 547 bp, Homo sapiens
  CDS 31..546
  misc_feature 362: w=a or t
  misc_feature 429: r=a or g
  misc_feature 430: k=g or t
  misc_feature 431: n=a, g, c or t
  misc_feature 497: r=a or g
  UNSURE 111: Xaa=Ile or Lys
  UNSURE 134: Xaa= *  or Ala or Glu or Gly or Leu or Ser or Val
  UNSURE 156: Xaa=Lys or Arg
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagawacacactaacgcagaaaaaaagttggcagacagggaaagcgctctagcgagtgctgatttagaagarknaattcaccagaaacaagggcagaaaaggaaaaattctcaacctggtgttaaagtagcagatagaaraatacttgatgacacagaagacacagttgtcagtcaaagaaagaaaattc

SEQ ID NO: 1885 - DNA, 330 bp, Homo sapiens
  CDS 31..330
  misc_feature 224: y=c or t
  UNSURE 65: Xaa=Leu or Pro
agctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagcyccagattcaacccgtgtacgtgcctgtgcctaaagtaagtcactgggctttcttcccgaatagctcgttagaaccacttacatacaaagcaatcttcttacctacc

SEQ ID NO: 1886 - DNA, 462 bp, Homo sapiens
  CDS 40..462
gcgcggctggtgtccgcccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgta

SEQ ID NO: 1887 - DNA, 488 bp, Homo sapiens
  CDS 120..488
  misc_feature 408: s=g or c
  misc_feature 409: n=a, g, c or t
  UNSURE 97: Xaa=Ala or Asp or Gly or His or Leu or Pro or Arg or Val
aagcgcgcacctttgcgcacgcgcacgaacgcacggccgcgcacatctgtcttgctggaagctttttcctagaggttgagcggtttgcacaatgtcggaaatggctgagttgtccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagcgsntcttgaagaagccgacaagatgtttctgagaacaagagaaccagcctggatggcgggtttcagatgcattatgagaaga

SEQ ID NO: 1888 - DNA, 492 bp, Homo sapiens
  CDS 28..492
  misc_feature 333: k=g or t
  misc_feature 334: m=a or c
  misc_feature 335: n=a, g, c or t
  misc_feature 336: n=a, g, c or t
  UNSURE 102: Xaa=Lys or Asn
  UNSURE 103: Xaa=His or Ile or Lys or Leu or Met or Asn or Pro or Gln or Arg or Ser or Thr
agaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaagcagcaccgagagaaagtggccgagctgaaaggcgcgaaggaagccagccagggttcgtccgccagttcagcgcctcagtccgtcaakmnnaaagcgccggacgcagacgaccaagatgtcaagagagcgaaggccaccttggtgcctcaggtacagccctccacatctgcgtggaccaccaactttgacaaaataggaaaggagttcattagagcgactcccagtaagccttcaggactcagttta

SEQ ID NO: 1889 - DNA, 418 bp, Homo sapiens
  CDS 135..416
gtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgt

SEQ ID NO: 1890 - DNA, 396 bp, Homo sapiens
  CDS 77..394
ctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaacccca

SEQ ID NO: 1891 - DNA, 313 bp, Homo sapiens
  CDS 107..313
  misc_feature 87: y=c or t
  misc_feature 299: y=c or t
  UNSURE 65: Xaa=Pro or Ser
aagtagagcggaggtggtggcggcggaggctttggcagctcgggactgagtgcaaggaatatgcactgaagaggcagcgaacctacyaacctttggccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagtycagagtatcagcaa

SEQ ID NO: 1892 - DNA, 407 bp, Homo sapiens
  CDS 97..405
aggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccaga

SEQ ID NO: 1893 - DNA, 229 bp, Homo sapiens
  CDS 74..229
  misc_feature 20: s=g or c
attttgttcgcgcggaagcscgcggtagggtgggaacccaagcgggagagccgcgggatttgcggccgccgccatgccgtcgtccccgctgcgggtggcggtggtgtgctcgagcaaccagaaccggagcatggaggcgcacaacatcctcagcaaacggggattcagcgtccgatcctttggaacagggactcacgtgaagcttccaggaccagctcccgacaagccc

SEQ ID NO: 1894 - DNA, 478 bp, Homo sapiens
  CDS 90..476
  misc_feature 477: m=a or c
  misc_feature 478: m=a or c
accaacgacggggacgctgggaagccgacttccggcgccctattttctcacctggttcccgcggcgagccagcggcagcgtcggcggcgatgagacagaagcactaccttgaggctgcagcgcggggactgcacgacagctgcccgggccaagcccgctacctcctctgggcctacacttcgtcgcacgatgataagagcacttttgaagaaacgtgtccatactgtttccagctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgcaagagcaatcctgcmm

SEQ ID NO: 1895 - DNA, 531 bp, Homo sapiens
  CDS 169..531
aaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctactt

SEQ ID NO: 1896 - DNA, 305 bp, Homo sapiens
  CDS 32..304
tcaaagcctctgtcaccacaccaaaatacaaatggggatctgtgactcatcagagtgtgggggttgtgaaaggtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggcttcagcagaagaaacacttcctataaatctcgcccaaacaggaaagtccagtttttttcctgcagcaaacctgaaaatacactatcctcca

SEQ ID NO: 1897 - DNA, 393 bp, Homo sapiens
  CDS 180..392
  misc_feature 346: s=g or c
  UNSURE 56: Xaa=Ser or Thr
acctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttgcggtgcagaggggcaggatgccgccgacccagccgacccacgggcagttcgcgctgaccaacggggatccctcaactgccactcgtacctgtccggatatatttccctgctgttgcgcgcggascctatcccacgtcgcgcttcggcagccaatgcatgcagcccaacaac

SEQ ID NO: 1898 - DNA, 372 bp, Homo sapiens
  CDS 158..370
tttttccgtggatctatcaattcacaattcgaatttggaagaaagaaggaaaacatgacgtctccagccaaattcaaaaaggataaggagatcatagcagagtacgatactcaggtcaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagt

SEQ ID NO: 1899 - DNA, 374 bp, Homo sapiens
  CDS 12..374
cagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaa

SEQ ID NO: 1900 - DNA, 482 bp, Homo sapiens
  CDS 296..481
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttggggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggca

SEQ ID NO: 1901 - DNA, 589 bp, Homo sapiens
  CDS 424..588
  misc_feature 476: m=a or c
  misc_feature 506: w=a or t
  misc_feature 581: m=a or c
  UNSURE 18: Xaa=Asn or Thr
  UNSURE 28: Xaa=His or Leu
  UNSURE 53: Xaa=Ser or Tyr
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcamccaagctagagtgcagtggcctttgaagcwtactacagcctcaaacttctgggctcaagtgatcctcagcctcccagtggtctttgtagactgcctgatggagtmtcatggca

SEQ ID NO: 1902 - DNA, 675 bp, Homo sapiens
  CDS 489..674
  misc_feature 362: k=g or t
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctakagagcaagcctaactcaagccattggcacacaggcattagacagaaagctggaagttgaaatggtggagtccaacttgcctggaccagcttaatggttctgctcctggtaacgtttttatccatggatgacttgcttggggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggca

SEQ ID NO: 1903 - DNA, 782 bp, Homo sapiens
  CDS 617..781
  misc_feature 362: k=g or t
  misc_feature 669: m=a or c
  misc_feature 699: w=a or t
  misc_feature 774: m=a or c
  UNSURE 18: Xaa=Asn or Thr
  UNSURE 28: Xaa=His or Leu
  UNSURE 53: Xaa=Ser or Tyr
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctakagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcamccaagctagagtgcagtggcctttgaagcwtactacagcctcaaacttctgggctcaagtgatcctcagcctcccagtggtctttgtagactgcctgatggagtmtcatggca

SEQ ID NO: 1904 - DNA, 821 bp, Homo sapiens
  CDS 656..820
  misc_feature 362: k=g or t
  misc_feature 708: m=a or c
  misc_feature 738: w=a or t
  misc_feature 813: m=a or c
  UNSURE 18: Xaa=Asn or Thr
  UNSURE 28: Xaa=His or Leu
  UNSURE 53: Xaa=Ser or Tyr
atcaaaagaactcttatatacaggagcccaggcaccatactgtcttttcgaggtaggagtcgactcctgtgaggtatggtgctgggtgcagatgcagtgtggctctggatagcaccttatggacagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctakagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcamccaagctagagtgcagtggcctttgaagcwtactacagcctcaaacttctgggctcaagtgatcctcagcctcccagtggtctttgtagactgcctgatggagtmtcatggca

SEQ ID NO: 1905 - DNA, 504 bp, Homo sapiens
  CDS 329..502
  misc_feature 84: w=a or t
agtgaacccggaagtgcttcgcggcggaggcccgggcaactcttttgaatggaatcgggctgattcatcgccggtttgcagacwgagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttgg

SEQ ID NO: 1906 - DNA, 297 bp, Homo sapiens
  CDS 39..296
agtgcgacagacagcctcagagctggtggggagacagcatgccactggaaaaattcgtagacatggaattcctggatcaaatgatactaagggggacttgcctggaagcagacttgtgtccgcagtatacaaactcaccctttaatgcacacactgaccagataacacaaacacatttacccccacagcacctagactcttctcacagtacacacacttgccttccagtacacagacatatccaaaggcacaccgacaagcaccacagcaaaaagatgttccccagaacacatggac

SEQ ID NO: 1907 - DNA, 444 bp, Homo sapiens
  CDS 52..444
  misc_feature 10: k=g or t
  misc_feature 11: n=a, g, c or t
gtattggcaknagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttat

SEQ ID NO: 1908 - DNA, 314 bp, Homo sapiens
  CDS 143..313
  misc_feature 121: s=g or c
  misc_feature 130: n=a, g, c or t
  misc_feature 311: w=a or t
  UNSURE 57: Xaa=Arg or Trp
atgcttggggaaggaacttcctgtaagcaaggcttgaggcttgctctcgccttcgtcagcagccctcctcaatcttctccaaactcccgtccccaggccacacagattctcctcaagagasccctataangacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaaagatggagatgcagcaatgcawggt

SEQ ID NO: 1909 - DNA, 266 bp, Homo sapiens
  CDS 98..265
ggaaggggcggggcgcagataggggtagcctggaggcctgcagtccgcgcggccgcggggagggacgagagggcctgacgtacagattataagcgccatggctatggctagtgttaaattgcttgccggtgttttaagaaagccagatgcctggattggactctggggtgttctccgagggacaccttcatcatacaaactctgtacttcctggaatcgatacttgtatttttctagtaccaagttacgtgcaccaaattataaaa

SEQ ID NO: 1910 - DNA, 388 bp, Homo sapiens
  CDS 154..387
  misc_feature 261: r=a or g
  misc_feature 263: n=a, g, c or t
  UNSURE 37: Xaa=Leu or Pro or Gln or Arg
acaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccrcngattgtgcaggctgcgtcttcagcaccagcacttgaaactgactcttcccctccaccatatagtagtattactgtggaagtacctacaacttcagatacagaagtttacggtgagttttatcccg

SEQ ID NO: 1911 - DNA, 366 bp, Homo sapiens
  CDS 153..365
aggagtaggacctttaggggtgggagtggggaaggagaggtttggggctaagtcttactgaggtagcgctgccccaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggaccctgatcgctgtgagagctgctatggtgctgagg

SEQ ID NO: 1912 - DNA, 458 bp, Homo sapiens
  CDS 279..458
  misc_feature 15: n=a, g, c or t
  misc_feature 16: n=a, g, c or t
agctttctgtgcgcnngttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctg

SEQ ID NO: 1913 - DNA, 432 bp, Homo sapiens
  CDS 73..432
  misc_feature 329: n=a, g, c or t
  misc_feature 330: n=a, g, c or t
  misc_feature 331: w=a or t
  misc_feature 375: n=a, g, c or t
  misc_feature 376: r=a or g
  misc_feature 377: n=a, g, c or t
  misc_feature 378: k=g or t
  misc_feature 409: n=a, g, c or t
  misc_feature 410: n=a, g, c or t
  UNSURE 86: Xaa=Ala or Asp or Glu or Gly or Val
  UNSURE 87: Xaa= *  or Lys
  UNSURE 101: Xaa=Arg or Ser
  UNSURE 102: Xaa=Ala or Asp or Glu or Gly or Ile or Lys or Met or Asn or Arg or Ser or Thr or Val
  UNSURE 113: Xaa=Ala or Cys or Asp or Phe or Gly or His or Ile or Leu or Asn or Pro or Arg or Ser or Thr or Val or Tyr
cgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggnnwaggcacagcagctgcgcaaggaggagcggactgggagcagaagnrnkgaggagatgcgcaagaaggagaagagcatgnntggaacgtggacacgctcagca

SEQ ID NO: 1914 - DNA, 333 bp, Homo sapiens
  CDS 73..333
cgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagcccctcccagcctacccctcctg

SEQ ID NO: 1915 - DNA, 440 bp, Homo sapiens
  CDS 92..439
aagtttgttggctgcggcagcaggctagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctaca

SEQ ID NO: 1916 - DNA, 313 bp, Homo sapiens
  CDS 35..313
  misc_feature 260: k=g or t
  UNSURE 76: Xaa= *  or Glu
tcagtgagtagtgcagaggtgtccctaacttccaatggagggaaagagaggagagcaaaggaaacacatccagaagtcgccacgagggctgtgtgccagcgctccattttcatgctgtttggaacaaggcgtgtcaaggaagatgtttctatccaaagttttcatggagcctctgcttcccctgtacctgtgtagctccctgaaactgaggacccacgtgtctgcaaagacctctggagatcctaagagagagaggcackagcaggtaaccagtggtggcctggccacgaaagagtatttgaaattcaacagt

SEQ ID NO: 1917 - DNA, 217 bp, Homo sapiens
  CDS 37..216
  misc_feature 49: r=a or g
  UNSURE 5: Xaa=Ala or Thr
gcagatgacgtgcggctcgtggggcagctcggcagcatggcgtccgtgrcgctgagcgaggcggagaaggtgtacatcgtgcatggcgtccaggaagacctccgtgtggatggccgtggctgtgaggactaccgatgtgtcgaagtggaaactgatgtggtgtccaacactagtgggtccgccagggtcaagctgggtcacacagacatcttggtgg

SEQ ID NO: 1918 - DNA, 493 bp, Homo sapiens
  CDS 178..492
  misc_feature 455: w=a or t
  UNSURE 93: Xaa= *  or Leu
agagtttacaaaggtctaggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagcttwgaatgactcagtgaagacgtcaatgcactgggttgtca

SEQ ID NO: 1919 - DNA, 345 bp, Homo sapiens
  CDS 63..344
aaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccacc

SEQ ID NO: 1920 - DNA, 471 bp, Homo sapiens
  CDS 156..470
aaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaact

SEQ ID NO: 1921 - DNA, 398 bp, Homo sapiens
  CDS 109..396
  misc_feature 6: n=a, g, c or t
  misc_feature 40: s=g or c
acctgncgcacttgacagcccgctgaggacgcagcgtcastgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcct

SEQ ID NO: 1922 - DNA, 363 bp, Homo sapiens
  CDS 119..361
  misc_feature 31: w=a or t
  misc_feature 50: s=g or c
  misc_feature 51: s=g or c
  misc_feature 304: m=a or c
agatatttaaaggcgtcggcgccacgcgcawatccctgctcggcgctgcssgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtmctcattgagaccctcgtcaccctgggtgctgaggtgcagtggtccagctgcaacatctt

SEQ ID NO: 1923 - DNA, 390 bp, Homo sapiens
  CDS 80..388
  misc_feature 20: s=g or c
  misc_feature 135: n=a, g, c or t
  misc_feature 262: r=a or g
  misc_feature 337: n=a, g, c or t
  misc_feature 373: n=a, g, c or t
  misc_feature 380: y=c or t
  UNSURE 19: Xaa=Ala or Glu or Gly or Val
  UNSURE 61: Xaa= *  or Trp
  UNSURE 86: Xaa= *  or Cys or Trp
aagttgaccggggtgcggastcctgggctgcagctcctggagtttccgaggttcgtgcgcgtctggtggcggcggcgtgatgttctcggcaggagcggagagtttgctccaccaggccagggagatccaggacgnggagctgaagaagttctgttcccggatctgtaaactgctgcaggcggaggacttggggccggacaccctcgactccctgcagaggctcttcctcatcatctcagccacgaagtacagccggaggtgraagaagacatgcgtagacctgctgcaggccaccctcggcctgcctgcatgccccgagcagctccaggtgctttgngcgccatcctgcgagagatgtccccctctgacagcntcagccytgggcctgag

SEQ ID NO: 1924 - DNA, 548 bp, Homo sapiens
  CDS 312..548
  misc_feature 178: n=a, g, c or t
  misc_feature 512: k=g or t
  UNSURE 67: Xaa=Ile or Met
gttttagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggagggagnccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacgccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatkccttcccaagagcctccagtagacgacaagaacgag

SEQ ID NO: 1925 - DNA, 306 bp, Homo sapiens
  CDS 61..306
gagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagagc

SEQ ID NO: 1926 - DNA, 225 bp, Homo sapiens
  CDS 24..224
  misc_feature 34: m=a or c
  misc_feature 211: m=a or c
  misc_feature 212: y=c or t
  UNSURE 4: Xaa=Pro or Gln
  UNSURE 63: Xaa=Asn or Thr
gcttgtgaaactggaaggctgccatggctagccmagccgcctcctcggtgcgaccaccgaggcccaagaaagagccgcagacgctcgtcatccccaagaatgcggcggaggagcagaagctcaagctggagcggctcatgaagaacccggttcaagtgctggggccggcagtggagagttccacgtgtacagacatctgcgccggagagamyatcagcgacagga

SEQ ID NO: 1927 - DNA, 436 bp, Homo sapiens
  CDS 188..436
  misc_feature 316: m=a or c
  UNSURE 43: Xaa=Phe or Leu
gacttgttctgtgttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaacatgactgagttctggcttatatctgctcctggggagaaaacctgtcagcaaacatgggagaaattgcatgcggcaacttcaaagaacaataatcttgctgtcacttccaagttcaatattcctgacttmaaggttggcacgttggatgtcttggttggcttgtcagatgaactggctaaactggatgcatttgtagaaggagtggttaagaaagtagctcaatacatggctgatgtattggaagatagc

SEQ ID NO: 1928 - DNA, 485 bp, Homo sapiens
  CDS 176..484
  misc_feature 138: r=a or g
  misc_feature 170: k=g or t
aagctctttgcggtggcgttggtgctgtttgcggatgctgatgcagtttctgcaggactgtaaactggattcctggaacctttgatattcctggctgtgtatagtgcctgttggtggactgtactgatactccaactrgagtgtgaagggactggattcctgcccctgakacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattt

SEQ ID NO: 1929 - DNA, 259 bp, Homo sapiens
  CDS 87..257
  misc_feature 79: r=a or g
  misc_feature 146: w=a or t
  misc_feature 257: y=c or t
actaattaaatgccatctgggtggttcctctgggtttttgagtccatcacccagttcagatcgagtcagaggccaaggrggagaacatgatgatggacctttttgaaactggctcctatttcttctacttggatggggaaaatgtwactctgcagccattagaagtggcagaaggctctcctttgtatccagggagtgatggtaccttgtccccctgccaggaccaaatgcccccggaagcggggagcgacagcagygg

SEQ ID NO: 1930 - DNA, 450 bp, Homo sapiens
  CDS 86..448
  misc_feature 373: r=a or g
cagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaargaaacagagaccctcctggatgacttccttctcacgtacactgtcttcatgacaactgatgacttgtgccaggctct

SEQ ID NO: 1931 - DNA, 391 bp, Homo sapiens
  CDS 159..389
  misc_feature 150: k=g or t
gtagctccataatcaagggctgtccaagggaaactgggtcccttgaagaatctacagatgagtctgaggaagaagagagcgaagaggaacccaagctgaagtatgaaaggctttccaatggggtaactgaaatacttcagaaggatgcakctagctgcatgacagtccatgacaagtttttggcattgggcacacattatggcaaggtttatttacttgatgtccaggggaacatcactcagaagtttgatgtaagtcctgtgaagataaatcagattagcttggatgaaagtggagagcacatgggtgtgtgttcagaggatggcaaggtgcaggtatttggactgtattctggagaagaatttcacgagacttttgactgtcccattaa

SEQ ID NO: 1932 - DNA, 376 bp, Homo sapiens
  CDS 213..374
  misc_feature 5: w=a or t
  misc_feature 258: r=a or g
  UNSURE 16: Xaa=Gly or Ser
ctctwcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccargcccggaggacgaggactccagcctggatgaatctgacctctatagcctggcccattcctacctcggtaaggcccactcagccatctccacggtccttcctcctctcccgaaatcagg

SEQ ID NO: 1933 - DNA, 340 bp, Homo sapiens
  CDS 41..340
  misc_feature 170: r=a or g
  UNSURE 44: Xaa=Ile or Val
ggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcrttgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagattcag

SEQ ID NO: 1934 - DNA, 482 bp, Homo sapiens
  CDS 53..481
  misc_feature 431: n=a, g, c or t
  misc_feature 432: n=a, g, c or t
  UNSURE 127: Xaa= *  or Ala or Glu or Gly or Lys or Leu or Met or Pro or Gln or Arg or Ser or Thr or Val or Trp
ccctcgcctcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaacctnnggcaagttcctcaactctctgtgtcttcgtaccctcatctgtacatgcgt

SEQ ID NO: 1935 - DNA, 324 bp, Homo sapiens
  CDS 54..323
ccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaacaccctagtagctgggattacaggtgcgtgccaccacacccagctgatttttatatttttagtaaagacggggtttcaccatgttggccaggctagtcacgaactcctgacctcaggtgatccacccgcctcagcctcccaaagtgctgggattacaggcatgaaccactgtgcccaggggc

SEQ ID NO: 1936 - DNA, 393 bp, Homo sapiens
  CDS 54..392
ccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccagcgagtggggttattttcgttaatgttagtaa

SEQ ID NO: 1937 - DNA, 310 bp, Homo sapiens
  CDS 91..309
  misc_feature 89: r=a or g
  misc_feature 108: k=g or t
  misc_feature 110: r=a or g
  misc_feature 159: k=g or t
  misc_feature 189: n=a, g, c or t
  misc_feature 240: s=g or c
  misc_feature 265: s=g or c
  misc_feature 282: s=g or c
  misc_feature 302: k=g or t
  UNSURE 6: Xaa=Ile or Met
  UNSURE 7: Xaa=Glu or Gly
  UNSURE 33: Xaa=His or Gln
  UNSURE 50: Xaa=Cys or Trp
  UNSURE 59: Xaa=Ala or Pro
  UNSURE 64: Xaa=Lys or Asn
  UNSURE 71: Xaa=Met or Arg
aggcttaactaccaccatctcctcgcgggcagtgggggcaaccgcgaagacagaatttcacaaactttcagctccagcagtttcaaggraatgtcaaatgacaagatkgragaccgagtgtcaagagctaagacaacaaaaaggcccccaaaatttgtkttcaagaaaaccaatgaaaaaagcaagcantcagaacgtgaagtccaggatcatggatgtgcttatcttcacagtcactgstgggtcctgaagttctcctctggcscagtgccagctgcgaascctctgccaaagggccagakgaggccgg

SEQ ID NO: 1938 - DNA, 225 bp, Homo sapiens
  CDS 49..225
cagctactagaggacgcccgttccaatggcaactctgccaaggcgcctatgagagcctcttggcttttacctggtctgcgagaaatcaaactttgggcacaagtcatgaagccgacaagcccgggagacacagtgtcagaattacaaggtcccgcatctggggctcgatctcgtgcagaggagcatttccgaagacactggccgctcccacaatggctccgaagc

SEQ ID NO: 1939 - DNA, 360 bp, Homo sapiens
  CDS 134..358
  misc_feature 14: m=a or c
  misc_feature 15: r=a or g
aaaagttcagcccmrcccccgcttccccctcgctgtctccctcggcctgtgccgccgccgacgccgcttgtgggcccgactccgctctgtctgcttcgccaccttctccccgagcactgcccggccggccgccatggctaacatggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcggga

SEQ ID NO: 1940 - DNA, 690 bp, Homo sapiens
  CDS 310..690
  misc_feature 508: n=a, g, c or t
  UNSURE 67: Xaa=Asp or His or Asn or Tyr
gaggacctgaacaagtccagaagggaagagatttgtccctctatccaacagagtacccagtgagcagcacagagggcacagcaagggacatcacccggttccccaaatgctcagagccacaagtgaagccaaaagtgaaagacaagatgcagaaaaccgccacgggcctttgaggaagggtaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcgnacaagagctgcgagaagatccacttcatcgcccccaaaatctactgctgtggggctggagtagccgcggacgccgagatgaccacacggatggtggcgtccaagatggcgctacacgcgttatctacgggccgcgagccccgcgtggccacggtcactcgcatcctgcgccagacgctcttc

SEQ ID NO: 1941 - DNA, 512 bp, Homo sapiens
  CDS 117..512
  misc_feature 29: k=g or t
  misc_feature 113: s=g or c
ctattcagctgggaggagggagaggggakgagaaggggagggccgcgggaggagggtacgagtggccgaccacggatttgcattgccgaggacgggaccccagggcagcgaasagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcat

SEQ ID NO: 1942 - DNA, 366 bp, Homo sapiens
  CDS 54..365
  misc_feature 202: y=c or t
  UNSURE 50: Xaa=Phe or Ser
aagtgctttagactgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtycattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggac

SEQ ID NO: 1943 - DNA, 433 bp, Homo sapiens
  CDS 170..433
ttccgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctt

SEQ ID NO: 1944 - DNA, 430 bp, Homo sapiens
  CDS 95..430
  misc_feature 15: r=a or g
  misc_feature 74: y=c or t
  misc_feature 75: r=a or g
  misc_feature 78: y=c or t
gacttggcggtgggrgccggagcctgcttgttgcagctgtgggtgaggacggctctagctaggtgagcggctcyrgcyagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttgtcaggttgattatcgagcaaaactttgggcctgtaatttctgttttcaaagaaatcagtttcctccagcttatggaggcatatctgaggtgaatcaacctgccgaattgatgccc

SEQ ID NO: 1945 - DNA, 379 bp, Homo sapiens
  CDS 116..379
aattttacgtggtgctgcatttccggtagcggcggcgggaaatcggctgtgggagagaggctaggcctctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggggttcatcactgaccatcagagaaatgcaagtcaaaaccac

SEQ ID NO: 1946 - DNA, 339 bp, Homo sapiens
  CDS 156..338
  misc_feature 53: r=a or g
agaccggcggcggacacgcgtgtgtgcggacgcagttgcgtgaggggtttgtrctatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatcc

SEQ ID NO: 1947 - DNA, 261 bp, Homo sapiens
  CDS 104..259
  misc_feature 259: w=a or t
gtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcwga

SEQ ID NO: 1948 - DNA, 381 bp, Homo sapiens
  CDS 13..381
aaaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttct

SEQ ID NO: 1949 - DNA, 467 bp, Homo sapiens
  CDS 94..465
  misc_feature 230: r=a or g
  UNSURE 46: Xaa=Gln or Arg
ttttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacratctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggc

SEQ ID NO: 1950 - DNA, 331 bp, Homo sapiens
  CDS 54..329
  misc_feature 26: s=g or c
  misc_feature 27: n=a, g, c or t
  misc_feature 279: y=c or t
  misc_feature 310: k=g or t
  UNSURE 86: Xaa=Met or Arg
aatcggaagtggctgcgtcgtcgacsntgggctttcgggtcccgcgcccagagatgggctccaaggcaaagaagcgcgtgctgctgcccacccgcccagcgccccccacggtggagcagatcctggaggatgtgcggggtgcgccggcagaggatccagtgttcaccatcctggccccggaagaccccccagttcccttcaggatgatggaggatgcggaggccccgggagagcagctctaccagcaaagccgggcctacgtggctgccaaccagcggytgcagcaggcgggcaacgtgctgaggcagakgtgtgagctcctgcagcgtgc

SEQ ID NO: 1951 - DNA, 417 bp, Homo sapiens
  CDS 55..417
  misc_feature 12: n=a, g, c or t
  misc_feature 13: n=a, g, c or t
  misc_feature 93: y=c or t
  misc_feature 100: k=g or t
  misc_feature 153: k=g or t
  misc_feature 154: k=g or t
  misc_feature 221: k=g or t
  misc_feature 382: n=a, g, c or t
  UNSURE 16: Xaa=Ala or Ser
  UNSURE 33: Xaa=Asp or Glu
  UNSURE 34: Xaa=Asp or Tyr
  UNSURE 56: Xaa=Gly or Val
  UNSURE 110: Xaa= *  or Gly or Arg
gaatcggaagtnnctgcgtcgtcgacgctgggctttcgggtcccgcgcccagagatgggctccaaggcaaagaagcgcgtgctgctgcccacycgcccakcgccccccacggtggagcagatcctggaggatgtgcggggtgcgccggcagakkatccagtgttcaccatcctggccccggaaggtagggggagcccggtcccggggaaaagcggacctgkaaccccggcagcaaggggacgggagagaagcacacccctaactcctgaccccacgccctgggaacccccgcaacatgggcacggtccgtatcctctccgagtctccctctactcctccgtagagtgggaccgattttcagagggttcttctgacaggggtngaggccgggcgctgtggttcaggcctgtaagccca

SEQ ID NO: 1952 - DNA, 295 bp, Homo sapiens
  CDS 54..293
  misc_feature 120: r=a or g
  UNSURE 23: Xaa=Asp or Asn
aatcggaagtggctgcgtcgtcgacgctgggctttcgggtcccgcgcccagagatgggctccaaggcaaagaagcgcgtgctgctgcccacccgcccagcgccccccacggtggagcagratcctggaggatgtgcggggtgcgccggcagaggatccagtgttcaccatcctggccccggaaggctggagtgcagtggcgagatctcgactcactgcaggctccgactccccagttcaagcgattctcctgcctcagcctccggagtagctgggactacagacacccgccacca

SEQ ID NO: 1953 - DNA, 383 bp, Homo sapiens
  CDS 126..383
  misc_feature 30: s=g or c
  misc_feature 251: w=a or t
aagtctgagcctccggcaccggccgcgcastggaggcggcggacggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggagtctacgtccctactgtctttgagaactatwttgcggacattgaggtggacggcaagcaggtggagctggctctgtgggacacagcagggcaggaagactatgatcgactgcggcctctctcctacccggacactgatgtcatcctcatgtgcttctccatcg

SEQ ID NO: 1954 - DNA, 430 bp, Homo sapiens
  CDS 172..429
  misc_feature 30: s=g or c
  misc_feature 165: s=g or c
  misc_feature 214: r=a or g
  misc_feature 251: w=a or t
  misc_feature 298: w=a or t
  UNSURE 15: Xaa=Ala or Thr
  UNSURE 27: Xaa=Lys or Met
  UNSURE 43: Xaa=Phe or Ile
aagtctgagcctccggcaccggccgcgcastggaggcggcggacggaagccttgacttcatctcagctccagagcccgccctctcttcctgcagcctgggaacttcagccggctggaggtcagttcccctccccagggaaggaggaagtgagggaagctgcgaascccaccatggctgcaatccgaaagaagctggtgatcgttggggatggtrcctgtgggaagacctgcctcctcatcgtcttcagcawggatcagtttccggaggtctacgtccctactgtctttgagaactatwttgcggacattgaggtggacggcaagcaggtggagctggctctgtgggacacagcagggcaggaagactatgatcgactgcggcctctctcctacccggacactgatgtcatcctcatgtgcttctccatcg

SEQ ID NO: 1955 - DNA, 264 bp, Homo sapiens
  CDS 56..262
  misc_feature 43: s=g or c
agtctgagcctccggcaccggccgcgcactggaggcggcggasggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgaccgcg

SEQ ID NO: 1956 - DNA, 292 bp, Homo sapiens
  CDS 35..292
  misc_feature 264: n=a, g, c or t
  UNSURE 77: Xaa=Ile or Lys or Arg or Thr
gggagttgtagtacgaatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcagganagccaagaagcaagcagcagagaggacc

SEQ ID NO: 1957 - DNA, 305 bp, Homo sapiens
  CDS 115..303
  misc_feature 59: s=g or c
gttcccggaagttttgctgctagtcgcggacgcaatggcttcaaggttacttcgcggastggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctg

SEQ ID NO: 1958 - DNA, 361 bp, Homo sapiens
  CDS 185..361
  misc_feature 7: s=g or c
  misc_feature 25: s=g or c
agaggastcccagcggctggagcasaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggag

SEQ ID NO: 1959 - DNA, 480 bp, Homo sapiens
  CDS 17..478
  misc_feature 444: n=a, g, c or t
  UNSURE 143: Xaa=Ile or Asn or Ser or Thr
acacacgcctgcaggtatggcgttctggtgtcagcgtgacagttatgcccgagagttcaccaccaccgtggtctcttgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacancccctctatgactgcagagcaagtagctgccattga

SEQ ID NO: 1960 - DNA, 706 bp, Homo sapiens
  CDS 31..705
  misc_feature 639: n=a, g, c or t
  UNSURE 203: Xaa= *  or Cys or Trp
ctctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgntcacgcaagttaataaaagagaatggattaaatgcaggcctggcatttcctactggatgttctctca

SEQ ID NO: 1961 - DNA, 265 bp, Homo sapiens
  CDS 105..263
  misc_feature 237: m=a or c
  UNSURE 45: Xaa=Arg or Ser
aggtcagggtccacagcatgcacctggagacatcaaatgtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctamgtcaagtccatgctggaaacctaccccc

SEQ ID NO: 1962 - DNA, 385 bp, Homo sapiens
  CDS 120..383
  misc_feature 123: r=a or g
  misc_feature 124: w=a or t
  UNSURE 2: Xaa=Asp or Ile or Asn or Val
ccagtctttggtcgggtttcggcggcttcagtgctcggggaggaggcagtgacggccggtgagattggaagtggcggcggcggcaggcggcagaggggagtccgaggttatgcgtctcaatgrwcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccacctcccgacaccatgtcctgccgggatcggacccaggagtttctgtctgcctgcaagtcgctgcagacccgtcagaatggaatccagacaaataagccagctttgcgtgctgcccg

SEQ ID NO: 1963 - DNA, 456 bp, Homo sapiens
  CDS 126..455
  misc_feature 43: r=a or g
  misc_feature 444: y=c or t
  UNSURE 107: Xaa=Cys or Arg
tggtgtgtcagccgtccctgcatgcccggttgcttctcttttrggggcggggtctagcaagagcaggtgtgggtttaggagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatygcagcacatatg

SEQ ID NO: 1964 - DNA, 348 bp, Homo sapiens
  CDS 27..347
  misc_feature 218: n=a, g, c or t
  misc_feature 241: n=a, g, c or t
  misc_feature 242: n=a, g, c or t
  misc_feature 243: k=g or t
  misc_feature 244: n=a, g, c or t
  misc_feature 257: r=a or g
  misc_feature 302: m=a or c
  misc_feature 306: s=g or c
  misc_feature 337: r=a or g
  UNSURE 64: Xaa=Phe or Leu
  UNSURE 72: Xaa=Ile or Lys or Met or Asn or Arg or Ser or Thr
  UNSURE 73: Xaa=Ala or Cys or Asp or Phe or Gly or Ser or Val or Tyr
  UNSURE 92: Xaa=His or Gln
  UNSURE 94: Xaa=Ala or Pro
  UNSURE 104: Xaa=Asp or Gly
aggcccgtccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagttgactgggttgcttctctatttattngacaataataatgtacatttcannkntctggttctaggrcattcagggaagggcgagtgggggcccgaggggtccctgccccamccgsctggtgtcctgttgtatctctgtgtaagtgrtgctcgtgaca

SEQ ID NO: 1965 - DNA, 507 bp, Homo sapiens
  CDS 122..505
ctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagct

SEQ ID NO: 1966 - DNA, 420 bp, Homo sapiens
  CDS 238..420
  misc_feature 56: r=a or g
acttccttgctggttgctaagacactcttgtttcgctccttgacaaccctggcggrggttcgctggctgcggccccggctccggcccccgcagagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgactataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatc

SEQ ID NO: 1967 - DNA, 323 bp, Homo sapiens
  CDS 70..321
gaaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggagga

SEQ ID NO: 1968 - DNA, 345 bp, Homo sapiens
  CDS 84..344
  misc_feature 138: m=a or c
  misc_feature 327: s=g or c
  misc_feature 329: r=a or g
  misc_feature 330: m=a or c
  misc_feature 337: n=a, g, c or t
  misc_feature 338: n=a, g, c or t
  UNSURE 19: Xaa=Lys or Gln
  UNSURE 82: Xaa=Leu or Val
  UNSURE 83: Xaa=Pro or Thr
  UNSURE 85: Xaa=His or Leu or Pro or Gln or Arg
atccacatccgcatcgtcgtcctccccgaccgcgtcctgcagcagctgccagtggagccgcctgacaaggactgccatccaccatggtgaagctgggctgcagcttctctgggaagccaggtaaagaccctggggacmaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccaagaggaagggcgcaggstrmccacacnnaccccac

SEQ ID NO: 1969 - DNA, 472 bp, Homo sapiens
  CDS 84..470
atccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctgga

SEQ ID NO: 1970 - DNA, 445 bp, Homo sapiens
  CDS 124..444
  misc_feature 106: n=a, g, c or t
  misc_feature 391: m=a or c
  UNSURE 90: Xaa=Pro or Thr
aattgcctcggtgatgtcgtgggttcaagcagcctccttgatccagggccctggagacaaaggggacgtgtttgacgaagaagcagacgagtcgctcctggcgcangggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccamcgtcccatgttgtagatttattggactccattgaggatatggacctttgtcatg

SEQ ID NO: 1971 - DNA, 285 bp, Homo sapiens
  CDS 78..284
ggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataa

SEQ ID NO: 1972 - DNA, 390 bp, Homo sapiens
  CDS 20..388
  misc_feature 366: r=a or g
  UNSURE 116: Xaa=Asp or Gly
cccttacggcgccggagagatggcggagttggacatcgggcagcactgccaggtggagcattgccggcagcgagattttcttccatttgtgtgtgatgattgttcaggaatattttgccttgaacacagaagcagggagtctcatggttgtcctgaggtgactgtaatcaatgagagactgaagacagatcaacatacatcttacccatgctctttcaaagactgtgctgagagagaacttgtggcagttatatgtccttattgtgagaagaatttttgcctgagacaccgtcatcagtcagatcatgagtgtgaaaaactggaaatcccaagctcgaatggctgcactcagaaacttgttaaagrcattattgattccaagacaggaga

SEQ ID NO: 1973 - DNA, 240 bp, Homo sapiens
  CDS 73..240
  misc_feature 112: m=a or c
  misc_feature 161: s=g or c
  misc_feature 175: m=a or c
  misc_feature 199: k=g or t
  misc_feature 235: y=c or t
  UNSURE 14: Xaa=Pro or Thr
  UNSURE 30: Xaa=Ala or Gly
  UNSURE 43: Xaa=Asp or Tyr
  UNSURE 55: Xaa=His or Tyr
ctttttgttccggggccgcaggcggggcaggcccgactttcgccgtcttcttgtctactctccagaacggccatgatttcccaattcttcattctgtcctccaagggggacmcgctcatctacaaagacttccgcggggacagtggcggccgggatgtggscgagctcttctacmggaagctgacgggactgccaggakacgagtccccggttgtcatgcatcaccatggccgtyatttc

SEQ ID NO: 1974 - DNA, 401 bp, Homo sapiens
  CDS 124..399
cccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgc

SEQ ID NO: 1975 - DNA, 284 bp, Homo sapiens
  CDS 114..284
cagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgt

SEQ ID NO: 1976 - DNA, 368 bp, Homo sapiens
  CDS 12..368
  misc_feature 120: y=c or t
  misc_feature 143: n=a, g, c or t
  misc_feature 148: y=c or t
  misc_feature 150: n=a, g, c or t
  misc_feature 206: k=g or t
  misc_feature 239: m=a or c
  misc_feature 285: w=a or t
  misc_feature 286: y=c or t
  misc_feature 288: n=a, g, c or t
  misc_feature 289: n=a, g, c or t
  misc_feature 328: k=g or t
  misc_feature 357: n=a, g, c or t
  UNSURE 37: Xaa=Pro or Ser
  UNSURE 46: Xaa=Ile or Thr
  UNSURE 47: Xaa=Leu or Met or Val
  UNSURE 65: Xaa=Asp or Glu
  UNSURE 76: Xaa=Asp or Glu
  UNSURE 92: Xaa=Leu or Met or Ser or Thr
  UNSURE 93: Xaa= *  or Ala or Glu or Gly or Lys or Leu or Met or Pro or Gln or Arg or Ser or Thr or Val or Trp
  UNSURE 106: Xaa=Ile or Ser
  UNSURE 116: Xaa=Asp or His or Asn or Tyr
aaaaaaacactatgctaatggcatggtgccgcggtcctgtcttgctgtgcctgcggcaggggctcggaaccaattcattcctgcacggcctggggcaggagcccttcgagggagctcggycactgtgttgcaggtcctcgccnagaaycntgcgagatggagaaagagagcacgaggcggcacaaaggaaagccccaggagcagaktcttgcccatctctccctctgagcatctcggamattgggactggatgtctttcgtcactggaaaacctcagactgccgwygnngcgggaagagtcatcccctcgagagctcgaggactcgakcggagaccagggccggtgcggtcccacanaccagggatcc

SEQ ID NO: 1977 - DNA, 447 bp, Homo sapiens
  CDS 34..447
gttttttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggcttcagc

SEQ ID NO: 1978 - DNA, 333 bp, Homo sapiens
  CDS 114..332
gcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatg

SEQ ID NO: 1979 - DNA, 535 bp, Homo sapiens
  CDS 2..535
  misc_feature 526: m=a or c
  UNSURE 175: Xaa=Lys or Asn
gatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtatcgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcgtcaaacacaagatgaagaamctcgtgtgg

SEQ ID NO: 1980 - DNA, 307 bp, Homo sapiens
  CDS 135..305
  misc_feature 112: k=g or t
attattattatcaaatccaatcagtggaagaaaggcaaacaagtgacttggcacttctgcctcagtcaaggaggctccttgatttatggtagctttggacttgcttccccgkctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcgg

SEQ ID NO: 1981 - DNA, 378 bp, Homo sapiens
  CDS 206..376
attacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcgg

SEQ ID NO: 1982 - DNA, 276 bp, Homo sapiens
  CDS 97..276
gtgattgtctcgtcctgggatcgcgagaggtgtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcg

SEQ ID NO: 1983 - DNA, 242 bp, Homo sapiens
  CDS 89..241
  misc_feature 192: n=a, g, c or t
  UNSURE 35: Xaa=His or Leu or Pro or Arg
ctacttcacggatccgcttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgcnccagaccccgtcttcgcgcccaatgacatactcctactcctccaacctgc

SEQ ID NO: 1984 - DNA, 413 bp, Homo sapiens
  CDS 159..413
  misc_feature 149: s=g or c
  misc_feature 279: m=a or c
  misc_feature 349: n=a, g, c or t
  misc_feature 354: m=a or c
  misc_feature 369: w=a or t
  UNSURE 64: Xaa=Leu or Pro or Gln or Arg
  UNSURE 66: Xaa=Lys or Gln
  UNSURE 71: Xaa=Ser or Thr
agtgcgtcatcagagagcgccggaagcggtccgagaatgaagagtgtgatctaccatgcattgtctcagaaagaggcgaatgactccgatgtccagccttcaggagcacagcgggccgaggccttcgtgagggccttcctgaagcgcasacgccccgcatgagcccgcaggcccgcgaggaccagctgcagcgcaaggcggtggtcctggagtacttcacccgccacaagcgcaaggagaagaagaagaaagccaaaggcctctctgccaggcaaaggmgggagctgcggctctttgacattaaaccagagcagcagagatacagccttttcctccctctccatgaacngtggmaacagtacatcaggwcctgtgcagtgggctcaagcagacacgcagccacagatgattca

SEQ ID NO: 1985 - DNA, 328 bp, Homo sapiens
  CDS 39..326
  misc_feature 152: k=g or t
aaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccackgatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagccttttgtacctgcag

SEQ ID NO: 1986 - DNA, 465 bp, Homo sapiens
  CDS 23..463
gaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagactgaggagcgctgcgaccc

SEQ ID NO: 1987 - DNA, 311 bp, Homo sapiens
  CDS 122..310
ctctcgtagctcaccctggccccaggccgggcggctcgagggggaggagttaccgccgttcttcggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagc

SEQ ID NO: 1988 - DNA, 371 bp, Homo sapiens
  CDS 84..371
aaaagtagagaaagtggaagaggaaagagttaccccagcgagaaccgggaaccgggctgcagactctccggcccgggggagggatgagtttcactctggttgcccaggctggagtgcaatggcgcgatctcggctcaccgcaacctctgcctcccggattcaagcgattctcctgcttcagcctcccgagtagctgggattacaggcatgtaccactgctcccggctaatcttgtatttttagtagagatggggtttctccatgttggtccggctggtctcggactcccaacctcaggtgatctgcccgcctcggcctcccaaagtgctgggattataggtgtgagccaccgctcccagccattctttatg

SEQ ID NO: 1989 - DNA, 360 bp, Homo sapiens
  CDS 102..359
  misc_feature 101: n=a, g, c or t
  misc_feature 312: n=a, g, c or t
  UNSURE 71: Xaa=Cys or Gly or Arg or Ser
attaacaaagatggtgcttatggggcaggttccctaacagtcaggattccggttgcagtttttctcccccgccccaaagatacgtggttgcagacggaganatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgacngcattcctagattccctacaggagtttccctgggtcagggagaagctg

SEQ ID NO: 1990 - DNA, 465 bp, Homo sapiens
  CDS 28..465
  misc_feature 10: n=a, g, c or t
  misc_feature 24: r=a or g
actccgctgngtctaggttctggraagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgag

SEQ ID NO: 1991 - DNA, 332 bp, Homo sapiens
  CDS 165..332
  misc_feature 292: m=a or c
  misc_feature 293: m=a or c
  misc_feature 314: r=a or g
  misc_feature 317: m=a or c
  misc_feature 325: s=g or c
  UNSURE 43: Xaa= *  or Ser or Tyr
  UNSURE 51: Xaa=Asp or Glu
  UNSURE 54: Xaa=Arg or Thr
acacatctcactcatccttctactcgtgacgcttcccagctctggctttttgaaagcaaagatgagcaacactcaagctgagaggtccataataggcatgatcgacatgtttcacaaatacaaccagacgtgatgacaagattgacaagccaagcctgctgacgatgatgaaggagaacttccccaacttccttagtgcctgtgacaaaaagggcacaaattacctcgccgatgtctttgagaaaaaggacaagaatgaggataagaagattgatttttctgagtttctgtmmttgctgggagacatagccacrgamtaccacasaagcaga

SEQ ID NO: 1992 - DNA, 393 bp, Homo sapiens
  CDS 42..392
agttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatga

SEQ ID NO: 1993 - DNA, 438 bp, Homo sapiens
  CDS 107..436
gcgcaagaatgtaatagagcttcgacggccgccattttctttctttcttagctgttagctgagaggaagtctctgaacaggcggcagcggctcttatagtgcaaccatggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggt

SEQ ID NO: 1994 - DNA, 286 bp, Homo sapiens
  CDS 72..284
  misc_feature 44: k=g or t
  misc_feature 45: k=g or t
gcggatttcgccggaaatcccggaagtgacagctttgggggttkkctgctggctctgactcccgtcctgcgatgggttgcgacgggggaacaatccccaagaggcatgaactggtgaaggggccgaagaaggttgagaaggtcgacaaagatgctgaattagtggcccaatggaactattgtactctaagtcaggaaatattaagacgaccaatagttgcctgtgaacttggcagactttataacaaagatgccgtcattgaatttctcttggacaaatctgcaga

SEQ ID NO: 1995 - DNA, 345 bp, Homo sapiens
  CDS 27..344
  misc_feature 16: w=a or t
  misc_feature 60: s=g or c
  misc_feature 154: k=g or t
  misc_feature 221: w=a or t
  misc_feature 265: n=a, g, c or t
  misc_feature 311: m=a or c
  misc_feature 335: r=a or g
  UNSURE 12: Xaa=Ala or Pro
  UNSURE 43: Xaa=Leu or Arg
  UNSURE 65: Xaa=His or Gln
  UNSURE 80: Xaa=Ala or Glu or Gly or Val
  UNSURE 95: Xaa=Phe or Leu
agaactgtggcgcttwctgggtaaagatggacgtccacgatctctttcgccggctcggcscgggggccaaattcgacacgagacgcttctcggcagacgcagctcgattccagataggaaaaaggaaatatgactttgattcttcggaggtgcktcagggactggacttttttggaaacaagaagtctgtcccaggtgtgtgtggagcatcacaaacacawtcagaagccccaaaaggagagaaaaaagaagagagcctaactgnaaaggaagagggagcagagcaagaaaaaaaggaagacgatgacttmagaaaattgcttcccaagaagaargtgctactat

SEQ ID NO: 1996 - DNA, 351 bp, Homo sapiens
  CDS 178..351
  misc_feature 143: k=g or t
  misc_feature 294: r=a or g
aacatgcgcattgcgcccgcagccctggaccatttgtcaggactactcgtgagacggagaaaaaaaaaagagaaaatttggggaacccttaggagaaatcttgagagtggacagcaattgtgaagatcgccagagagttctgkgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgartttggagccctggaagttattacagatgagaatgagatggaaaatgttaaaaaagca

SEQ ID NO: 1997 - DNA, 420 bp, Homo sapiens
  CDS 142..420
agttgctttgaggcagtaccggaggagaaagatggcggctaccttactagctgctcggggagccgggccagcaccggcttgggggccggagggttcactccagactgggaaagccgagaagtttccactgggaccactatcatggccgtgcagtttgacgggggcgtggttctgggggcggactccagaacaaccactgggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcg

SEQ ID NO: 1998 - DNA, 314 bp, Homo sapiens
  CDS 38..313
accgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctg

SEQ ID NO: 1999 - DNA, 471 bp, Homo sapiens
  CDS 175..471
ttcttactttcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatctt

SEQ ID NO: 2000 - DNA, 392 bp, Homo sapiens
  CDS 102..392
taaggcggtcccgggggagtgaggagaaagggggggtcttggcggccggaggaggagtaggtgcgggtgaagatggcggcagcgaggccgcgaactgcatcatggaggtgtcctgtggccaggcggaaagcagtgagaagcccaacgctgaggacatgacatccaaagattactactttgactcctacgcacactttggcatccacgaggagatgctgaaggacgaggtgcgcaccctcacttaccgcaactccatgtttcataaccggcacctcttcaaggacaaggtggtgctggacgtcggctcgggcaccggcatcctctgcatgtttgctgccaaggccggggcccgcaaggtcatcgggatcgagtgttccagtatctctgattat

SEQ ID NO: 2001 - DNA, 436 bp, Homo sapiens
  CDS 11..436
gtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgag

SEQ ID NO: 2002 - DNA, 187 bp, Homo sapiens
  CDS 20..187
  misc_feature 126: k=g or t
  UNSURE 36: Xaa=Gly or Val
aagcctcagattgattacaatgttctttctacttcatttcatcgttctgatcaatgtcaaagattttgcactgactcaaggtagcatgatcactccttcatgccaaaaaggatatttccctgtggkaatcttaccaagtgcttaccccgagcttttcactgtgatggcaaggatgactgtgggaacg

SEQ ID NO: 2003 - DNA, 398 bp, Homo sapiens
  CDS 104..397
  misc_feature 226: s=g or c
  misc_feature 259: y=c or t
attaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtsattggtggaggacatgccgggactgaggcagcyaccgccgccgctcggtgcggctctcggactctgctcctcactcaccgcgtggacacgatcggtcagatgtcatgtaatccttcctttggtggcatcggaaagggacatttaatgagggaagtagatgccttggatggcc

SEQ ID NO: 2004 - DNA, 223 bp, Homo sapiens
  CDS 56..223
atcctctgcagggcccaggcgcccttggccttaggacccaacttctcttaccgccatggagttcgacctgggagcagccctggagcccacctcccagaagcccggtgtgggggcgggccacgggggagatcccaagctcagtccccacaaagttcagggccggtcggaggcaggggcaggtccgggtccaaagcaaggacaccacagctcttccgactccagc

SEQ ID NO: 2005 - DNA, 307 bp, Homo sapiens
  CDS 25..306
  misc_feature 138: n=a, g, c or t
  misc_feature 195: w=a or t
  misc_feature 196: m=a or c
  UNSURE 38: Xaa=Asp or Glu
  UNSURE 58: Xaa=His or Asn
gccggccctcgcctcggagcagccatgatggaaggcctggacgacggcccggacttcctctcagaagaggaccgcggacttaaagcaataaatgtagatcttcaaagtgatgctgctctgcaggtggacatttctgangctcttagtgagcgggataaagtaaaattcactgttcacacaaagagttcattgccwmattttaaacaaaacgagttttcagttgttcggcaacatgaggaatttatctggcttcatgattcctttgttgaaaatgaagactatgcaggttatatcattccaccagcac

SEQ ID NO: 2006 - DNA, 309 bp, Homo sapiens
  CDS 112..309
  misc_feature 15: s=g or c
ccctacttcctgtgstcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtc

SEQ ID NO: 2007 - DNA, 423 bp, Homo sapiens
  CDS 62..421
  misc_feature 196: s=g or c
  misc_feature 387: m=a or c
  UNSURE 109: Xaa=Asn or Thr
aagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacsctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccamccccacccccttcttcccacaccttcgctggagatg

SEQ ID NO: 2008 - DNA, 397 bp, Homo sapiens
  CDS 95..397
  misc_feature 31: s=g or c
  misc_feature 113: r=a or g
  misc_feature 140: y=c or t
  misc_feature 248: w=a or t
  misc_feature 321: k=g or t
  UNSURE 7: Xaa=Asp or Asn
  UNSURE 16: Xaa=Pro or Ser
  UNSURE 52: Xaa=Asn or Tyr
  UNSURE 76: Xaa=Gly or Val
attgctgcgagcaggagcaggagacgcggastcggagcgctgagctgacctgccggagccgggcgtgggctgcagcctcggagctcccggaacgatggtgaagttggggaacratttcgcagagaagggcaccaagcagycgctgctggaggatggcttcgacaccattcccctgatgacgcccctcgatgtcaatcagctgcagttcccgcccccggataaggtggtcgtgaaaactaagaccgagwatgaacctgaccgcaagaaagggaaagcacgtcctccccaaattgctgagttcaccgtcagcatcacggaggktgtcaccgagaggtttaaggtctccgtgttggtcctcttcgccctggccttcctcacctgcgtcgtcttcctggct

SEQ ID NO: 2009 - DNA, 391 bp, Homo sapiens
  CDS 38..391
  misc_feature 272: s=g or c
  misc_feature 273: n=a, g, c or t
  UNSURE 79: Xaa=Ala or Asp or Gly or His or Leu or Pro or Arg or Val
gacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatsncaccagcattgactcagtcgtaattgggaaggaccaagaggtgaagctgcagcctggccaggttctccacatggtgaatgaactttatccatatattgtagagtttgaggaagaggca

SEQ ID NO: 2010 - DNA, 350 bp, Homo sapiens
  CDS 69..350
  misc_feature 266: s=g or c
  misc_feature 274: n=a, g, c or t
  UNSURE 66: Xaa=Lys or Asn
  UNSURE 69: Xaa= *  or Leu or Ser
gaaatcgtaggacttccgaaagcagcggcggcgtttgcttcactgcttggaagtgtgagtgcgcgaagatgcgaaaggtggttttgattaccggggctagcagtggcattggcctggccctctgcaagcggctgctggcggaagatgatgagcttcatctgtgtttggcgtgcaggaatatgagcaaggcagaagctgtctgtgctgctctgctggcctctcaccccactgctgaggtcaccattgtccaggtggatgtcagcaasctgcagtnattcttccgggcctccaaggaacttaagcaaaggatgatcaagaaatggttgtatgtgatccgtgttgaagaccat

SEQ ID NO: 2011 - DNA, 405 bp, Homo sapiens
  CDS 74..403
agttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgat

SEQ ID NO: 2012 - DNA, 436 bp, Homo sapiens
  CDS 83..436
  misc_feature 253: s=g or c
  misc_feature 254: r=a or g
  misc_feature 306: k=g or t
  misc_feature 407: r=a or g
  UNSURE 57: Xaa=Ile or Met
  UNSURE 58: Xaa=Asp or Asn
  UNSURE 75: Xaa=Leu or Arg
  UNSURE 109: Xaa=Glu or Lys
agacaagtggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatsractggggtggaacagaaaagcctttaccggtcgacatggttctcatctccckttgctttggactcagcattgcaaccatggtgcagtgctttggccatatcagcggtggccacatcaaccctgcagtgactgtggccatggtgtgcaccaggragatcagcatcgccaagtctgtcttctac

SEQ ID NO: 2013 - DNA, 279 bp, Homo sapiens
  CDS 121..279
  misc_feature 47: r=a or g
  misc_feature 49: s=g or c
gaagatggcggcgcacaagtcaggtccggcacatgtttccgcggagrascccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtagga

SEQ ID NO: 2014 - DNA, 479 bp, Homo sapiens
  CDS 101..478
  misc_feature 59: k=g or t
  misc_feature 68: k=g or t
  misc_feature 127: w=a or t
cccttttttgcagtctcaggacgggcgctttggagccggccccaggcagcgtgtgtcgktcgcctagkctggagaactagtcctcgactcacgtgcaaggatgatgctgaaaggaataacaaggctwatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgt

SEQ ID NO: 2015 - DNA, 387 bp, Homo sapiens
  CDS 116..385
gacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtgg

SEQ ID NO: 2016 - DNA, 233 bp, Homo sapiens
  CDS 40..231
gatcgcgtcgggcagcgggcgcggcggccccgcgcagccatggactggctcatggggaagtccaaagccaagcccaatggcaagaagcccgctgcggaggagaggaaggcctacctggagcctgagcacaccaaggccaggatcaccgacttccagttcaaggagctggtggtgctgccccgcgagattgaccttaacgagtggctggccagcaacaacgacgtttttccacc

SEQ ID NO: 2017 - DNA, 199 bp, Homo sapiens
  CDS 24..197
gggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagc

SEQ ID NO: 2018 - DNA, 402 bp, Homo sapiens
  CDS 232..402
  misc_feature 285: r=a or g
  misc_feature 286: r=a or g
  misc_feature 298: r=a or g
  misc_feature 299: n=a, g, c or t
  misc_feature 386: r=a or g
  UNSURE 19: Xaa=Gly or Arg
  UNSURE 23: Xaa=Ala or Asp or Gly or Ile or Asn or Ser or Thr or Val
  UNSURE 52: Xaa=Asp or Gly
ggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactrrgacatttttcarnttctttcttgtcatccttgctggggactgaaaacgcttctgtgagacttgataatagctcctctggtgcaagtgtggtagctattgrcaacaaaatcgagcaa

SEQ ID NO: 2019 - DNA, 653 bp, Homo sapiens
  CDS 273..653
  misc_feature 117: m=a or c
  misc_feature 461: w=a or t
  misc_feature 490: r=a or g
  misc_feature 638: w=a or t
  UNSURE 73: Xaa=Lys or Arg
atgcccccggccggcaggtcttttagtctttttccccctcccttactcttcgtccccggtccctcccctccccacccctttccttctagctccgacgtttgcggccgcgggggcggmggaggatatggagtaaagccagagtcagtggccaggcacgaaggcagagcaggaacagccaggaggcgtttattaggggggcggggggaaagagccccagcaccgcccctcctggaagaaggaagaggtaactataactacccaatattgcagccatggagtccatgcttaataaattgaagagtactgttacaaaagtaacagctgatgtcactagtgctgtaatgggaaatcctgtcactagagaatttgatgttggtcgacacattgccagtggtggcaatgggctagcttggaagatttttaatggcacaaaaaagtcaacaaagcaggaagtggcagtwtttgtctttgataaaaaactgattgacargtatcaaaaatttgaaaaggatcaaatcattgattctctaaaacgaggagtccaacagttaactcggcttcgacaccctcgacttcttactgtccagcatcctttagaagaatccagggattgcttggcattttgtacagaaccagtwtttgccagtatagcc

SEQ ID NO: 2020 - DNA, 469 bp, Homo sapiens
  CDS 291..467
  misc_feature 94: s=g or c
  misc_feature 437: n=a, g, c or t
  misc_feature 438: n=a, g, c or t
  misc_feature 439: n=a, g, c or t
  misc_feature 440: n=a, g, c or t
  UNSURE 49: Xaa=Ile or Met
  UNSURE 50: Xaa=any one of the twenty amino acids
agttggtccttagtactgcggccgtgtgggtgagttggctgccggtgagttgggtgccggtggagtcgtgttggtcctcagaatccccgcgtascgctgcctcctcctaccctcgccatgtttcttacccggtctgagtacgacaggggcgtgaatactttttctcccgaagaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacataggttgtgccatgagtgggctaattgctgatgctaagactttaattgataaagccagagtggagacacagaaccactggttcacctacaatgagacaatnnnngtggagagtgtgaccaagctgtgtccaat

SEQ ID NO: 2021 - DNA, 348 bp, Homo sapiens
  CDS 66..347
  misc_feature 25: n=a, g, c or t
tgcgtttccgccatttttgaaaatnaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatat

SEQ ID NO: 2022 - DNA, 406 bp, Homo sapiens
  CDS 148..405
  misc_feature 152: s=g or c
  misc_feature 159: m=a or c
  misc_feature 169: s=g or c
  UNSURE 2: Xaa=Ala or Gly
  UNSURE 8: Xaa=Gly or Arg
agaggagttcggcgccgcttctgtggccacggcaggctggggtgcagcggcgtgatctcagctcactccaacctctgcttcccaggttcaagcgattcttctgcctcagcctccggatacctgggattacagcttcacggtgatgatatggsatctgcmagctctagcsgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctgga

SEQ ID NO: 2023 - DNA, 435 bp, Homo sapiens
  CDS 190..435
aactgctcagcgcggtgaggagggagccggtgactcggagacggtgactcagaggcagagcggcgcaagggccaagaagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacc

SEQ ID NO: 2024 - DNA, 392 bp, Homo sapiens
  CDS 115..390
  misc_feature 65: s=g or c
  misc_feature 326: n=a, g, c or t
  UNSURE 71: Xaa=Ile or Asn or Ser or Thr
ggttgccaggacgacgcctgcgaagatggccgctgcgtcctcatcggattccgacgcctgcggastgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggancccagctctggcacttgcttcaggcccttgtgtctatgtgtataagaatctcagaccctacttcaa

SEQ ID NO: 2025 - DNA, 429 bp, Homo sapiens
  CDS 115..429
  misc_feature 337: n=a, g, c or t
  misc_feature 375: n=a, g, c or t
  misc_feature 377: r=a or g
  misc_feature 388: s=g or c
  misc_feature 407: r=a or g
  UNSURE 75: Xaa=Leu or Met or Val
  UNSURE 87: Xaa=Phe or Leu
  UNSURE 88: Xaa=Asp or Gly
  UNSURE 92: Xaa=Gly or Arg
  UNSURE 98: Xaa=Asp or Gly
acacatgcctgcttaaagccctctccatcctctgcctcacccagtccccgctgagactgagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttgntgcctcccaagatcccagatggagagagagtggacttngrtgacatccacsggaagcgcatggagaaggrcctgaatgagttgcaggcgctg

SEQ ID NO: 2026 - DNA, 349 bp, Homo sapiens
  CDS 26..349
ggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccaccc

SEQ ID NO: 2027 - DNA, 265 bp, Homo sapiens
  CDS 75..263
  misc_feature 163: n=a, g, c or t
  misc_feature 172: n=a, g, c or t
  misc_feature 173: s=g or c
  misc_feature 216: n=a, g, c or t
  misc_feature 248: m=a or c
  misc_feature 261: n=a, g, c or t
  misc_feature 262: m=a or c
  UNSURE 30: Xaa=Leu or Pro or Gln or Arg
  UNSURE 33: Xaa= *  or Cys or Phe or Leu or Ser or Trp or Tyr
  UNSURE 48: Xaa=Ala or Pro or Ser or Thr
  UNSURE 58: Xaa=Lys or Asn
  UNSURE 63: Xaa=Ala or Asp or His or Asn or Pro or Ser or Thr or Tyr
gtccgcaaagccggtggcgcccggaggctgcacggagagcggtgcccgcgtcagtgaccgaagaagagaccaagatgaatgcagagcccgagaggaagtttggcgtggtggtggttggtgttggccgagccggctccgtgcggatgagggacttgcggaatcnacacccttnstcagcgttcctgaacctgaggaagggtgtggattccgcaagtncctcatccgcccggagccatctcgctgccaamaccctgctttccnmtcg

SEQ ID NO: 2028 - DNA, 324 bp, Homo sapiens
  CDS 143..322
  misc_feature 13: k=g or t
  misc_feature 62: w=a or t
  misc_feature 78: n=a, g, c or t
  misc_feature 81: r=a or g
  misc_feature 191: r=a or g
  misc_feature 285: s=g or c
  misc_feature 286: n=a, g, c or t
  misc_feature 295: m=a or c
  misc_feature 300: r=a or g
  misc_feature 301: n=a, g, c or t
  misc_feature 302: n=a, g, c or t
  misc_feature 309: s=g or c
  UNSURE 17: Xaa=Ile or Val
  UNSURE 48: Xaa=Ala or Gly
  UNSURE 53: Xaa=Lys or Asn or Arg or Ser
  UNSURE 54: Xaa=Ala or Pro or Ser or Thr
  UNSURE 56: Xaa=Ala or Gly
gtccgcaaagcckgtggcgcccggaggctgcacggagagcggtgcccgcgtcagtgaccgawgaagagaccaagatgnatrcagagcccgagaggaagtttgcgtggtggtggttggtgttggccgagccggctccgtgcggatgagggacttgcggaatccacacccttcctcagcgttcctgaacctgrttggcttcgtgtcgagaagggagctcgggagcattgatggagtccagcagatttctttggaggatgctctttccagccaagaggtggaggtcgsnatatctgcmgtgarnnctccagscatgaggactacatc

SEQ ID NO: 2029 - DNA, 438 bp, Homo sapiens
  CDS 61..438
  misc_feature 373: r=a or g
  UNSURE 105: Xaa=Ile or Val
atataaggctcggaggccgcgaggcttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacrtctccctcatctacaccaactatgaggcgggcaaggatgactatgtgaaggcactgcccgggcaa

SEQ ID NO: 2030 - DNA, 386 bp, Homo sapiens
  CDS 37..384
ctctagtcccagtaggaggtttgactaagatcaatcatgacgacttacagtgacaaaggggcaaagcctgagagaggccgattcctccacttccactctgtgaccttctgggttggcaacgccaagcaggccgcgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagtatggggacaccacacacaccctggt

SEQ ID NO: 2031 - DNA, 314 bp, Homo sapiens
  CDS 128..313
  misc_feature 63: y=c or t
aaacgggatggggagctggaccagattatgagcttacagaaagcctggcctacattttactcyttttggatttcttcctcatcaagagactgctgcggtgcctgtcatgtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcagggg

SEQ ID NO: 2032 - DNA, 378 bp, Homo sapiens
  CDS 51..377
  misc_feature 364: y=c or t
  UNSURE 105: Xaa=Leu or Pro
cggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtccyggaggccctcaatg

SEQ ID NO: 2033 - DNA, 187 bp, Homo sapiens
  CDS 21..185
  misc_feature 10: n=a, g, c or t
aaaaggaganaaataaagcaatgggggaatatgccattttaattaggatggtcagggaaagccttgttaataaaggtggcctttttaagaatggtgaggagggcagacatgcacagggaacagaaaggaggacagtgtggctggagtggaatgtgagagtgggagtgtggtttaaagatgacatcag

SEQ ID NO: 2034 - DNA, 458 bp, Homo sapiens
  CDS 159..458
agcggcggcggtggcggcggaggggccgtgcggtgggtccgtactatcttttcccagtctcggttcgacgactccattttcctcggtgggggcttagcgcactggaggagcggcgggcttcagacagttgtcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgat

SEQ ID NO: 2035 - DNA, 559 bp, Homo sapiens
  CDS 121..558
  misc_feature 48: s=g or c
tctctgctacctgtagctgagggtgctgttgatgggcagcgcggcgcstgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggt

SEQ ID NO: 2036 - DNA, 299 bp, Homo sapiens
  CDS 106..297
  misc_feature 169: k=g or t
  misc_feature 275: y=c or t
  UNSURE 22: Xaa=Ala or Ser
  UNSURE 57: Xaa=Leu or Pro
atggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctkccatggctccagttggccgactgagacttgcctgggtagcccataagactctgacttcctcagccacctcacccatttcccacctcccaggttccttgatggagcyggtggagaaggaacgagcatctac

SEQ ID NO: 2037 - DNA, 287 bp, Homo sapiens
  CDS 112..285
agtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcaggtgggaagcggcggcgcccttcgtactccgttcctttcccctttcggctgcctccggc

SEQ ID NO: 2038 - DNA, 376 bp, Homo sapiens
  CDS 92..376
  misc_feature 363: n=a, g, c or t
  UNSURE 91: Xaa=Leu or Pro or Gln or Arg
ggggtcagaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaacngcagaaggccccc

SEQ ID NO: 2039 - DNA, 516 bp, Homo sapiens
  CDS 119..514
ggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagactgcagatttcctcctt

SEQ ID NO: 2040 - DNA, 354 bp, Homo sapiens
  CDS 77..352
gagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatc

SEQ ID NO: 2041 - DNA, 306 bp, Homo sapiens
  CDS 84..305
  misc_feature 131: k=g or t
  misc_feature 132: y=c or t
  misc_feature 144: m=a or c
  misc_feature 146: r=a or g
  UNSURE 21: Xaa=Lys or Gln
attcttaggagcctctcaagagctccacgcagcccggctgggcagcaagggacagaacagaggcggccgctgacagcaccagcatgtcttacagtgtgaccctgactgggcccgggccctggggcttccgkytgcaggggggcmargacttcaacatgcccctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtg

SEQ ID NO: 2042 - DNA, 262 bp, Homo sapiens
  CDS 89..262
ctttccccagaggcgagcttcatcaggcaggagccagaggccagagagacagcgtgcagctccagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagac

SEQ ID NO: 2043 - DNA, 429 bp, Homo sapiens
  CDS 89..427
aagctattcttaggagcctctcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagc

SEQ ID NO: 2044 - DNA, 354 bp, Homo sapiens
  CDS 197..352
  misc_feature 118: s=g or c
  misc_feature 153: y=c or t
  misc_feature 154: m=a or c
  misc_feature 196: m=a or c
  misc_feature 202: y=c or t
  misc_feature 231: s=g or c
  misc_feature 254: s=g or c
  misc_feature 343: s=g or c
  UNSURE 12: Xaa=Pro or Arg
  UNSURE 20: Xaa=Glu or Gln
  UNSURE 49: Xaa=His or Gln
tagcggtggccgccgagcgggatctgtgcggggagccggaaatggttgtggactacgtctgtgcggctgcgtggggctcggccgcgcggactgaaggagactgaaggccctcggatgsccagaacctgtaggccgcaccgtggacttgttctymatcgagggggtgctggggggacctgatgtggcaccaaatgamatgaayaaagctccacagtccacaggccccccacscgccccatcccccggactcccasagccagcgtttcccccggggcagacagcgccggtggtgttcagtacgccacaagcgacacaaatgaacacgccttctcagccccgccascacttctaccc

SEQ ID NO: 2045 - DNA, 273 bp, Homo sapiens
  CDS 116..271
  misc_feature 262: s=g or c
  UNSURE 49: Xaa=His or Gln
gataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccascacttctaccc

SEQ ID NO: 2046 - DNA, 484 bp, Homo sapiens
  CDS 48..482
agatcggcttccggttccggtgggctctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcct

SEQ ID NO: 2047 - DNA, 266 bp, Homo sapiens
  CDS 91..264
  misc_feature 249: r=a or g
gaggacttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgarattaagattggacagcc

SEQ ID NO: 2048 - DNA, 443 bp, Homo sapiens
  CDS 143..442
gcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggc

SEQ ID NO: 2049 - DNA, 261 bp, Homo sapiens
  CDS 74..259
  misc_feature 258: m=a or c
  misc_feature 261: w=a or t
  UNSURE 62: Xaa=Ala or Asp
atgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagmcaw

SEQ ID NO: 2050 - DNA, 413 bp, Homo sapiens
  CDS 109..411
agtggatgttgctggaacccacgcggaggaaggaagagacgcaggcaggctgcggttacccaagcggccacccgggcctcagggaccccttccccgagagacggcaccatgacccagggaaagctctccgtggctaacaaggcccctgggaccgaggggcagcagcaggtgcatggcgagaagaaggaggctccagcagtgccctcagccccaccctcctatgaggaagccacctctggggaggggatgaaggcaggggccttccccccagcccccacagcggtgcctctccaccctagctgggcctatgtggaccccagcagcagctccagctattacaacggtttccccaccggagaccatgagctcttcaccactttcagctgggatgaccagaaagttcgtcgagtctt

SEQ ID NO: 2051 - DNA, 391 bp, Homo sapiens
  CDS 151..390
  misc_feature 53: r=a or g
  misc_feature 133: k=g or t
  misc_feature 134: y=c or t
  misc_feature 135: y=c or t
  misc_feature 335: n=a, g, c or t
  UNSURE 62: Xaa=His or Leu or Pro or Arg
ataatatgtgggccgctgtggagccgtggtcgcgctgtgtgtgtgtgtgagtrgagagtgagtgcgggacctgaggctgtgtgtgtgtgaactgtggccactggcggggtcgggggggggcagcggcggacckyytcggacggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcntggtcgagctgatccagagtgtatgctgggccacttgctgagaatactcttcaaga

SEQ ID NO: 2052 - DNA, 352 bp, Homo sapiens
  CDS 118..351
  misc_feature 173: k=g or t
  misc_feature 174: y=c or t
  misc_feature 209: k=g or t
  misc_feature 263: r=a or g
  misc_feature 271: n=a, g, c or t
  misc_feature 272: n=a, g, c or t
  misc_feature 273: y=c or t
  misc_feature 285: r=a or g
  misc_feature 286: r=a or g
  misc_feature 303: r=a or g
  misc_feature 311: r=a or g
  misc_feature 317: r=a or g
  misc_feature 321: n=a, g, c or t
  misc_feature 322: r=a or g
  misc_feature 325: r=a or g
  misc_feature 327: k=g or t
  UNSURE 19: Xaa=Leu or Arg
  UNSURE 31: Xaa=Cys or Phe
  UNSURE 49: Xaa=Lys or Arg
  UNSURE 52: Xaa=Ala or Cys or Asp or Phe or Gly or His or Ile or Leu or Asn or Pro or Arg or Ser or Thr or Val or Tyr
  UNSURE 57: Xaa=Asp or Asn
  UNSURE 65: Xaa=Lys or Arg
  UNSURE 67: Xaa=Lys or Arg
  UNSURE 69: Xaa=Asp or Asn
  UNSURE 70: Xaa=Ala or Thr
acttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacackytcagaagatgatactgtgctcgatctcaaagagtktctcaagacccttacaggagttcttccagaacgccaaaagttacttggactcaragttaaannyaaacctgcagarratgatgttaagcttggrgctctcaractgaraccnratrckaaaatcatgatgatgggaactcgtg

SEQ ID NO: 2053 - DNA, 460 bp, Homo sapiens
  CDS 258..458
attgggcggaaggttcgctggcactccgttggtcttccagctggtgggagttgacgacgcggtgctgggcgttgggaccctactttatctagttcgggaagttgggttgtggggtcatacctgtctgtctgctcccagctttcttgggtttcttccgacggcgtggggcctcgctaaggaattcccggcccctcagggccacggctttagcggtgtcttttgcgagttcttcgtaagtacatcttaaagctgtcaagatggttctagcagaccttggaagaaaaataacatcagcattacgctcgttgagcaatgccaccattatcaatgaagaggtattgaatgctatgctaaaagaagtctgtaccgctttgttggaagcagatgttaatattaaactagtgaagcaactaagagaaaatgttaagtctgctattgatcttgaagagatggcatctgg

SEQ ID NO: 2054 - DNA, 183 bp, Homo sapiens
  CDS 23..181
acagttacgcgccgcacggatcatggccgcagccgctctggggcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctgga

SEQ ID NO: 2055 - DNA, 665 bp, Homo sapiens
  CDS 7..663
  misc_feature 71: r=a or g
  misc_feature 72: r=a or g
  misc_feature 97: s=g or c
  misc_feature 112: r=a or g
  misc_feature 129: n=a, g, c or t
  misc_feature 130: r=a or g
  misc_feature 131: w=a or t
  misc_feature 238: n=a, g, c or t
  misc_feature 239: n=a, g, c or t
  misc_feature 319: m=a or c
  misc_feature 325: k=g or t
  misc_feature 566: w=a or t
  UNSURE 22: Xaa=Glu or Gly
  UNSURE 31: Xaa=Glu or Gln
  UNSURE 36: Xaa=Glu or Lys
  UNSURE 41: Xaa=Lys or Asn
  UNSURE 42: Xaa=Glu or Lys or Met or Val
  UNSURE 78: Xaa= *  or Ala or Glu or Gly or Ile or Lys or Leu or Pro or Gln or Arg or Ser or Thr or Val
  UNSURE 105: Xaa=Pro or Thr
  UNSURE 107: Xaa=Asp or Tyr
  UNSURE 187: Xaa=Lys or Met
cggaaaatggccgccgccgccgccgccgcgccgagcggaggaggaggaggaggcgaggaggagagactggrrgaaaagtcagaagaccaggacctcsagggcctcaaggacraacccctcaagtttaanrwggtgaagaaagataagaaagaagagaaagagggcaagcatgagcccgtgcagccatcagcccaccactctgctgagcccgcagaggcaggcaaagcagagacatcannagggtcaggctccgccccggctgtgccggaagcttctgcctcccccaaacagcggcgctccatcatccgtgaccggggamccatgkatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagawgcccaaatctcccaaagctccaggaactggcagaggccggggacgccccaaagggagcggcaccacgagacccaaggcggccacgtcagagggtgtgca

SEQ ID NO: 2056 - DNA, 474 bp, Homo sapiens
  CDS 174..473
  misc_feature 4: s=g or c
  misc_feature 45: k=g or t
  misc_feature 152: n=a, g, c or t
  misc_feature 200: r=a or g
ctgsaagacggcagagctgccgccattttgcgggaagaggaggckctgtacctgcagtgctgcttttcttgcctagactctaggaactatccgagctccactccccacaacatactcaaaggaacggagagaaccgggacccccctgcgggnacccggaactgatctgacaggatggcatctgatgactttgacatagtrattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcggg

SEQ ID NO: 2057 - DNA, 454 bp, Homo sapiens
  CDS 34..453
  misc_feature 284: w=a or t
  misc_feature 285: r=a or g
  misc_feature 359: n=a, g, c or t
  misc_feature 360: n=a, g, c or t
  UNSURE 84: Xaa=Leu or Gln
  UNSURE 109: Xaa=Ile or Lys or Met or Asn or Arg or Ser or Thr
gcgcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcaccwraacccacctggagggaagaccagcgacatttttgggtctccggtcactgccacttcacgcttggcacacccaannaaacccaaggatcatgttttcttatgtgaaggagaagaaccaaaatcggatcttaaagctgcaaggagcatcccggctggagcagagccaggtg

SEQ ID NO: 2058 - DNA, 416 bp, Homo sapiens
  CDS 8..415
  misc_feature 390: y=c or t
  misc_feature 391: s=g or c
  UNSURE 128: Xaa=Leu or Pro
agcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactataatgttgagttcactttgacacagatgcysggggtagccatcaccatctattacc

SEQ ID NO: 2059 - DNA, 342 bp, Homo sapiens
  CDS 114..341
  misc_feature 218: n=a, g, c or t
  UNSURE 35: Xaa=Lys or Asn
agtcggcgccacggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaangatgtagatgtccgtaggagaattgaacttattcaggactttgaaatgcctactgtgtgtaccactattaaggtgtcaaaagatggacagtacattttagcaactggaacatataaacctcggg

SEQ ID NO: 2060 - DNA, 328 bp, Homo sapiens
  CDS 39..326
ataacgggcgttaataaccataccctgttagactaagcatggtccacccgcgaatcctctacagagatggccaagcgctggggtcgtggctgcgtcctctaggccagccttgtgcaaaggaccttctcaccacagatcagccagaccatcttcctccttccaagtcatcaaagagttccaagctggtcacctgtcccttgatgttcccaggaaaccaggaaagaggacccctgcattttatcttcccatccagagtggcaggatctctgcctgggaaacaggcttcattcagcacagctgtggtagcattaacaaagcaaagtgggca

SEQ ID NO: 2061 - DNA, 439 bp, Homo sapiens
  CDS 111..437
  misc_feature 9: y=c or t
gcatgtttyctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaaga

SEQ ID NO: 2062 - DNA, 458 bp, Homo sapiens
  CDS 105..458
actacccaggaaggcggactgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacctgctcgggagctatttccccaagaagatttctgagctggatgcatttttaaaggagccagctctcaatgaagccaacttgagcaatctgaaggccccattggacatcccagtgcctgatccagtcaaggagaaagagaaagaggagcggaagaaacagcaggagaaggaagacaaggatgaaaagaagaagggggaggatgaagacaaaggtcctccctgtggcccagtgaactgcaatgaaaagatcgtggtccttctgcagcgcttgaag

SEQ ID NO: 2063 - DNA, 370 bp, Homo sapiens
  CDS 150..368
cttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcacccgga

SEQ ID NO: 2064 - DNA, 242 bp, Homo sapiens
  CDS 72..242
aacggagagagacggcaacctgggttccggaagccggagagctggagctttgaagccaccccggtcaaaggatgctgagtccggagcgcctagccctaccggactacgagtatctggctcagcgacatgtcctcacctacatggaggatgcagtgtgccagctgctagaaaacagggaagatattagccaatatggaattgccaggttcttcactgaatattttaaagtgtatgccagggaa

SEQ ID NO: 2065 - DNA, 356 bp, Homo sapiens
  CDS 30..356
  misc_feature 331: n=a, g, c or t
  misc_feature 332: s=g or c
  UNSURE 101: Xaa=Ile or Lys or Met or Asn or Arg or Ser or Thr
agaagccgcccagtgccctgagcgtctccatggcctgcctgagcccctcgcagctccagaagttccaacaggatggattcctggtgctggaaggattcttgtctgcggaagagtgtgtggccatgcaacaaaggattggcgagatagtggctgaaatggatgttcctctccactgccgcacagaattctccacccaggaagaggagcagcttcgagcccagggcagcacagactatttcttgagcagtggtgacaagattcgattcttctttgagaaaggcgtttttgatgagaaaggaaatttcctggtccctccggagaaatccatcansaaaattggccacgctctgcacgcc

SEQ ID NO: 2066 - DNA, 295 bp, Homo sapiens
  CDS 66..293
  misc_feature 107: k=g or t
  misc_feature 122: r=a or g
agaggaggatgaggcaccattccaggagaaagattccggcagcgatgaagatttcctaatggaagatgatgacgatagtgactatggcagttcgaaaaagaaaaackaaaagatggttaagraggtcaaaacctgaaagaaaagaaaagaaaatgcccaaacccagactaaaggctacagtgacgccaagtccagtgaaaggcaaagggaaagtgggtcgccccacagcttcaaaggcatcaaaggaaagactccttctcccaaagaagaagatgaggaaccggaaagcccgcca

SEQ ID NO: 2067 - DNA, 226 bp, Homo sapiens
  CDS 2..226
  misc_feature 15: s=g or c
  UNSURE 5: Xaa=Pro or Arg
aatgagcgagttgcsaggcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggcagtacactatgaaccag

SEQ ID NO: 2068 - DNA, 409 bp, Homo sapiens
  CDS 127..408
  misc_feature 126: r=a or g
  misc_feature 253: s=g or c
  UNSURE 43: Xaa=Glu or Gln
ctttttctctgcacggagccggcgcttttgcagttgcttctgcggaaaggtggtagttaagaatttgtaaaggccagagaactacctacgattctctcagcggtctctcttctcctcaagtttgaratgctttatctcatcgggttgggcctgggagatgccaaggacatcacagtcaagggcctggaagttgttagacgctgcagtcgagtgtatctggaagcctacacctcagtcctaactgtagggaagsaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttg

SEQ ID NO: 2069 - DNA, 427 bp, Homo sapiens
  CDS 145..426
  misc_feature 271: s=g or c
  UNSURE 43: Xaa=Glu or Gln
ctttttctctgcacggagccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaagsaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttg

SEQ ID NO: 2070 - DNA, 320 bp, Homo sapiens
  CDS 68..319
  misc_feature 106: w=a or t
  misc_feature 114: m=a or c
  misc_feature 119: m=a or c
  misc_feature 120: m=a or c
  misc_feature 126: w=a or t
  misc_feature 239: r=a or g
  misc_feature 258: w=a or t
  misc_feature 259: y=c or t
  misc_feature 263: y=c or t
  misc_feature 264: n=a, g, c or t
  UNSURE 13: Xaa=His or Gln
  UNSURE 16: Xaa=Asn or Thr
  UNSURE 18: Xaa=Lys or Pro or Gln or Thr
  UNSURE 20: Xaa=Ile or Asn
  UNSURE 58: Xaa=Gly or Ser
  UNSURE 64: Xaa=Asp or Val
  UNSURE 66: Xaa= *  or Leu or Pro or Gln or Arg or Ser
ccactactccagacagacggctttggaatccaccagctacatccagctccctgaggcagagttgagaatggagagaatgttacctctcctgactctgggggcccawaataccamcctgmmagagawtcctcaaaaggcctcaagttcaacctcacggagacttctgaggcagaaattcaccagagcttccagcacctcctgcgcaccctcaatcagtccagcgatgaagctgcagctgrgtatgggaaaatgccatgwytgtynaagagcaactcagtctgctggacaggttcacggaggatgccaagaggctgtatggc

SEQ ID NO: 2071 - DNA, 254 bp, Homo sapiens
  CDS 54..254
  misc_feature 42: s=g or c
  misc_feature 43: n=a, g, c or t
  misc_feature 229: y=c or t
  UNSURE 59: Xaa=Phe or Ser
acctctgcagagccgggtggagcccattgacgtccagcgaasnaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctycagcgagacctatttcctccccacc

SEQ ID NO: 2072 - DNA, 227 bp, Homo sapiens
  CDS 30..227
  misc_feature 17: s=g or c
  misc_feature 27: r=a or g
  misc_feature 35: m=a or c
  misc_feature 41: r=a or g
  misc_feature 68: y=c or t
  misc_feature 69: s=g or c
  UNSURE 2: Xaa=Asp or Glu
  UNSURE 14: Xaa=Gly or Arg
agctaaactcagcggascagcgcggcrcgatggamggtcgrgtgcagctgatgaaggccctcctggcysggcccctccggcccgcggcgcgtcgctggaggaacccgattccctttcccgagacgtttgatggcgataccgaccggctcccggagttcatcgtgcagacgagctcctacatgttcgtggacgagaacacgttctccaacgacgccctgaaggtgacg

SEQ ID NO: 2073 - DNA, 453 bp, Homo sapiens
  CDS 82..453
atccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtg

SEQ ID NO: 2074 - DNA, 323 bp, Homo sapiens
  CDS 145..321
  misc_feature 102: s=g or c
  misc_feature 111: n=a, g, c or t
gaaggcgactttaaaggcgccgggactgagcgaagggcgtttgggtactgccgtcgccgccgcccaggccggggaggggtgcgttagtgtcaggaagcgggstgcgccganggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgt

SEQ ID NO: 2075 - DNA, 793 bp, Homo sapiens
  CDS 68..793
  misc_feature 14: n=a, g, c or t
  misc_feature 152: n=a, g, c or t
  misc_feature 792: y=c or t
  UNSURE 29: Xaa=Leu or Met or Val
  UNSURE 242: Xaa=Leu or Pro
aagataaggccgcncgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcntgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctctggttggtgtggtggctggaggtggccgaattgacaaacccatcttgaaggctggccgggcgtaccacaaatataaggcaaagaggaactgctggccacgagtacggggtgtggccatgaatcctgtggcagcatccttttggaggtggcaaccaccagcacatcggcaagccctccaccatccgcagagatgcccctgctggccgcaaagtgggtctcattgctgcccgcyg

SEQ ID NO: 2076 - DNA, 721 bp, Homo sapiens
  CDS 68..721
  misc_feature 14: n=a, g, c or t
  misc_feature 152: n=a, g, c or t
  misc_feature 243: m=a or c
  misc_feature 244: m=a or c
  misc_feature 320: n=a, g, c or t
  misc_feature 349: s=g or c
  misc_feature 720: y=c or t
  UNSURE 29: Xaa=Leu or Met or Val
  UNSURE 59: Xaa=Ala or Asp or Glu
  UNSURE 85: Xaa= *  or Glu or Lys or Gln
  UNSURE 94: Xaa=Asp or Glu
  UNSURE 218: Xaa=Leu or Pro
aagataaggccgcncgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcntgcgcgccgtggatttcgctgagcggcacggctacatcaagggcatcgtcaaggacatcatccacgacccgggccgcggcgcgcccctcgmmaaggtggtcttccgggatccgtatcggtttaagaagcggacggagctgttcattgccgccgagggcaccatgcctnagggtacaatcgtgtgctgcctggaggasaagcctggagaccgtggcaagctggcccgggcatcagggaactatgccaccgttatctcccacaaccctgagaccaagaagacccgtgtgaagctgccctccggctccaagaaggttatctcctcagccaacagagctctggttggtgtggtggctggaggtggccgaattgacaaacccatcttgaaggctggccgggcgtaccacaaatataaggcaaagaggaactgctggccacgagtacggggtgtggccatgaatcctgtggcagcatccttttggaggtggcaaccaccagcacatcggcaagccctccaccatccgcagagatgcccctgctggccgcaaagtgggtctcattgctgcccgcyg

SEQ ID NO: 2077 - DNA, 389 bp, Homo sapiens
  CDS 125..388
  misc_feature 326: r=a or g
  UNSURE 68: Xaa=Ala or Thr
agtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggrccctgactgtgttaaagaagaagtgggagaaccagggctgggagcagagtctcacacagactc

SEQ ID NO: 2078 - DNA, 301 bp, Homo sapiens
  CDS 117..299
gtaacagggcgtgggctggcacacttacttgcaccagtgcccagagagggggtgcaggctgaggagctgcccagagcaccgctcacactcccagagtacctgaagtcggcatttcaatgacaggtgccccgcaccgtcctctggctgaccatcgagctagccattgtgggctccgacatgcaggaagtcatcggcacggccattgcattcaatctgctctcagctggacggtaccaccccagtgtaccccaactcttcaggccaggcagagaacagctgctgctacttccccccctaacca

SEQ ID NO: 2079 - DNA, 458 bp, Homo sapiens
  CDS 228..458
  misc_feature 64: y=c or t
  misc_feature 123: r=a or g
  misc_feature 314: s=g or c
  UNSURE 29: Xaa=Lys or Asn
atgggtggagtctcgctttttctttccagtgttggctgacttacagctcttataaactagtggyaatttctgaacccagccggctccatctcagcttctggtttctaagtccatgtgccaaargctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaasaccattcagctcttcactctcctcctctggcccattaacaagcagctcttccggaagatcaactgcagactgtcctattgcatctcaagccagctggtgatgctgctggagtggtggtcgggcacggaatgcaccatcttcacg

SEQ ID NO: 2080 - DNA, 363 bp, Homo sapiens
  CDS 153..362
tttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactt

SEQ ID NO: 2081 - DNA, 372 bp, Homo sapiens
  CDS 109..372
  misc_feature 289: s=g or c
  misc_feature 293: w=a or t
  UNSURE 61: Xaa=Glu or Gln
  UNSURE 62: Xaa=Asp or Val
atcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtsaggwtgtctcagatttaacaacagttgaaagggaagactcatcattacttaatcctgcagccaaaaaaactgaaaatagatac

SEQ ID NO: 2082 - DNA, 234 bp, Homo sapiens
  CDS 15..233
ctgattgccccaccatggaggcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcggg

SEQ ID NO: 2083 - DNA, 368 bp, Homo sapiens
  CDS 186..368
  misc_feature 220: k=g or t
  misc_feature 271: k=g or t
  misc_feature 273: n=a, g, c or t
  misc_feature 317: k=g or t
  UNSURE 12: Xaa=Leu or Trp
  UNSURE 29: Xaa=Met or Arg
  UNSURE 30: Xaa= *  or Glu or Lys or Gln
gttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgcttkgaagcagaagctggtgcccttggtgcggaccgtgtgcgtccgaagcccgakgnagaggaaccggctcccaggcaacttgttccagcgatggcatgtkcctctagaactccagatgacaagacaaatggctagctctggtgcatcaggg

SEQ ID NO: 2084 - DNA, 624 bp, Homo sapiens
  CDS 307..624
  misc_feature 36: w=a or t
  misc_feature 52: k=g or t
cttttggcttctgccctcaaccaaaatggcgctacwcggaagctgccgaggkgctaggagttgccgaagcaagtccggaagctaccgagcgagtccggaagttgccgaaagggagcagcggggaaggaggatggcggatatcatcgcaagactccgggaggacggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcag

SEQ ID NO: 2085 - DNA, 466 bp, Homo sapiens
  CDS 126..464
  misc_feature 328: n=a, g, c or t
  UNSURE 68: Xaa=Leu or Pro or Gln or Arg
atttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgagggctgaggacctgaggagtccgcngtggggatggagagggacaggggggttttcgggccaggaacttgtaaaactctgctcgaaaaaagacaaagacaatgcggcgacattaaagtgctgggacagaggtgcagggaacactaatcttcccgtcgtaacacg

SEQ ID NO: 2086 - DNA, 250 bp, Homo sapiens
  CDS 84..248
  misc_feature 166: n=a, g, c or t
  UNSURE 28: Xaa= *  or Leu or Ser
cccatccctaatttgcaaaataggaactgaggctcaggagagctagactagtttgtgcacagccgagaagtggtcaagctagaatgggaccccaggtttgcgctccctactctccaccgataacctatcaaagggctttgcaagagcttttgactaatcgtctgtnaatggttcttcattcacgtattaattgcacatcagtatgtgccaaatctactagacattggagaaacagtaggaacaacacatg

SEQ ID NO: 2087 - DNA, 444 bp, Homo sapiens
  CDS 72..443
ctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagaggagtttgatcctaactccaaccc

SEQ ID NO: 2088 - DNA, 367 bp, Homo sapiens
  CDS 189..365
  misc_feature 115: n=a, g, c or t
cgcgccggaagtggaagaccaggcagcccagctgaaggcagtaagctcggctcacagtcgcaggagagttctggggtacacgggcaaaggggcttgagaaggcccggaggcgaancgcaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagt

SEQ ID NO: 2089 - DNA, 568 bp, Homo sapiens
  CDS 412..567
  misc_feature 367: n=a, g, c or t
gtttacaaacttgacgtacacacgcagtcctatccctacggtcctggaattgggggttactatcttggaatctaggggcactccaggctctgggctcagacggctggcttctgcctacccgagccttaacctttcaaggaccagaaggattccagagctcttgccctaggtcctggggcagcgatgactcactgcagcaccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggctttgcnacgctctccacccgatccttccattgaaaggcagagaaggaaggatgtgcttgggaactttaagacccacgaacgacagcgcactgatggagcagcccagtgtctggggcaaagtcctcgaggttcattcattcaggaagcctctgaccagcctttaccatgcgctgagtgagaagctgaggataaggaaagagcaagacc

SEQ ID NO: 2090 - DNA, 502 bp, Homo sapiens
  CDS 97..501
  misc_feature 454: m=a or c
agacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactamgggagggacagacacttcgggactcaatgcttaagtatccagatagtc

SEQ ID NO: 2091 - DNA, 314 bp, Homo sapiens
  CDS 29..313
  misc_feature 96: n=a, g, c or t
  UNSURE 23: Xaa=Ala or Asp or Gly or Val
aacctacttggtctcctgctttcgcgacatggccttcaattttggggctccctcgggcacctccggtaccgctgcagccaccgcggcccccgcggntgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagc

SEQ ID NO: 2092 - DNA, 291 bp, Homo sapiens
  CDS 24..290
acaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagc

SEQ ID NO: 2093 - DNA, 378 bp, Homo sapiens
  CDS 145..378
agtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgag

SEQ ID NO: 2094 - DNA, 305 bp, Homo sapiens
  CDS 5..304
  misc_feature 194: k=g or t
  UNSURE 64: Xaa=Asp or Tyr
atatatgggggcggggacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcgtgggttgtcttctggcctcagagtatccctkatcagaaccttgggcccctgggccccttcactcagtacttggtggaccaccatcacaccctcctgtgcaatgggtattggcttgcctggctgattcatgtgggagagtcct

SEQ ID NO: 2095 - DNA, 272 bp, Homo sapiens
  CDS 113..271
ctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcc

SEQ ID NO: 2096 - DNA, 429 bp, Homo sapiens
  CDS 175..429
  misc_feature 39: s=g or c
  misc_feature 342: r=a or g
agaacatctcgctcctcgcgcgtttccgtttccgctagsactctggcagttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacrgccatcgccggcagtgaaatcttctccctggagatgagcaagaccgaggcgctgacgcaggccttccggcggtccatcggcgttcgc

SEQ ID NO: 2097 - DNA, 373 bp, Homo sapiens
  CDS 67..372
  misc_feature 80: m=a or c
  misc_feature 263: n=a, g, c or t
  UNSURE 5: Xaa=His or Pro
  UNSURE 66: Xaa=Cys or Phe or Ser or Tyr
gaggaagtctaacctttgggagactccaagacagcagctccgaggtcggcgggggtctgggtggccatggaggagccccmtgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagtncaaagtcgtccgcgtcctggagatgctggaggcgctggtgaatgagggcagcctggcgctggaggagctgaagatggagagggaccacctcaggaaggaggtggaggggc

SEQ ID NO: 2098 - DNA, 502 bp, Homo sapiens
  CDS 151..501
  misc_feature 254: n=a, g, c or t
  misc_feature 268: w=a or t
  misc_feature 424: s=g or c
  UNSURE 35: Xaa=His or Leu or Pro or Arg
  UNSURE 40: Xaa=Asn or Tyr
  UNSURE 92: Xaa=Ala or Pro
cacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcncaccatcaacctgwaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctascccatgtgttactgctgcagctgggaacaactttcttcaaactacctggtggtgaacttaacccaggagaagatgaag

SEQ ID NO: 2099 - DNA, 377 bp, Homo sapiens
  CDS 193..375
  misc_feature 146: n=a, g, c or t
gcagttgccgcattcgccgcattcgctgcaggcgcgaggttgggtgcaggcagctgtttgagcctcgaggcatcgacggacggacagacggacggactgactgacgatgccgcgctctcacaggcctccgcctaccgcgcagggcntgccactgccgcagcagccgagcccaagtctgagggcgttgtggctatgactttcaagatttttctcctttttgcagggcttatggttaaagttcctgtggggttatatttttcctgcaaattacttcttttccaaagtctgatgttgatgtcccctgaagacagcggcttttatgcgaccattgttgcagtggtcgggcttcatgtggtgctggcaattttcgtcttcat

SEQ ID NO: 2100 - DNA, 384 bp, Homo sapiens
  CDS 196..384
  misc_feature 4: m=a or c
gcgmggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaac

SEQ ID NO: 2101 - DNA, 281 bp, Homo sapiens
  CDS 11..280
  misc_feature 121: k=g or t
  misc_feature 122: s=g or c
  misc_feature 127: y=c or t
  misc_feature 137: m=a or c
  misc_feature 142: r=a or g
  misc_feature 150: s=g or c
  misc_feature 154: n=a, g, c or t
  misc_feature 155: k=g or t
  misc_feature 160: n=a, g, c or t
  misc_feature 170: r=a or g
  misc_feature 175: r=a or g
  misc_feature 211: k=g or t
  misc_feature 214: w=a or t
  misc_feature 221: r=a or g
  misc_feature 224: k=g or t
  misc_feature 226: r=a or g
  UNSURE 37: Xaa=His or Gln
  UNSURE 38: Xaa=Leu or Val
  UNSURE 43: Xaa=His or Asn
  UNSURE 47: Xaa=Arg or Thr
  UNSURE 49: Xaa=Cys or Gly
  UNSURE 54: Xaa=Ile or Val
  UNSURE 67: Xaa= *  or Tyr
  UNSURE 71: Xaa=Met or Val
  UNSURE 72: Xaa= *  or Glu
aacatgcaagatggcggcccatcaccggcagaacacagcagggcggaggaaagtgcaggtttcctatgttattcgagatgaagtggagaagtacaaccgaaatggagtcaatgctctgcakstggayccagcactamatagrcttttcasagcnkgtcgngactctatcrtaagratatggagtgtcaatcagcacaagcaagatccatakatwgcatctrtgkarcaccatactgattgggtaaacgacattgtactctgttgtaatggggaaacattaa

SEQ ID NO: 2102 - DNA, 324 bp, Homo sapiens
  CDS 152..322
actcgtgcgcctaccagacagtggcggaggacggcgctcgctagtctcccaggtcgcggtacacggcgagaacgggcggggcggtctcggctgcgtccgggcgatccagtgcttagttccgtcatatccctctccacgacctcggtcgagcatgttcaccagggcccaggtgagacggattctgcagcgggtgcccgggaagcagcgatttggcatctaccggttcctgcccttcttttttgtcctgggaggaacgatggagtggatcatgattaaagtgcgcgtgggccaggagaccttctatgatgtctaccgtagaaaagc

SEQ ID NO: 2103 - DNA, 298 bp, Homo sapiens
  CDS 72..296
  misc_feature 39: s=g or c
  misc_feature 276: s=g or c
  UNSURE 69: Xaa=Gly or Arg
ggagtgagggtagcacgctgagctgaaggctgtgcggasggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacsgcttaaccgcatcacggtgtgg

SEQ ID NO: 2104 - DNA, 416 bp, Homo sapiens
  CDS 246..416
agttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctg

SEQ ID NO: 2105 - DNA, 470 bp, Homo sapiens
  CDS 101..469
  misc_feature 395: r=a or g
  UNSURE 99: Xaa=Glu or Lys
cggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagragcgggtaggaggtgtgcaatctttggggggaacaggtgcacttcgaattggagctgatttcttagcgcgttggt

SEQ ID NO: 2106 - DNA, 392 bp, Homo sapiens
  CDS 116..391
  misc_feature 3: s=g or c
aasagtcggttgccgtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacac

SEQ ID NO: 2107 - DNA, 433 bp, Homo sapiens
  CDS 77..433
atatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgttt

SEQ ID NO: 2108 - DNA, 513 bp, Homo sapiens
  CDS 101..511
  misc_feature 348: k=g or t
  misc_feature 350: r=a or g
  misc_feature 351: r=a or g
  misc_feature 408: s=g or c
  misc_feature 409: n=a, g, c or t
  misc_feature 471: r=a or g
  misc_feature 489: s=g or c
  misc_feature 491: s=g or c
  UNSURE 83: Xaa=Cys or Phe
  UNSURE 84: Xaa=Asp or Gly or Asn or Ser
  UNSURE 103: Xaa=Arg or Ser or Thr
  UNSURE 124: Xaa=Asp or Gly
  UNSURE 130: Xaa=Ser or Thr
  UNSURE 131: Xaa=Ala or Pro
tgggcggagatattcgccgccggcgcttgcgcctggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttccctkcrrcattaagcccctgctgcggcgagcatctgcttatgaggctctggagaagtaccctasngcctatgttgactataagactgtgctgcagattgatgataatgtgacgtcagccgtagaagrcatcaacagaatgaccascsctctcatggactcgcttgggcc

SEQ ID NO: 2109 - DNA, 497 bp, Homo sapiens
  CDS 123..497
  misc_feature 24: y=c or t
gaagatccccagcgctgcgggctyggagagagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgg

SEQ ID NO: 2110 - DNA, 268 bp, Homo sapiens
  CDS 22..267
aggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagcccaacacag

SEQ ID NO: 2111 - DNA, 260 bp, Homo sapiens
  CDS 89..259
  misc_feature 213: n=a, g, c or t
  misc_feature 214: n=a, g, c or t
  UNSURE 42: Xaa=Ile or Lys or Met or Asn or Arg or Ser or Thr
attcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacanncctgagctgagcctcatgcaggctgaccactggctgcgacgacgag

SEQ ID NO: 2112 - DNA, 399 bp, Homo sapiens
  CDS 149..397
  misc_feature 81: r=a or g
  misc_feature 356: n=a, g, c or t
  misc_feature 357: n=a, g, c or t
  misc_feature 358: s=g or c
  UNSURE 70: Xaa=any one of the twenty amino acids
agaagctctaggacccagcagcggttgtcgggtttggggctggaggtgaagccctgtgtgaatggggttgattgtccggcrccacttccccgcgctgcccggcagccgtcttccccagccgagggactgaactagccatgatcgcctcatgtggagggcaaagttgcgccggggaacttgtgagcctgcggtgaaagttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctgnnsattcagcaccaggcacagggagtgcaggccagccatcctac

SEQ ID NO: 2113 - DNA, 411 bp, Homo sapiens
  CDS 109..411
  misc_feature 18: s=g or c
aaaaaagccgggcgtgasggccgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgacgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacgga

SEQ ID NO: 2114 - DNA, 317 bp, Homo sapiens
  CDS 88..315
acagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaaccccggagacg

SEQ ID NO: 2115 - DNA, 272 bp, Homo sapiens
  CDS 87..272
  misc_feature 2: k=g or t
  misc_feature 18: n=a, g, c or t
  misc_feature 23: k=g or t
  misc_feature 28: k=g or t
  misc_feature 71: k=g or t
  misc_feature 73: r=a or g
akcgggggaccggaagtngctckcggakgctcagaagctagtcccggagcccggcgtgtggcgcctcggakcrcggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccgg

SEQ ID NO: 2116 - DNA, 426 bp, Homo sapiens
  CDS 171..425
  misc_feature 391: n=a, g, c or t
  UNSURE 74: Xaa= *  or Leu or Ser or Trp
aatcgcgaaagtgtcgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatngctcgttagagagttccctcctggattgcccaaat

SEQ ID NO: 2117 - DNA, 415 bp, Homo sapiens
  CDS 13..414
gaccgcgctaagatggcgactcccatgcatcggctaatagcccggagacaagcattcgacacagagttgcagcctgtcaagaccttttggatcctgattcagccatccatcgttattagtgaagcaaataagcaacatgtaagatgtcagaaatgcttggaatttggacattggacttatgaatgcacaggaaaaagaaaatacctacataggccctcaaggacagcagaactaaagaaagctttaaaagaaaaagaaaacagattattattgcaacaaagcattggagaaaccaatgtagaaagaaaggccaagaaaaaaaggtctaagagtgtaaccagttccagtagcagtagcagtgacagttctgccagtgattcttcatcagagagtgaagaaacatctacctcttcct

SEQ ID NO: 2118 - DNA, 289 bp, Homo sapiens
  CDS 53..289
  misc_feature 58: s=g or c
  misc_feature 60: w=a or t
  misc_feature 64: s=g or c
  misc_feature 65: r=a or g
  UNSURE 2: Xaa=His or Gln
  UNSURE 3: Xaa=Lys or Met
  UNSURE 5: Xaa=Gly or Arg
actctgtcacctccgctggaaggagtggaacccagacttgctggtctgatccatgcasawggcsrggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggag

SEQ ID NO: 2119 - DNA, 439 bp, Homo sapiens
  CDS 264..437
  misc_feature 43: k=g or t
  misc_feature 44: n=a, g, c or t
  misc_feature 58: y=c or t
  misc_feature 414: r=a or g
  misc_feature 415: r=a or g
  misc_feature 419: w=a or t
  UNSURE 51: Xaa=Asp or Gly or Asn or Ser
gctcagctgacagctcccgagaacggaagaggcggcgcgccgknttgagcagggcgtytctaggcctggtcggctggcggcgatggcaggattttcataatatatgtagtatgagttccacatcttggcctcttacgccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgrrcgcwatctgctctatgcaagcact

SEQ ID NO: 2120 - DNA, 494 bp, Homo sapiens
  CDS 264..494
  misc_feature 43: k=g or t
  misc_feature 44: n=a, g, c or t
gctcagctgacagctcccgagaacggaagaggcggcgcgccgknttgagcagggcgtttctaggcctggtcggctggcggcgatggcaggattttcataatatatgtagtatgagttccacatcttggcctcttacgccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaacttt

SEQ ID NO: 2121 - DNA, 262 bp, Homo sapiens
  CDS 101..262
agaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccag

SEQ ID NO: 2122 - DNA, 325 bp, Homo sapiens
  CDS 104..325
  misc_feature 320: s=g or c
  UNSURE 73: Xaa=Asp or His
ctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgasatggg

SEQ ID NO: 2123 - DNA, 199 bp, Homo sapiens
  CDS 24..197
attgtttcctactaaatacccaaatgtgtcacacaggcatcaccagtgggaattttgtttttaaacatttagaaataaaacagtttttgacccataagccagtcctaacgcatagggtaatggggatcgaggctaaacacacacacaactacaaatattccctagaaaaatgcaacatcctcagaaaatcaagatctcc

SEQ ID NO: 2124 - DNA, 393 bp, Homo sapiens
  CDS 53..391
  misc_feature 2: r=a or g
  misc_feature 20: s=g or c
araaaccgggtgccggcagsgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccagg

SEQ ID NO: 2125 - DNA, 316 bp, Homo sapiens
  CDS 74..316
  misc_feature 80: y=c or t
  misc_feature 83: s=g or c
  misc_feature 88: k=g or t
  misc_feature 223: y=c or t
  UNSURE 3: Xaa=Phe or Leu
  UNSURE 4: Xaa=Gly or Arg
ctgaagtactaccagctcttcttagactccctgagagacccaaataaagtattccctgagcatataggggaagatgttcytcsgccckgccatgttagctaagtttcgagttgcccgtctctatggcaaaatcattactgcagatcccaagaaagagctggaaaatttggcaacatcattggaacattacaaatttattgttgattactgtgaaaagcatccygaggccgcccaggaaatagaagttgagctagaacttagtaaagagatggttagtcttctcccaacaaaaatggagagattcagaaccaagacg

SEQ ID NO: 2126 - DNA, 434 bp, Homo sapiens
  CDS 249..434
  misc_feature 9: n=a, g, c or t
agttgtcgngtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtg

SEQ ID NO: 2127 - DNA, 430 bp, Homo sapiens
  CDS 202..429
  misc_feature 31: n=a, g, c or t
  misc_feature 32: k=g or t
  misc_feature 164: n=a, g, c or t
  misc_feature 166: y=c or t
  misc_feature 180: r=a or g
  misc_feature 283: y=c or t
  misc_feature 307: r=a or g
  misc_feature 429: m=a or c
  UNSURE 28: Xaa=Cys or Arg
  UNSURE 36: Xaa=Glu or Lys
  UNSURE 76: Xaa=Asp or Glu
agtgcgcatgttcactgggcgtcttctgccnkgccccttcgcccacgtgaagaacgccagggagctgtgaggcagtgctgtgtggttcctgccgtccggactctttttcctctactgagattcatctgtgtgaaatatgagttggcgaggaagatcgacctatnayggcctagaccaagrcgctatgtacagcctcctgaaatgattgggcctatgcggcccgagcagttcagtgatgaagtggaaccagcaacacctgaagaaggggaaccagcaactcaaygtcaggatcctgcagctgctcagragggagaggatgagggagcatctgcaggtcaagggccgaagcctgaagctcatagccaggaacagggtcacccacagactgggtgtgagtgtgaagatggtcctgatgggcaggagatggamc

SEQ ID NO: 2128 - DNA, 404 bp, Homo sapiens
  CDS 217..402
gagtcggcgcggccacatcctttaaatatggtctttcttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagagagagcagaggagttatgtggacttgttggttaaatacgca

SEQ ID NO: 2129 - DNA, 211 bp, Homo sapiens
  CDS 40..210
accgggagctgagcaaggcccagaaccagttcacagtatatgaggttcttaaccctcggaagaaatgtaagaagaagaaatatgtcaactcaggaactgacacagctgaacttcacagtagccattgacttcacggcttccaatgggaatcctctgcagcctacctccctgcactacatgagtccctaccagctcagcgcctatgccatgg

SEQ ID NO: 2130 - DNA, 363 bp, Homo sapiens
  CDS 74..361
  misc_feature 51: r=a or g
gacggcagttccgagtccagtgggggcggtgggagcgatgagggtctgagrcggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggaagcagggcg

SEQ ID NO: 2131 - DNA, 597 bp, Homo sapiens
  CDS 267..596
  misc_feature 16: s=g or c
  misc_feature 235: h=a or c or t
  misc_feature 236: n=a, g, c or t
actacagagctgcaasccctgacaatgggatccgggaaaggcagaggtggccggcacgcctgggaactgggaaatccctttcctggattcactgggagcaccgggaggtggctgagaaccctacttctgtgaggggagcagtgaggcagggaaaccctaggtttggggatggataagcaggggcaggagagcagagcttgcaggcaggagcccaggttctagtcttgggaaggchnggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggag

SEQ ID NO: 2132 - DNA, 438 bp, Homo sapiens
  CDS 108..437
  misc_feature 16: s=g or c
actacagagctgcaasccctgacaatgggatccgggaaaggagaggtggccggcacgcctgggaactgggaaatccctttcctggattcactgggagcaccgggaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggag

SEQ ID NO: 2133 - DNA, 465 bp, Homo sapiens
  CDS 57..464
  misc_feature 103: r=a or g
  misc_feature 135: s=g or c
  misc_feature 316: n=a, g, c or t
  misc_feature 317: n=a, g, c or t
  misc_feature 318: n=a, g, c or t
  misc_feature 416: r=a or g
  UNSURE 16: Xaa=Asp or Gly
  UNSURE 27: Xaa=Glu or Gln
  UNSURE 87: Xaa=Ala or Asp or Glu or Gly or Val
  UNSURE 88: Xaa=Ala or Pro or Ser or Thr
gattttaggggtagggagaagtgtcagcttcaggcatcgcgaggcgtggcggccccatggccccgctgggaggcgccccgcggctggtactgctgttcagcgrcaagaggaaatccgggaaggacttcgtgaccsaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgnnncaggcttcttttgcaggaagattgtggagggcatctcccagcccatctggctggtgagtgacacacggagagtgtctgacatccagtggtttcgggargcctatggggccgtgacgcagacggtccgcgttgtagcgttggagcgga

SEQ ID NO: 2134 - DNA, 313 bp, Homo sapiens
  CDS 5..313
  misc_feature 272: s=g or c
  UNSURE 90: Xaa=Leu or Val
ggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagstggaggacaagcagaacgccgacatcagcgctatgcaggac

SEQ ID NO: 2135 - DNA, 349 bp, Homo sapiens
  CDS 154..348
  misc_feature 267: r=a or g
gagactgcttccacttcgggcgggggagccccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaraagagaaaaacgtcaagcagtaaacatgatgtgtcagcacaccatgatttgaatattgatcaatcacagtgtaatgaaatgt

SEQ ID NO: 2136 - DNA, 342 bp, Homo sapiens
  CDS 78..341
  misc_feature 179: k=g or t
  misc_feature 228: k=g or t
  misc_feature 233: k=g or t
  misc_feature 284: m=a or c
  UNSURE 51: Xaa=Asp or Tyr
  UNSURE 69: Xaa= *  or Tyr
gtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattacctkaattttcttgcccaaagaggttacttcaaagacaaagcttttgttaatkatctkaaatacttgctttactgggaagacccagaatatgccaagtatctaaagtamcctcagtgtttacacatgttagagctgctccaatatgaacacttccgaaaggagctgg

SEQ ID NO: 2137 - DNA, 405 bp, Homo sapiens
  CDS 119..403
  misc_feature 176: s=g or c
  UNSURE 20: Xaa=Glu or Gln
gagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccasagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgacccggtggcggaggagacgcgggcacggctg

SEQ ID NO: 2138 - DNA, 271 bp, Homo sapiens
  CDS 39..269
  misc_feature 261: r=a or g
  UNSURE 75: Xaa=Asp or Asn
ctcgctcaccctggttcctctcggagcggagacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagaracaaagacac

SEQ ID NO: 2139 - DNA, 479 bp, Homo sapiens
  CDS 185..478
  misc_feature 274: s=g or c
  misc_feature 341: m=a or c
  misc_feature 342: s=g or c
  misc_feature 343: s=g or c
  misc_feature 445: n=a, g, c or t
  misc_feature 453: m=a or c
  UNSURE 30: Xaa=His or Gln
  UNSURE 53: Xaa=Pro or Arg or Ser or Thr
  UNSURE 87: Xaa=Ile or Met
  UNSURE 90: Xaa=Asn or Thr
gactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcasgatgaccaggacctgacccgcatgatccacatcctggacacggagcacccctgggacctgcactcgmssccctcagagcaccacgaggccatcacctgcctggagtgggaccagtcaggctcccggctcctgtcagcagatgccgacgggcagatcaagtgctggagcatngcgaccamctggctaatagctgggagagctcagt

SEQ ID NO: 2140 - DNA, 387 bp, Homo sapiens
  CDS 35..385
  misc_feature 260: r=a or g
  misc_feature 343: m=a or c
  UNSURE 76: Xaa=Glu or Lys
  UNSURE 103: Xaa=Asp or Glu
aaaaatctctctgccggtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccgraggacatagccagggcggacaacatcttcacggccactgaacggaaccgcatcgactacgtcagctccgccgtccgtatcgamcacgccccggaccttccgcggccagaggtgtgttttataggcag

SEQ ID NO: 2141 - DNA, 383 bp, Homo sapiens
  CDS 42..383
  misc_feature 340: y=c or t
  misc_feature 341: n=a, g, c or t
  misc_feature 342: n=a, g, c or t
  misc_feature 343: k=g or t
  UNSURE 100: Xaa=Ala or Val
  UNSURE 101: Xaa=Gly or Leu or Met or Arg or Val or Trp
agttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgynnkggagcaagacctggggaagctggaggaagagctgcgggca

SEQ ID NO: 2142 - DNA, 248 bp, Homo sapiens
  CDS 55..246
  misc_feature 119: m=a or c
  UNSURE 22: Xaa=Asn or Thr
aaccactgagtccagaagcaagacctgtgagagtgcacagtgccacttcgccccatggctgaagatggtttgcccaaaatttattctcatcctccaacagaaagcagtaaaacaccaamtgcagcaaccattttctttggggctgacaatgctattcccaaatcagaaacaactattacttcagaaggagaccacgtcacttcagtaaatgaatatatgctagaaagcgatttttcaacaactacaga

SEQ ID NO: 2143 - DNA, 227 bp, Homo sapiens
  CDS 55..225
  misc_feature 127: r=a or g
  UNSURE 25: Xaa=Ala or Thr
attcgaggcgacgggctccgggccctgatagatggggtgcggggacggagacaaatgacggcctttgggctcggaatacccacctttctggtaatgcagcccagcgggtcccagcctcgttttccarccctcactcaaaatggagtcgctctggttcgaacgcctctgacaagtgtgtacctacgtgtcaggcccatccttcctgcaggcctttgtcttggtgtcac

SEQ ID NO: 2144 - DNA, 267 bp, Homo sapiens
  CDS 55..267
attttttccttcggcttccgttcttggtccatgtgagagaagctggctgctgaaatgactgcgaaccggcttgcagagagccttctggctttgagccaacaggaagaactagcggatttgccaaaagactacctcttgagtgagagtgaagatgagggggacaatgatggagagagaaagcatcaaaagcttctggaagcaatcagttcccttgatggaaagaataggcggaaattggctgagaggtctgaggctagtctgaaggtg

SEQ ID NO: 2145 - DNA, 282 bp, Homo sapiens
  CDS 127..282
  misc_feature 267: n=a, g, c or t
agtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgcngcagtctggcttacc

SEQ ID NO: 2146 - DNA, 317 bp, Homo sapiens
  CDS 127..315
  misc_feature 255: k=g or t
ttccatttagcgtgcctaacatcctaccttgccttctatgagtctttcttctaatactacacctctgccttattttagttcagggtttcactaagtaacccctacattaataaatgagtatggataatgctaatatttgagcaatacagaggattaagagatcaagatacttcactgcctattagcctaatagggatacctactttctttcaaatgccaaaaattcacattagaaacataatccagatatgtgtkattttatatatatatatacaaaacagtaaatggtttcttaaaattattgctatttttcaacc

SEQ ID NO: 2147 - DNA, 407 bp, Homo sapiens
  CDS 98..406
  misc_feature 230: n=a, g, c or t
  UNSURE 45: Xaa=Leu or Met or Val
attctcgcgagaagtccaggggtggccgtgatggcggcggcaggagcaggacctggccaggaagcgggtgccgggcctggcccaggagcggtcgcaaatgcaacaggggcagaagaggggggagatgaagccggtggcagcgggagcagccgctcctcctggagaggggatctctgctgctccgacagttgagcccagttccggggaggctgaaggcggggaggcaaacntggtcgatgtaagcggtggcttggagacagaatcatctaatggaaaagatacactagaaggtgctggggatacatcagaggtgatggatactcaggcgggctccgtggatgaagagaatggccgacagttgggtgaggtagagctgcaatgtgggatttgtacaaatggttcacggc

SEQ ID NO: 2148 - DNA, 363 bp, Homo sapiens
  CDS 103..363
atttctgtgcgccgagctccgccccacgagcacctgtttccgagcggagagcgcgggccgttttctttcctggtgtcccgtcgcggcttgggacccggcaagatgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggagtgaatatttcaacg

SEQ ID NO: 2149 - DNA, 480 bp, Homo sapiens
  CDS 201..479
  misc_feature 95: m=a or c
  misc_feature 96: n=a, g, c or t
  misc_feature 169: n=a, g, c or t
  misc_feature 207: s=g or c
  misc_feature 210: m=a or c
  misc_feature 218: k=g or t
  misc_feature 220: n=a, g, c or t
  misc_feature 438: r=a or g
  misc_feature 453: r=a or g
  UNSURE 3: Xaa=Ala or Pro
  UNSURE 4: Xaa=Pro or Thr
  UNSURE 6: Xaa=Asp or Glu
  UNSURE 7: Xaa= *  or Leu or Ser or Trp
  UNSURE 80: Xaa=Gly or Arg
  UNSURE 85: Xaa=Gly or Ser
aagttggtgggaagcgtgcggtgccgcagcaatggcggcgctcacaattgccacgggtactggcaattggttttcggctttggcgctcggggtgmntcttctcaaatgccttctcatccccacataccattccacagattttgaagtacaccgaaactggcttgctatnactcacagtttgccaatatcacagtggtattatgaggscamcttcagaktngacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaargaacttacagaaaargccaaaatttattctgtcggtattact

SEQ ID NO: 2150 - DNA, 621 bp, Homo sapiens
  CDS 207..620
  misc_feature 7: m=a or c
  misc_feature 8: m=a or c
aattccmmcagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgccaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacgtcccctgcctcaagattctcctcagcaaaggcctggggctgggcattgtggctggctcacttctagtaaagctgccccaggtgtttaaaatcctgggagccaagagtgctgaagggttgagtctccagtctgtaatgctggagctagtggcattgactgggaccatggtctacagcatcactaacaacttcccattcagctcttggggtgaagccttattcctgatgctccagacgatcaccatctgcttcctggtcatgcactacagaggacagactgtgaaaggtgtcgctttcctcgcttgctacggcc

SEQ ID NO: 2151 - DNA, 473 bp, Homo sapiens
  CDS 147..473
  misc_feature 51: r=a or g
  misc_feature 118: k=g or t
attttagctgttggttccggccgcaccgtgtgggctgtagtagcgggaggrgtgggggtcctccagagttaagtggctgtcctcgactgtgcccatacagcagccagctttcttcctkaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacaca

SEQ ID NO: 2152 - DNA, 340 bp, Homo sapiens
  CDS 133..339
  misc_feature 12: y=c or t
  misc_feature 13: w=a or t
  misc_feature 43: n=a, g, c or t
  misc_feature 295: s=g or c
  misc_feature 296: r=a or g
  UNSURE 55: Xaa=Glu or Gly or Gln or Arg
gcttctcctttywgtgttccggccgatcccacctctcctcgancctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccagggcggaggctcagctgtgattgacatggagaacatggatgatacctcaggctctagcttcgaggatatgggtgagctgcatsrgcgcctgcgcgaggaagaagtagacgctgatgcagctgatgcag

SEQ ID NO: 2153 - DNA, 416 bp, Homo sapiens
  CDS 155..415
  misc_feature 394: k=g or t
  misc_feature 412: r=a or g
  UNSURE 80: Xaa=Asp or Glu
agaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgakgttcttgcaaaatcagarccaa

SEQ ID NO: 2154 - DNA, 355 bp, Homo sapiens
  CDS 133..354
  misc_feature 4: s=g or c
  misc_feature 13: n=a, g, c or t
  misc_feature 25: s=g or c
  misc_feature 219: s=g or c
  misc_feature 330: m=a or c
  misc_feature 347: n=a, g, c or t
  UNSURE 29: Xaa=Phe or Leu
  UNSURE 66: Xaa= *  or Tyr
  UNSURE 72: Xaa=Ala or Asp or Gly or Val
aaasccttcccgncttccagcccasacaccagccagccagtggcgttcctggctcctcgggattttccttttcctccgaagctgctgattcatccccaggctggagtcaggctcagctgtggggctgggagcatgggctctcaggctgctgctgagtggaggaactgggcctcctgggaggtgtcctccagcctctctggatgctccatggggtgcttsaaggatgaccgcatcgtcttctggacttggatgttctccacctacttcatggagaaatgggctccccggcaggacgacatgcttttctatgtgcgccggaagctggcgtamtccggcagcgaaagcgntgcagacg

SEQ ID NO: 2155 - DNA, 438 bp, Homo sapiens
  CDS 112..438
aagcgcacgctgaggaggatcggcggccggtgagggggaagcaagtctggtctctgtgattgaagaagtcggctctgggctccagtgcgggaatcacacacatacctcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggatatattgatttgtcaaaaagaagagtttctccagaggaagcaatcaaatgtgaagacaaattcacaaaatccaaaactgtttat

SEQ ID NO: 2156 - DNA, 179 bp, Homo sapiens
  CDS 20..178
  misc_feature 27: n=a, g, c or t
  UNSURE 3: Xaa=Ile or Lys or Arg or Thr
atggacctaatcaggcaaaatgttaanacattttaaatggttaaaatcaggctttaaggatttggattcattgttttatttgaaatatttagcattctcatggcatcaagtatgtatacatgtatactgtatgaagcgatatatttattatatattgctaaatgtatattcaaaaagct

SEQ ID NO: 2157 - DNA, 432 bp, Homo sapiens
  CDS 196..432
  misc_feature 15: n=a, g, c or t
  misc_feature 18: n=a, g, c or t
  misc_feature 19: n=a, g, c or t
  misc_feature 39: s=g or c
  misc_feature 40: n=a, g, c or t
  misc_feature 62: r=a or g
ataaagggcacagcncannggtacgtggatcgcggtgcsnagactgaggttagaaggcacargtggcgagatgagccgggtaccagcgttcctgagcgcggccgaggtggaggaacacctccgcagctccagcctcctcatcccgcctctagagacggccctggccaacttctccagcggtcccgaagaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagct

SEQ ID NO: 2158 - DNA, 472 bp, Homo sapiens
  CDS 207..470
  misc_feature 139: n=a, g, c or t
aatcaggatccggagacggaaatgtccgaagccgcagtacttgaccctgtattttgggagtcgaacggagaatggaaactgaaagtggaaatcaggaaaaggtaatggaagaagaaagcactgaaaagaaaaaagaagnttgaaaaaaagaaacggtcacgagttaaacagatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatt

SEQ ID NO: 2159 - DNA, 274 bp, Homo sapiens
  CDS 105..272
gaacgtgatctcgggtttgtcgggctgaaatgtggcgggtctcggaaggttccgacctcagtaaagagagctaacgtgtattcttctttttcttagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaatcg

SEQ ID NO: 2160 - DNA, 434 bp, Homo sapiens
  CDS 88..432
  misc_feature 322: k=g or t
  misc_feature 367: k=g or t
  misc_feature 384: w=a or t
  misc_feature 385: n=a, g, c or t
  misc_feature 426: n=a, g, c or t
  UNSURE 79: Xaa=Ala or Ser
  UNSURE 94: Xaa=Phe or Val
  UNSURE 100: Xaa= *  or Glu or Lys or Gln
gctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtatkcattgccttcaagaaagctggtggctctacagttaagatccattkttattaagtataaatcwnagccattctgtgaaaaactgctttcctgggtgaaagcagtngctgtgca

SEQ ID NO: 2161 - DNA, 367 bp, Homo sapiens
  CDS 96..365
agagaagccgggagcgggcgaggcggcggcggcagagcgatggcaggaatagagttggagcggtgccagcagcaggcgaacgagggacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgcccacggacccaggatgcaggcatt

SEQ ID NO: 2162 - DNA, 303 bp, Homo sapiens
  CDS 67..303
  misc_feature 92: y=c or t
  misc_feature 101: r=a or g
  UNSURE 9: Xaa=Leu or Pro
  UNSURE 12: Xaa=Glu or Gly
catggaatacaatgacatagctgtggttgatgaactatattttatctattgcaatgatattttgaaatgcagtgctactcattgagtttccyttgtgaggrgattgtgtggcgaggacccagcaagacaagctactatcccaaaaaagctacttatatgaacttcatttctggtttctttcaaattgaaggtaaattccaagatgaagcttttattctattctctgaccaaagtgttgggaaaagaaaggaatttgttaccattttcatttctaacatactaaaacagaaaacaaaaaacccc

SEQ ID NO: 2163 - DNA, 566 bp, Homo sapiens
  CDS 361..564
  misc_feature 16: k=g or t
  misc_feature 109: k=g or t
  misc_feature 122: r=a or g
  misc_feature 134: r=a or g
  misc_feature 178: k=g or t
  misc_feature 194: k=g or t
  misc_feature 246: r=a or g
  misc_feature 253: m=a or c
  misc_feature 340: m=a or c
  misc_feature 344: r=a or g
  misc_feature 358: m=a or c
  misc_feature 563: r=a or g
  UNSURE 68: Xaa=Glu or Gly
taccagtgagcagggkggatgaggtcctcacccgtgagctcatatgctgatgggggagacctacagcaagcaaggagataaataaatacatcaaatagaggtaaatgakgtgaagaaaacaraacgggctgagragatagtgtgagactgtaaggagttttaaattttaaaacttgckactcataattagatakgcaagtttctgaaattcgcatagtgcatttcagatgatgagagaggtgacarccgtagmaagtgggagaagtggttgcggggagatgggtgagcgatggaggtggcgagcaagttggagagatgcagggagagtcaggtgacaagmagaragtgtgctgaggamagatggcggacagacaggccgctgcccccaatttttggtgctctttcattcctgcactcaggcacgaggcagacaggaaagacaggcagtgctgcttcgtaacaggcatctttcttgccctaagtatacatcttagaatgtgtggagaaagtcacgctatgggagcacttgggcaggctcaggtgttcactgtagtagaaggagraat

SEQ ID NO: 2164 - DNA, 279 bp, Homo sapiens
  CDS 109..279
tcctctctcagctcccgcttgagatcgaggactgatggggcacgcttccttcctcggcgccatgctggtttcatttcacctgcattcctgaaagaggcgctttcctaaatgtttttccaagtattcttccttctccaattgcaggataactgcccccatctgccaaattctgggcaggaagactttgacaaggacgggattggcgatgcctgtgatgatgacgatgacaatgacggtgtgaccgatgagaaggacaactgccagctcctcttcaatccc

SEQ ID NO: 2165 - DNA, 352 bp, Homo sapiens
  CDS 148..351
  misc_feature 19: w=a or t
  misc_feature 315: n=a, g, c or t
  misc_feature 316: y=c or t
  UNSURE 56: Xaa=Arg or Ser
  UNSURE 57: Xaa=Arg or Trp
gagaagcgagccggcggcwgaggaggcgactgactgagcagcgcacccggggagcaaggaggcgcggtgaactgagcggcccctgagctgacagatacactgcgcactggaacggcgagcgagccgacgggcgagtgaggggcgcagatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagnyggcagtttgcagccttagtggcatctaaagtatttt

SEQ ID NO: 2166 - DNA, 352 bp, Homo sapiens
  CDS 97..351
  misc_feature 310: n=a, g, c or t
  UNSURE 72: Xaa= *  or Glu or Lys or Gln
cttctcgcgcatgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctgnagctcattgcctcagagaacttctgcagccgagctgcgctgg

SEQ ID NO: 2167 - DNA, 350 bp, Homo sapiens
  CDS 65..349
gcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaa

SEQ ID NO: 2168 - DNA, 339 bp, Homo sapiens
  CDS 150..338
accctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaag

SEQ ID NO: 2169 - DNA, 216 bp, Homo sapiens
  CDS 37..216
  misc_feature 180: w=a or t
gagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgtwcagaaagcaataaaggagaaagagattcctattgaa

SEQ ID NO: 2170 - DNA, 425 bp, Homo sapiens
  CDS 77..424
  misc_feature 115: w=a or t
  misc_feature 356: w=a or t
  misc_feature 366: m=a or c
  misc_feature 367: w=a or t
  UNSURE 94: Xaa=Phe or Ile
  UNSURE 97: Xaa=Ala or Asp or Glu
atttccggctctcgcgagtctgggtgggagcgcgccaaatttctcccctgaagcagaggtggtagccaacggctccatgtctctgaggagcggcgggcggcggcgcgcggacccwggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagawttaaggtggmwttggcctataaaaccgtatttctacaattgcgaccagaaagggttgtgagcgagaaag

SEQ ID NO: 2171 - DNA, 450 bp, Homo sapiens
  CDS 66..449
  misc_feature 142: m=a or c
  misc_feature 273: w=a or t
  misc_feature 288: n=a, g, c or t
  misc_feature 289: n=a, g, c or t
  misc_feature 356: n=a, g, c or t
  misc_feature 357: n=a, g, c or t
  UNSURE 26: Xaa=Asn or Thr
  UNSURE 70: Xaa=Cys or Ser
  UNSURE 75: Xaa= *  or Ala or Glu or Gly or Ile or Lys or Leu or Pro or Gln or Arg or Ser or Thr or Val
  UNSURE 97: Xaa=Lys or Asn
  UNSURE 98: Xaa=Ile or Leu or Val
gagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcamctggctgatcctgcaccacaaggtgtacgatttgaccaaatttctggaagagcatcctggtggggaagaagttttaagggaacaagctggaggtgacgctactgagaacttgatgtcgggcactctacagwgccagggaaatgtgnnaacattcatcattggggagctccatccagtaagtacattttgggggccctttcttatttgtattaanntatcagatgaccttaccctagtctgtaagcttgcatgtatacacattttaaaaggagtaaagcaaaaacaactcctgattttaggacaccaag

SEQ ID NO: 2172 - DNA, 413 bp, Homo sapiens
  CDS 66..413
  misc_feature 230: y=c or t
  misc_feature 261: s=g or c
  misc_feature 262: y=c or t
  misc_feature 267: s=g or c
  misc_feature 274: m=a or c
  UNSURE 66: Xaa=Ala or Leu or Pro or Val
  UNSURE 68: Xaa=Asp or His
  UNSURE 70: Xaa=Lys or Thr
gagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagcyggaggtgacgctactgagaactttgaggatsycgggsactctamagatgccagggaaatgtccaaaacattcatcattggggagctccatccagatgacagaccaaagttaaacaagcctccggaaactcttatcactactattgattctagttccagttggtggaccaactgggtgatcccc

SEQ ID NO: 2173 - DNA, 441 bp, Homo sapiens
  CDS 219..440
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgg

SEQ ID NO: 2174 - DNA, 414 bp, Homo sapiens
  CDS 139..414
  misc_feature 208: r=a or g
  misc_feature 222: n=a, g, c or t
  misc_feature 293: m=a or c
  misc_feature 328: w=a or t
  misc_feature 365: n=a, g, c or t
  misc_feature 395: m=a or c
  UNSURE 24: Xaa=Ile or Val
  UNSURE 28: Xaa= *  or Cys or Trp
  UNSURE 52: Xaa= *  or Ser
  UNSURE 64: Xaa=Ser or Thr
  UNSURE 76: Xaa=Ala or Glu or Gly or Val
  UNSURE 86: Xaa=Lys or Thr
actagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaartcaagaaaagttgnacagagtttagaacaaacagctcgagagattttaactctactgcaaggggtccatcagggtgctgggtttmaggacattccaaagaggtgtttgaaagctcgagawcattttggtacagtaaaaacacatctaacatctttgnaagaccaaatttcctgctgaacagtattamagatttcatgagcactgga

SEQ ID NO: 2175 - DNA, 519 bp, Homo sapiens
  CDS 96..518
  misc_feature 92: y=c or t
  misc_feature 421: y=c or t
  misc_feature 422: r=a or g
  UNSURE 109: Xaa=Ala or Val
attcctgagagctctcctcaccaagaagcagcttctccgctccttctaggatctccgcctggttcggcccgcctgcctccactcctgcctcyaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggyrcggttcctggagcagcagaacaagatgctggagaccaagtggagcctctgcagcagcagaagacggctcgaagcaacatggacaacatgttcgagag

SEQ ID NO: 2176 - DNA, 414 bp, Homo sapiens
  CDS 110..412
  misc_feature 156: y=c or t
  misc_feature 334: n=a, g, c or t
  UNSURE 16: Xaa=Ala or Val
  UNSURE 75: Xaa=Lys or Asn
gctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggytttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaanggagatgttacagcccagatagctcttcagcctgcactgaagttcaatggtggtggtcatatcaatcatagcattttctg

SEQ ID NO: 2177 - DNA, 441 bp, Homo sapiens
  CDS 110..439
  misc_feature 12: m=a or c
  misc_feature 13: m=a or c
  misc_feature 41: s=g or c
  misc_feature 174: n=a, g, c or t
  misc_feature 303: n=a, g, c or t
  misc_feature 304: n=a, g, c or t
  misc_feature 305: k=g or t
  misc_feature 384: n=a, g, c or t
  misc_feature 385: n=a, g, c or t
  UNSURE 22: Xaa=Ile or Asn or Ser or Thr
  UNSURE 65: Xaa=Ala or Asp or Glu or Gly or Val
  UNSURE 66: Xaa=Phe or Val
  UNSURE 92: Xaa=Ala or Asp or Glu or Gly or Val
gatttccggggmmactggtgtgacgtgtcccgcgcttggcsagcaggaagcggcggcgaacgcggcctgaattcccggcgccggccccagctcctctgccgctgccgccatgctcgacttcttcaccattttctccaagggcgggcttgtgctctggtgcttccagggcgttancgactcatgcaccggacccgttaacgcgttgattcgttccgtgctgctgcaggaacggggaggtaacaactccttcacccatgaggcactcacactcaagtataaactggacaaccagtttgagctggnnkttgtggttggttttcagaagatcctgacactgacatatgtagacaaattgatagatgacgtgcatcggctgtttcgggnnaagtaccgcacagagatccaacagcaaagtgctttaagtttattaaatggcacttt

SEQ ID NO: 2178 - DNA, 347 bp, Homo sapiens
  CDS 75..347
  misc_feature 26: r=a or g
ttgaggatggaatctttgaggtcaartctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagac

SEQ ID NO: 2179 - DNA, 267 bp, Homo sapiens
  CDS 18..266
ggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaag

SEQ ID NO: 2180 - DNA, 264 bp, Homo sapiens
  CDS 13..264
  misc_feature 11: s=g or c
  misc_feature 112: s=g or c
  UNSURE 34: Xaa=Ala or Pro
ggacgcgcacstatggcagagggcagcggggaagtggtcgcagtgtctgcgacggggctgccaacggcctcaacaatggggcaggcgggacctcggcgacgacctgcaaccsctgtcgcgcaactgcataagatcctggagacgcggctggacaacgacaaggagatgttagaagctctcaaggcactttcaaccttttttgttgaaaatagtctgcggactcgaagaaatttacgtggagatattgaacgtaaaagtttagcc

SEQ ID NO: 2181 - DNA, 379 bp, Homo sapiens
  CDS 51..377
ctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccccgcctggagcagaagctcatgtgggccttcagcatgtatgac

SEQ ID NO: 2182 - DNA, 501 bp, Homo sapiens
  CDS 92..499
aaaaagccgttctccaattaaagctgttaacgtgtactacgctgtttccttgttggattttcttgttctctgctgctactgtaaaaacgaaatgagtggtcctgctcaggttccaatgatgtccccaaatggttctgtgcctcctatctatgtgcctcctggatatgccccacaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtagatgctcactctacacatggaaggtccaactttagagatgaacgatctagtaaaacatatgaacgtttgcagaaaaaattgaaggatcg

SEQ ID NO: 2183 - DNA, 282 bp, Homo sapiens
  CDS 45..281
aaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagag

SEQ ID NO: 2184 - DNA, 500 bp, Homo sapiens
  CDS 93..500
  misc_feature 468: n=a, g, c or t
  misc_feature 483: n=a, g, c or t
  misc_feature 484: n=a, g, c or t
  misc_feature 486: k=g or t
  misc_feature 494: s=g or c
  UNSURE 126: Xaa=Cys or Gly or Arg or Ser
  UNSURE 131: Xaa=Ala or Cys or Asp or Phe or Gly or His or Ile or Leu or Asn or Pro or Arg or Ser or Thr or Val or Tyr
  UNSURE 132: Xaa=Leu or Val
  UNSURE 134: Xaa=His or Gln
cactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggacngtttcttctcatctnncktgtggcasccatgc

SEQ ID NO: 2185 - DNA, 473 bp, Homo sapiens
  CDS 111..473
aactctttatcaatcgtcttccggcgcagcccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctaaaggtggtggggacagggctatgggagtggcaggtattatgacagtcgaa

SEQ ID NO: 2186 - DNA, 490 bp, Homo sapiens
  CDS 313..489
  misc_feature 17: s=g or c
gattgggagccgcggastttcaggacgagcccctggagcgccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggctttcctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaag

SEQ ID NO: 2187 - DNA, 461 bp, Homo sapiens
  CDS 34..459
  misc_feature 335: m=a or c
  misc_feature 362: m=a or c
  misc_feature 408: m=a or c
  misc_feature 424: r=a or g
  misc_feature 425: m=a or c
  misc_feature 431: m=a or c
  misc_feature 435: n=a, g, c or t
  misc_feature 436: w=a or t
  UNSURE 101: Xaa=Asn or Thr
  UNSURE 110: Xaa=Ala or Glu
  UNSURE 125: Xaa= *  or Cys
  UNSURE 131: Xaa=Ala or Glu or Lys or Thr
  UNSURE 133: Xaa=Asn or Thr
  UNSURE 135: Xaa=Phe or Ile
cttcgatcctcggggagcccaggagaccagaacatgaactccttcaattataccacccctgattatgggcactatgatgacaaggataccctggacctcaacacccctgtggataaaacttctaacacgctgcgtgttccagacatcctggccttggtcatctttgcagtcgtcttcctggtgggagtgctgggcaatgccctggtggtctgggtgacggcattcgaggccaagcggaccatcaatgccatctggttcctcaacttggcggtagcgacttcctctcctgcctggcgctgcccatcttgttcacgtccattgtacagcatcaccamtggccctttggcggggccgcctgcagmatcctgccctccctcatcctgctcaacatgtacgccagcatcctgmtcctggccaccatcarmgccgamcgcnwtctgctggtgtttaaacccatctgg

SEQ ID NO: 2188 - DNA, 403 bp, Homo sapiens
  CDS 57..401
  misc_feature 115: n=a, g, c or t
  misc_feature 116: m=a or c
  misc_feature 329: m=a or c
  UNSURE 20: Xaa=Ala or Asp or Glu or Gly or Val
  UNSURE 91: Xaa=Asp or Glu
atttctccccagggggctctaggctgtggatgtgagaaggggagcaagggaggcagatggcgacaaggaacagccccatgcccctgggcacggctcagggtgaccctggagaggnmggaacacggcccggccctgacgccagcctccgggacacaggtgcggccactcagctcaagatgaagcccaggaaggtgcacaagatcaaggcggtcatcatcgacctgggctcccagtactgcaagtgcggctacgcgggagagccgaggcccacctacttcatctcctccaccgtgggcaaacgctgccccgaggcggccgacgctggcgamacccgcaagtggactttagtgggccatgagctgctcaacacggaggccgcctctcaagctggtgaacccgctga

SEQ ID NO: 2189 - DNA, 200 bp, Homo sapiens
  CDS 17..199
  misc_feature 101: k=g or t
  misc_feature 103: m=a or c
  misc_feature 111: m=a or c
  UNSURE 29: Xaa= *  or Asp or Glu or Tyr
  UNSURE 32: Xaa=Ala or Glu
acgttttagcgttaccatggatcctggaggtgcccgcgaacactgcttgtcgcctgggcaaccggagaggacgaagcaggacctaggtggcggcgggtggkamcgggctgmaatggtgtccaatcccgtgcatggcttgccctttcttccgggcacgtcctttaaggactctacgaaaacagccttccacagaagtcaga

SEQ ID NO: 2190 - DNA, 333 bp, Homo sapiens
  CDS 120..332
  misc_feature 74: s=g or c
gttagccagcttggcgctggctcccggaatatggagccctgggcgcgggggcggcgtgtcaggtggttgcggastggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctggg

SEQ ID NO: 2191 - DNA, 299 bp, Homo sapiens
  CDS 101..298
  misc_feature 13: k=g or t
  misc_feature 43: k=g or t
  misc_feature 44: n=a, g, c or t
  misc_feature 45: n=a, g, c or t
agtctgatttackgctctgctgaaaaccgcttcgctcccgcaknntcagcaccggaggcggcggctgcagcagcagcaacaagtcgggacttttagagtaatgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccat

SEQ ID NO: 2192 - DNA, 398 bp, Homo sapiens
  CDS 152..397
  misc_feature 186: r=a or g
  misc_feature 187: r=a or g
  UNSURE 12: Xaa=Glu or Gly
aagtaacccacgtgcttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggrrctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagaggg

SEQ ID NO: 2193 - DNA, 366 bp, Homo sapiens
  CDS 79..366
  misc_feature 74: k=g or t
  misc_feature 192: m=a or c
aagaccaagcattcagcaagccactcttccacctcccttactgcaggaaggcactccgaagacataagtcggtkagacatggctgaagataaaagcaagagagactccatcgagatgagtatgaagggatgccagacaaacaacgggtttgtccataatgaagacattctggagcagaccccggatccaggmagctcaacagacaacctgaagcacagcaccaggggcatccttggctcccaggagcccgacttcaagggcgtccagccctatgcggggatgcccaaggaggtgctgttccagttctctggccaggcccgctaccgcatacctctggagatcctcttctggctcgcagtggcttct

SEQ ID NO: 2194 - DNA, 495 bp, Homo sapiens
  CDS 20..493
  misc_feature 209: r=a or g
  misc_feature 210: r=a or g
  misc_feature 217: r=a or g
  misc_feature 220: s=g or c
  misc_feature 419: m=a or c
  misc_feature 462: s=g or c
  UNSURE 64: Xaa=Asp or Gly or Asn or Ser
  UNSURE 134: Xaa=Leu or Met
  UNSURE 148: Xaa=Ser or Thr
gcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtrrtggccarggstctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctamtgggccgaaaggtgttccctgtttccaggaatgtgcatactastcgctgccaagctctgggggtcatcacagagaa

SEQ ID NO: 2195 - DNA, 452 bp, Homo sapiens
  CDS 102..452
  misc_feature 100: n=a, g, c or t
  misc_feature 140: s=g or c
  misc_feature 275: n=a, g, c or t
  misc_feature 386: n=a, g, c or t
  UNSURE 95: Xaa=His or Gln
atagtcagtggcggcgctgaagagaccggttgccgccatgatagaacagcagaagcgtaagggcccagagttgccgctggttccagtcaagcggcagcgncatgagttgctgttgggagcggggtctggcccaggagccsgggcagcagcaggcgacgccgggagccttgctgcaagcgggacctccaagatgttcctcccttcaagccccaatcatgctgctctctggacatgaaggggaagtctactgctgcaagttccaccccaacggatcnaccttagcatctgcaggatttgaccgactgatattactgtggaatgtctatggtgactgtgataactatgccacactgaagggacacagtggagcagtgatggaattgcantacaacacagatggcagtatgcttttctcagcatccacagataaaaccgtggctgtgtgggatagt

SEQ ID NO: 2196 - DNA, 374 bp, Homo sapiens
  CDS 99..374
gctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggacaacagtgccctggggaacagcccataccatcgggctcctcgctgcatccatgtctataagaagaatggagtgggcaaggtgggcgaccagatactactggccatcaagggacagaagaaaaaggcgctcattgtggggcactgcatgcct

SEQ ID NO: 2197 - DNA, 345 bp, Homo sapiens
  CDS 184..345
  misc_feature 163: s=g or c
  misc_feature 231: n=a, g, c or t
ctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggastgcgtcggagaaagctgctcatgaactcggaacagcgcatcaaccggatcatgggctttcacaggccngggagcggcgcggaagaagaaagtcaaacaaaatcaaagcagcaggacagtgataaactgaactccctcagcgttccttccgtttcaaagcgagtagtgctgggtgattcagtc

SEQ ID NO: 2198 - DNA, 390 bp, Homo sapiens
  CDS 91..390
cattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaa

SEQ ID NO: 2199 - DNA, 232 bp, Homo sapiens
  CDS 56..232
  misc_feature 106: k=g or t
  misc_feature 211: m=a or c
  UNSURE 52: Xaa=His or Gln
ctctgtgcctcgttgtcccctggcgcacccggacatctctcagggtgccggcaccatgaagatctggacttcggagcacgtctttgaccacccgtgggaaactgtkacaacagctgcaatgcagaaatacccaaaccctatgaacccaagtgtggttggagttgatgtgttggacagacatatagatccctctggaaagttgcacagccamagacttctcagcacagagtgg

SEQ ID NO: 2200 - DNA, 265 bp, Homo sapiens
  CDS 33..263
  misc_feature 149: s=g or c
  misc_feature 228: k=g or t
  UNSURE 66: Xaa=Cys or Gly
cccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggstccagcgaccctgtgggcccccccatgcaggagctcaaggacctgggcgtcaccgtgttcattgtcagcaccggccgakgcaacttcctggagctgtcagccgctgcctcagcccc

SEQ ID NO: 2201 - DNA, 420 bp, Homo sapiens
  CDS 39..419
  misc_feature 156: m=a or c
  misc_feature 363: y=c or t
  misc_feature 366: k=g or t
  UNSURE 40: Xaa=Leu or Met
  UNSURE 109: Xaa=His or Tyr
  UNSURE 110: Xaa=Asp or Tyr
agctgcgctgccggaggaaacggaagaaggagcaagctatggaggggaacagggatgaggctgagaaatgtgtcgagatcgcccgggaggccctgaacgccggcaaccgcgagaaggcccagcgcttcctgcagaaggccgagaagctctacccamtgccttcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagcataaacaaatgtaaaaatyackatgaagtacttggagttacgaaagatgctggtgatgaagatttgaaaaaagctt

SEQ ID NO: 2202 - DNA, 249 bp, Homo sapiens
  CDS 73..249
  misc_feature 25: y=c or t
  misc_feature 26: s=g or c
aggactaggcacctctgcacgtccysccccgccggaagtggaggccgcgggctctgagcggcccctgcccggatggcaacagtagttctaggaggagacaccatgggccctgagcgtatcttccccaatcagactgaggaactgggacatcagggcccttcagaaggcactggggattggagcagtgaggagcctgaggaagagcaggaggaaacggggtcgggcccagctggctactcctaccagccc

SEQ ID NO: 2203 - DNA, 398 bp, Homo sapiens
  CDS 172..396
  misc_feature 59: s=g or c
  misc_feature 150: n=a, g, c or t
gcgcctcccggaagtggccggtccagagctgtggggtggcctccgcgcggtctctggcsgagtcggggaatcggatcaaggcgagaggatccggcagggaaggagcttcggggccgggggttgggccgcacatttacgtgcgcgaaggangtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccac

SEQ ID NO: 2204 - DNA, 353 bp, Homo sapiens
  CDS 84..353
  misc_feature 291: n=a, g, c or t
  misc_feature 292: k=g or t
  UNSURE 70: Xaa=Gly or Leu or Met or Arg or Val or Trp
aacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgagnkgctatctcggagacacatgaaggtggcattttttggcaggacaagcagtgggaagagctct

SEQ ID NO: 2205 - DNA, 294 bp, Homo sapiens
  CDS 101..292
  misc_feature 116: k=g or t
  misc_feature 127: r=a or g
  UNSURE 6: Xaa=Phe or Val
gacccggcagtacggcaaatatggcggagcatctgttgaatcttcaagtccaggaggttcagcaacatcagatgaccatgaatttgatccatcagctgacatgctggttcatgatkttgatgatgarcgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagagga

SEQ ID NO: 2206 - DNA, 633 bp, Homo sapiens
  CDS 260..631
  misc_feature 406: n=a, g, c or t
acgtaaccgttcaagcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacnactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatgga

SEQ ID NO: 2207 - DNA, 446 bp, Homo sapiens
  CDS 88..444
  misc_feature 395: k=g or t
  UNSURE 103: Xaa=Ile or Ser
ctctctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcaktgactcccccgggcatgtcgacttctcctcggaggtgactgctgccctccg

SEQ ID NO: 2208 - DNA, 322 bp, Homo sapiens
  CDS 28..321
  misc_feature 149: s=g or c
  misc_feature 150: r=a or g
  misc_feature 254: s=g or c
  misc_feature 307: s=g or c
  UNSURE 41: Xaa=Arg or Thr
  UNSURE 76: Xaa=Ser or Thr
  UNSURE 94: Xaa=Asp or His
ctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaaggasrcctcccccacgaagatctcggtccagaagccatgaccgcctgccctaccagaggaggtaccgggagcgccgtgacagcgatacataccggtgtgaagagcggasccatcctttggagaggactactatggaccttcacgttctcgtcatcgtcggcsatcgcgggagagggg

SEQ ID NO: 2209 - DNA, 343 bp, Homo sapiens
  CDS 50..343
  misc_feature 275: s=g or c
  UNSURE 76: Xaa=Ala or Pro
aagtgtgggctggggtccgcggcggcgacagcggcggcggcggccggggatgcatcactgtaagcgataccgctcccctgaaccagacccgtacctgagctaccgatggaagaggaggaggtcctacagtcgggaacatgaagggagactgcgatacccgtcccgaaggagcctcccccacgaagatctcggtccagaagccatgaccgcctgccctaccagaggaggtaccgggagcgccgtgacagcgatacataccggtgtgaagagcggasccatcctttggagaggactactatggaccttcacgttctcgtcatcgtcggcgatcgcgggagagggg

SEQ ID NO: 2210 - DNA, 403 bp, Homo sapiens
  CDS 233..403
agatcgccgaagcgtcggactaccgttggtttccgcaacttcctggattatcctcgccaaggcactttgcaatatatttttccgccttttctggaaggatttcgctgcttcccgaagtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgc

SEQ ID NO: 2211 - DNA, 492 bp, Homo sapiens
  CDS 52..492
aagggccggaccgcagctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaatttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagct

SEQ ID NO: 2212 - DNA, 195 bp, Homo sapiens
  CDS 32..193
tgttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgc

SEQ ID NO: 2213 - DNA, 197 bp, Homo sapiens
  CDS 15..197
gcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggt

SEQ ID NO: 2214 - DNA, 444 bp, Homo sapiens
  CDS 150..443
  misc_feature 126: r=a or g
  misc_feature 135: r=a or g
  misc_feature 310: n=a, g, c or t
  misc_feature 311: s=g or c
  misc_feature 373: r=a or g
  misc_feature 374: n=a, g, c or t
  misc_feature 389: s=g or c
  misc_feature 443: m=a or c
  UNSURE 54: Xaa=Ala or Asp or Glu or Gly or Val
  UNSURE 75: Xaa= *  or Cys or Trp or Tyr
  UNSURE 80: Xaa=Asp or Glu
  UNSURE 98: Xaa=Lys or Asn
ctccattgggcacatctgggaggaaggcaacctcctttgtcgtcttgttggtaccagtcattctcaagtatctctgacacctgtggtggttcagtttgctgagcctgccacctggtatgaattagrctgggtgtratgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgnstttccccaccaggtactcagaggtctgcaggaagtgactcccgggcaaggcagacttcagtrntccctgaagcgtgasatgtggactgcatggctgggtggggactggtggatgtctctggagctccagaamc

SEQ ID NO: 2215 - DNA, 235 bp, Homo sapiens
  CDS 24..233
  misc_feature 96: s=g or c
  UNSURE 25: Xaa=Ala or Pro
acaataatcactgaacattgaatatgaaggtgtcggctctaacgtggcctcagctcgaggttcaggggaaagagaaacagtccagcagtcagaggsccttggatggagtcctgctgtcgcccaggctggagtgcaatggcacaatctcggctcactgcaacctccaccttctgggttcaagtgattctcctgcctcagcctcccaagtagcaggggttacaggtgcccgccatca

SEQ ID NO: 2216 - DNA, 256 bp, Homo sapiens
  CDS 34..255
  misc_feature 18: n=a, g, c or t
tatttatgtgacctgtgngggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattac

SEQ ID NO: 2217 - DNA, 427 bp, Homo sapiens
  CDS 21..425
  misc_feature 223: n=a, g, c or t
  misc_feature 320: n=a, g, c or t
  misc_feature 321: n=a, g, c or t
  UNSURE 68: Xaa=Leu or Pro or Gln or Arg
  UNSURE 100: Xaa=Phe or Leu
  UNSURE 101: Xaa=Cys or Gly or Arg or Ser
agtgtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcngccccccagctcagctgctcagtaccttcagcaaatgtatgcagcccaacaacagcacttgatgctgcatactgcagctcttcagcagcagcatttnngcagctcccagcttcagagccttgctgctgttcaggcaagtttgtccagtggaagaccatctacatctcccacaggaagtgtcacacagcagtcaagtatgtccca

SEQ ID NO: 2218 - DNA, 638 bp, Homo sapiens
  CDS 471..638
  misc_feature 74: s=g or c
  misc_feature 81: s=g or c
  misc_feature 83: k=g or t
  misc_feature 357: m=a or c
  misc_feature 520: s=g or c
  misc_feature 521: m=a or c
  misc_feature 575: m=a or c
  misc_feature 597: m=a or c
  misc_feature 604: w=a or t
  misc_feature 605: w=a or t
  UNSURE 17: Xaa=Ala or Gly
  UNSURE 43: Xaa=Lys or Gln
  UNSURE 45: Xaa= *  or Phe or Leu or Tyr
tctcatttcctcccagcctcgtgcgggaaatggctttaattctgacggcagggctgtgagggactagcgggaasccggagsckttttgtcaaggaactgcggcgtcggttgccagtcaaccccgccgccgcggagccgctgcactgctgggggatctcccagcagctctgacgagcgcgggctgcagcatgggcagaaaacgctgctctgcagattagctgggtggattttttaagcgcaccccaccccccaaacccataaataacaaaaccaacccgcagtggccgaccggagatagctaagatgccgcgcaggagtttccacctggatgtttgaggttgtgtagatgtggccggmacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggsmaggccttactttgaccgcttctcagaggacgaccccgagtacatgcgccttcgmaaccgggcggcggacctgcggmaggactwwaacctgatggagcagaagaagcgcgtcaccatg

SEQ ID NO: 2219 - DNA, 305 bp, Homo sapiens
  CDS 135..305
cccccccgctcttacgcggtctgtgggagaccggagcgggagacagcggtgacaggagcagcggccgggagcccttagggaggcagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacggatgttcctgatgacatacagcctatcacc

SEQ ID NO: 2220 - DNA, 332 bp, Homo sapiens
  CDS 3..332
  misc_feature 7: s=g or c
  misc_feature 17: r=a or g
  misc_feature 148: y=c or t
  misc_feature 153: r=a or g
  misc_feature 164: s=g or c
  misc_feature 183: s=g or c
  misc_feature 185: s=g or c
  misc_feature 222: r=a or g
  misc_feature 228: s=g or c
  misc_feature 229: k=g or t
  misc_feature 237: r=a or g
  UNSURE 2: Xaa=Pro or Arg
  UNSURE 49: Xaa=Leu or Pro
  UNSURE 51: Xaa=Gly or Arg
  UNSURE 61: Xaa=Asp or Glu or His or Gln
  UNSURE 74: Xaa=Gly or Arg
  UNSURE 76: Xaa=Gly or Leu or Arg or Val
  UNSURE 79: Xaa=Ala or Thr
caatgcscatgcgcgargcgcgagcggtttctcccaacacagtggttcccacggttgtcttggaaaccagaccccgaggcttggcagagcaggagccctcggtggcagtgcttgggtgtcgaggctctgaggctccggcctcacctcyccacrgggtcgaaggsaacgtctccggatgccagsastcgcaaagggccgaccatgatgatgaaaccccaggcrgagacskggaagcarcacgggatcccagcctcaggcctgcacggacggtgttggttgggtcactgtcatggctaagaaagcaactccaacccacacactgcaaatatgaa

SEQ ID NO: 2221 - DNA, 281 bp, Homo sapiens
  CDS 109..279
  misc_feature 76: s=g or c
gagcctaggactgagggcgatggctgctgtggccgtggctgttcgcgaggactcgggatccgggatgaaggcggasttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcg

SEQ ID NO: 2222 - DNA, 423 bp, Homo sapiens
  CDS 70..423
gctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggca

SEQ ID NO: 2223 - DNA, 436 bp, Homo sapiens
  CDS 135..434
  misc_feature 116: s=g or c
  misc_feature 428: n=a, g, c or t
  misc_feature 430: r=a or g
  UNSURE 99: Xaa=Lys or Arg
atttccgcccacgtgggaagctatgaggtatagacccggctagaatctgaagtgcgggagagtgctggaccctgagtgatggggccggcgccagctggagagcagcttcgcggagsactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtnarggtgcc

SEQ ID NO: 2224 - DNA, 342 bp, Homo sapiens
  CDS 155..340
  misc_feature 335: r=a or g
  UNSURE 61: Xaa=Gly or Arg
ttttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgrgacggga

SEQ ID NO: 2225 - DNA, 431 bp, Homo sapiens
  CDS 104..430
  misc_feature 316: n=a, g, c or t
  misc_feature 317: n=a, g, c or t
  misc_feature 320: k=g or t
  misc_feature 321: r=a or g
  misc_feature 379: w=a or t
  misc_feature 380: r=a or g
  UNSURE 72: Xaa=Ala or Pro or Ser or Thr
  UNSURE 73: Xaa=Cys or Asp or Gly or Tyr
  UNSURE 92: Xaa=Phe or Leu
  UNSURE 93: Xaa=Asp or Asn
agttggagggaggcagggaatctggcttgattggcgtgctgagacgcacctggcgcaaccctcccttctgaatcgaagttcaagtcccgcggacactgcaaccatgaaggagagacgggccccccagccagtcgtggccagatgtaagctcgttctggtcggggacgtgcagtgtgggaagaccgcgatgttgcaagtgttagcgaaggattgctatccagagacctatgtgcccaccgtgttcgaaaattacacagcctgtttggagacagaggaacagagggtggagcttagtctctgggatacctcaggatcnncckrctacgataatgtccgtccactctgctacagcgactcggatgcagtattactatgtttwracatcagccgtccagagacagtggacagcgcactcaagaagtggaggacag

SEQ ID NO: 2226 - DNA, 301 bp, Homo sapiens
  CDS 81..299
  misc_feature 63: s=g or c
  misc_feature 66: s=g or c
aggatggagggcgaggcctggcagctgtagtgcttctgggcagtagaggcgcggggtgcggastasggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggc

SEQ ID NO: 2227 - DNA, 441 bp, Homo sapiens
  CDS 236..439
actcctagctcatctgggcggcggcggcaactggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcc

SEQ ID NO: 2228 - DNA, 461 bp, Homo sapiens
  CDS 59..460
  misc_feature 22: s=g or c
  misc_feature 27: k=g or t
  misc_feature 28: y=c or t
  misc_feature 118: r=a or g
  misc_feature 329: s=g or c
  misc_feature 330: m=a or c
  misc_feature 395: n=a, g, c or t
  misc_feature 424: y=c or t
  misc_feature 426: s=g or c
  misc_feature 434: n=a, g, c or t
  UNSURE 91: Xaa=Ala or Glu or Pro or Gln
  UNSURE 113: Xaa=Cys or Gly or Arg or Ser
  UNSURE 123: Xaa=Ser or Thr
  UNSURE 126: Xaa=Leu or Met or Val
gcaggaccccaagtgggggtcscggakycagagggccaattcctgtccccccagcagcatggcatcgtgtgctgaaccctctgagccctctgccccactgcccgccggggtcccaccrctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccasmagagtggctggacattctggggaacgggctgttgaggaagaagacgctggtcccagggccgccangttcgagcgccggtcaaggccaggtggtyascgtacatntgcagacgtcgctggagaatgcacacg

SEQ ID NO: 2229 - DNA, 426 bp, Homo sapiens
  CDS 39..425
  misc_feature 356: n=a, g, c or t
  misc_feature 357: s=g or c
  UNSURE 106: Xaa=Lys or Asn
  UNSURE 107: Xaa=Leu or Val
agcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatctgattcgctccatcaatgacccggagcatccactgacgctagaggagttgaacgtagtagagcaggtgcgggttcaggttagcgaccccgagagtacagtggctgtggctttcacaccaaccattccgcactgcagcatggccacccttattggtctgtccatcaaggtcaansttctgcgctcccttcctcagcgtttcaagatggacgtgcacattactccggggacccatgcctcagagc

SEQ ID NO: 2230 - DNA, 368 bp, Homo sapiens
  CDS 198..368
aggttggttcagcccccgtctacactggggtggtgcttagccggcgccacaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaata

SEQ ID NO: 2231 - DNA, 459 bp, Homo sapiens
  CDS 126..458
  misc_feature 388: m=a or c
  misc_feature 389: m=a or c
  misc_feature 419: y=c or t
  misc_feature 425: s=g or c
  misc_feature 451: k=g or t
  UNSURE 88: Xaa=Ala or Asp or Glu
  UNSURE 109: Xaa=Leu or Trp
attcattgtcttgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgmmtggtgcccgcacaatgacaacgtcattgcyagtggstccgaggactgcacagtcatggtgtkggagatcc

SEQ ID NO: 2232 - DNA, 313 bp, Homo sapiens
  CDS 136..312
  misc_feature 117: m=a or c
atcaatatttcatcggcgtcaataggaggcatcggggacagccgctgcggcagcactcgagccagctcaagcccgcagctcgcagggagatccagctccgtcctgcctgcagcagcmcaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagacca

SEQ ID NO: 2233 - DNA, 460 bp, Homo sapiens
  CDS 136..459
  misc_feature 385: n=a, g, c or t
  UNSURE 84: Xaa=Gly or Arg or Trp
atttaaaggggccgcgacccctgtcccggctgctagggagggaggtagagaaggagcgcggggccgtcgctgtctgcagttctaggcttgtagcctttgcactaaccctgccgcagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctggggnggctgctctataaagccccctctcccccggaggtggaccacggtcctgagggaacctggcatgggatgcaggaga

SEQ ID NO: 2234 - DNA, 289 bp, Homo sapiens
  CDS 31..288
agtgcctggcaccttgtacgtattcacttcatgacggaatggatgaacgaggctgttcttttagattgggctctgtcacgggcagccctgaggttttctgcacgtatgtgtgctgagcccctgtctttctggtgttggcaggacgagcagctgagggccctggtgaggcagtttggacagcaggactggaagttcctggccagccacttccctaaccgcactgaccagcaatgccagtacaggtggctgagagttttgaatccagaccttgtcaaggggccatggacca

SEQ ID NO: 2235 - DNA, 368 bp, Homo sapiens
  CDS 66..368
  misc_feature 81: k=g or t
  misc_feature 104: n=a, g, c or t
  UNSURE 6: Xaa=Leu or Val
ggaagttttctgtcactggacgccaaggagttttcggtggctcagctgggtaaccggggatcaccatggcggcctcattgktggggaagaagatcgtgtttgtnacggggaacgccaagaagctggaggaggtcgttcagattctaggagataagtttccatgcactttggtggcacagaaaattgacctgccggagtaccagggggagccggatgagatttccatacagaaatgtcaggaggcagttcgccaggtacaggggcccgtgctggttgaggacacttgtctgtgcttcaatgcccttggagggctccccggcccctacataaagtggtttctggagaagttaaagcctgaaggtctccac

SEQ ID NO: 2236 - DNA, 387 bp, Homo sapiens
  CDS 91..387
acttcgtctttagctcctggcgctgctggcttctgggcggtttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcaaatgtctgttcaaagaattgtggaagacgctcctcctatagacctacaggctgaagctcagcatgctagtggagaagttgaagaaccgccacgatatttgctgaagtttgaacaaatttatctttccaagcctacccattgg

SEQ ID NO: 2237 - DNA, 410 bp, Homo sapiens
  CDS 238..408
  misc_feature 179: r=a or g
  misc_feature 195: r=a or g
  misc_feature 201: r=a or g
  misc_feature 202: h=a or c or t
  misc_feature 216: r=a or g
  misc_feature 235: k=g or t
  misc_feature 236: r=a or g
  misc_feature 297: w=a or t
  misc_feature 298: m=a or c
  misc_feature 344: r=a or g
  misc_feature 366: b=c or g or t
  misc_feature 378: m=a or c
  UNSURE 21: Xaa=Leu or Met
  UNSURE 36: Xaa=Asn or Ser
  UNSURE 43: Xaa=Ile or Met
attttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcargaggctcaggactcarattcarhctctgaggggaggrgccgctggtggagaagcakrcatggacttcctgcggaacttattctcccagacgctcagcctgggcagccagaaggagcgwmtgctggacgagctgaccttggaaggggtggcccggtacatgcagarcgaacgctgtcgcagagtcatbtgtttggtgggmgctggaatctccacatccgcaggcaatccccg

SEQ ID NO: 2238 - DNA, 360 bp, Homo sapiens
  CDS 46..360
  misc_feature 140: w=a or t
  misc_feature 141: m=a or c
  misc_feature 149: n=a, g, c or t
  misc_feature 156: r=a or g
  misc_feature 164: m=a or c
  misc_feature 173: m=a or c
  UNSURE 32: Xaa=Asp or Glu or Val
  UNSURE 35: Xaa=Ala or Glu or Gly or Val
  UNSURE 40: Xaa=Pro or Gln
  UNSURE 43: Xaa=Ala or Glu
gaacctcagagcatcagttggaattacgatctgaggctgtcagagatgactctggttctgtccatgaatagattctgcgagcccattgtctcggaaggagctgctgaaattgctgggtaccaaacactatgggaggctgwmagctacgnaggcccragcccccmagggccagmacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaaccatctcaatttttgaggacgag

SEQ ID NO: 2239 - DNA, 393 bp, Homo sapiens
  CDS 122..391
  misc_feature 126: s=g or c
  misc_feature 128: r=a or g
  misc_feature 129: r=a or g
  misc_feature 130: r=a or g
  misc_feature 131: r=a or g
  misc_feature 132: m=a or c
  misc_feature 352: w=a or t
  misc_feature 353: n=a, g, c or t
  UNSURE 2: Xaa=Ala or Gly
  UNSURE 3: Xaa=Glu or Gly or Lys or Arg
  UNSURE 4: Xaa=Ala or Asp or Asn or Thr
  UNSURE 77: Xaa=Asp or Glu
  UNSURE 78: Xaa=Asp or His or Asn or Tyr
gacgccatcgcagcacgccgggagtgtggcgttctgtgaagagttcggtgctaacctccctcacgcggcggtggctgccgggaccctagcaggtttcagctggagcggcggcggcggcaacatggsarrrrmcgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgawnacgaggtgctggtgacagccagtcgggcattgctgctggc

SEQ ID NO: 2240 - DNA, 478 bp, Homo sapiens
  CDS 29..478
  misc_feature 141: y=c or t
  UNSURE 38: Xaa=Leu or Pro
tcgttggctggatgaatctgatgcggaaatggagctcagagctaaggaagaagagcgcctaaataaactccgactggaaagcgaaggctctcctgaaactcttacaaacttaaggaaaggatacctgtttatgtataatcytgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcatt

SEQ ID NO: 2241 - DNA, 453 bp, Homo sapiens
  CDS 179..451
  misc_feature 40: s=g or c
  misc_feature 45: k=g or t
agagcgcggaggagccgcgagcgctgagggtgagtgccgsgagckctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgag

SEQ ID NO: 2242 - DNA, 258 bp, Homo sapiens
  CDS 20..256
  misc_feature 128: y=c or t
  UNSURE 37: Xaa=Phe or Leu
ccctgcgtcggggggcaagatggcagcccaggctttggcgctgctgagagaggtagcgaggctggaagcgccgctggaggagctacgcgcgcttcactccgtgctgcaggcagtgccgctcaacgagyttcgccagcaagcggcggagtgcgcctcggcccgctcttctccctgcttaacgagaaccatagggaaaagactactttgtgtgtatccattctggagagattgctccaagctatggaaccggttcacgtg

SEQ ID NO: 2243 - DNA, 431 bp, Homo sapiens
  CDS 41..430
  misc_feature 302: k=g or t
  misc_feature 353: r=a or g
  misc_feature 354: n=a, g, c or t
  misc_feature 355: w=a or t
  misc_feature 366: m=a or c
  UNSURE 88: Xaa= *  or Gly
  UNSURE 105: Xaa=Ala or Asp or Glu or Gly or Ile or Lys or Asn or Arg or Ser or Thr or Val
  UNSURE 109: Xaa=His or Pro
agtgcgcgcctagcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattackgatgttcgggccgtcctgcatctcctgctctcggtgcccgccggcttctgrnwggccaccatcmttgggaccgcctgcctggccattgcgagcggcatctacctactggcggctgtgcgtggcgagcag

SEQ ID NO: 2244 - DNA, 326 bp, Homo sapiens
  CDS 23..325
gcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtg

SEQ ID NO: 2245 - DNA, 334 bp, Homo sapiens
  CDS 151..333
agaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggccctggggggtgtgaagcctgcagtcctgacacgctctggggatccttcacagcctctgctcccccaacactcctcactggagacacagctcttctgtgagcagggagatgggggcacagaagggc

SEQ ID NO: 2246 - DNA, 372 bp, Homo sapiens
  CDS 124..372
  misc_feature 31: s=g or c
  misc_feature 38: s=g or c
agtcccacccgggagccggcagggagcggastgcggascgcctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcg

SEQ ID NO: 2247 - DNA, 153 bp, Homo sapiens
  CDS 1..153
  misc_feature 13: s=g or c
  misc_feature 123: s=g or c
  misc_feature 124: r=a or g
  UNSURE 5: Xaa=Glu or Gln
  UNSURE 41: Xaa=Asp or Glu
  UNSURE 42: Xaa=Asp or Asn
atgttgaggggcsagcacccgcccgcccgctgcagggacgccccgccaacgccactgccgcttcagctggatggctggatccatgagaagatgctgatggcgcgggatggcacgcgggaggasraccacaagctgcataagagatggctccgg

SEQ ID NO: 2248 - DNA, 436 bp, Homo sapiens
  CDS 256..435
  misc_feature 11: s=g or c
  misc_feature 129: r=a or g
  misc_feature 218: r=a or g
  misc_feature 224: s=g or c
  misc_feature 226: r=a or g
  misc_feature 230: r=a or g
  misc_feature 364: n=a, g, c or t
  misc_feature 381: n=a, g, c or t
  UNSURE 37: Xaa=Asp or His or Asn or Tyr
agttctccggsagcgccggtcggaggcggtcggcggaggtgtctaccccgccggtgatggcgttgaacgccactggcttcccggccttccgtccgctgcctccgtccgattctgcgtctgcttgctgargaggcggattaggggggcgcggagtctcttcccttgagtgcataggtcccggttggtagagggtttgagtccgcatcgccacagctgarggctgsgrgggrctaagagcagaatatatctttagaaatgagttgcacaattgagaaggcacttgccgacgctaaagctcttgttgaaagattaagagatcatgacgatgcagcagaatctctgattgagcaaaccacagctctcnacaagcgagtagaagcnatgaaacagtatcaggaagaaattcaagaacttaatgaagtcgcgagacatcggc

SEQ ID NO: 2249 - DNA, 397 bp, Homo sapiens
  CDS 161..397
atgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatc

SEQ ID NO: 2250 - DNA, 358 bp, Homo sapiens
  CDS 33..356
  misc_feature 26: r=a or g
  misc_feature 248: w=a or t
ccggggtttgtagcggaggaggagcrggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggwgatcaagcaagcttttttgaggcagaaaaagtcccaagaattaagcacaagaagaaaggcacagtgtccatggtgaataatggcagtgatcaacatggatctcagtttct

SEQ ID NO: 2251 - DNA, 284 bp, Homo sapiens
  CDS 72..284
  misc_feature 241: s=g or c
  UNSURE 57: Xaa=Pro or Arg
accctagaggcccaggccccccaacggctgacccctgcacactccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcaggccctgccccacaggcccctacagcstccacagccactaagcctgcacccccaagtgaagatgtcccca

SEQ ID NO: 2252 - DNA, 424 bp, Homo sapiens
  CDS 101..424
  misc_feature 13: w=a or t
  misc_feature 14: y=c or t
  misc_feature 23: r=a or g
  misc_feature 24: n=a, g, c or t
  misc_feature 27: m=a or c
  misc_feature 28: w=a or t
  misc_feature 315: w=a or t
  misc_feature 316: r=a or g
  UNSURE 72: Xaa= *  or Leu
ggaaccggaagtwycgtgttgtrnggmwcagctggttcatttatgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggcctwrccagtgagaacatcctacaaagcatttagtacaagatggaactggaatgaatggctgaaactaccagtaaaataccctgacctgcccaggaatgcccaagtggccctc

SEQ ID NO: 2253 - DNA, 276 bp, Homo sapiens
  CDS 28..276
  misc_feature 2: w=a or t
gwcagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggc

SEQ ID NO: 2254 - DNA, 422 bp, Homo sapiens
  CDS 83..421
  misc_feature 152: k=g or t
  misc_feature 326: s=g or c
  misc_feature 406: n=a, g, c or t
  UNSURE 24: Xaa=Ala or Ser
  UNSURE 82: Xaa=Ala or Pro
ctgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatgkcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcascagcagccgccacagttgcagttgccaggcctgctccagtagctgttgcagctgctgcaacagctgctgcttatggaggntacccactgcacacac

SEQ ID NO: 2255 - DNA, 270 bp, Homo sapiens
  CDS 101..268
  misc_feature 68: y=c or t
  misc_feature 184: s=g or c
agttcccgttgcccaagcaactagggcccggagcccggggtgctggagggaggcggcaggcccgggtyaggggcctcgagatcgggcttgggcccagagcatgttccagatcccagagtttgagccgagtgagcaggaagactccagctctgcagagaggggcctgggccccagccccgcaggsacgggccctcaggctccggcaagcatcatcgccaggccccaggcctcctgtgggacgccagtcaccagcaggagcagccaaccagc

SEQ ID NO: 2256 - DNA, 230 bp, Homo sapiens
  CDS 42..230
  misc_feature 191: m=a or c
  UNSURE 50: Xaa=Asp or Glu
agtctcaggctcagcgctcagccctacacatcgcctcttgcatgcaactcacagagagggagaggcaacctgtcctcccctctctcagcctcggcatctccagccaccaaggacctgcttttcgcacctccaacaacccctcccttctaccctgccactccctcccagagagaaaggaaaaggagagagamagattctggaatttgaacctacccaaagaggaaacatac

SEQ ID NO: 2257 - DNA, 535 bp, Homo sapiens
  CDS 65..535
  misc_feature 304: n=a, g, c or t
  misc_feature 316: m=a or c
  misc_feature 439: w=a or t
  UNSURE 84: Xaa=Asp or Glu
agagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccnaatcgtagagamcgagaagctataattttatcatcttatgctggaatcttaatgaacagtatcccgattgaggaagtctttaaaatttatggggctgattcttctgccgattctggtaccatcaaggttccccgwgtttcatctctccgcctctccttgcacccctttgccatgttaacagcacccaaagcagcagcatacgcccgcaaacagggtgtcaagtcaagaaag

SEQ ID NO: 2258 - DNA, 347 bp, Homo sapiens
  CDS 167..346
aagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccagggggatggcgtccactccgatggggaatgagggggagaagaagagcagctggccatctcaagctgcaccctccttgagaggaggtccggcttcgttatctcgttctgaggaatacctgtcccagatcagtgcagaactcatggaggaggctttgtgcactgcttgctgccacttgaaccctgtgc

SEQ ID NO: 2259 - DNA, 457 bp, Homo sapiens
  CDS 130..456
  misc_feature 409: r=a or g
  misc_feature 417: n=a, g, c or t
  misc_feature 419: n=a, g, c or t
  misc_feature 420: n=a, g, c or t
  misc_feature 421: k=g or t
  UNSURE 94: Xaa=Ile or Val
  UNSURE 97: Xaa=Ile or Lys or Met or Asn or Arg or Ser or Thr
  UNSURE 98: Xaa=Asp or Tyr
ctgagtgtgacgtcagaatcaccatggccagctttccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagrtcacagtnannkatatctccatgaaggagctaaagcaggccctggtca

SEQ ID NO: 2260 - DNA, 316 bp, Homo sapiens
  CDS 41..316
  misc_feature 73: r=a or g
gaaggagcagagcgaccggaagcgcggagggagccgcgggatggaccgcagcctgccagttttctccattcargatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcaccc

SEQ ID NO: 2261 - DNA, 419 bp, Homo sapiens
  CDS 18..419
  misc_feature 273: y=c or t
  misc_feature 275: y=c or t
  misc_feature 279: y=c or t
  misc_feature 288: w=a or t
  misc_feature 289: m=a or c
  misc_feature 341: r=a or g
  UNSURE 86: Xaa=Pro or Ser
  UNSURE 88: Xaa=Cys or Arg
  UNSURE 91: Xaa=Asn or Ser or Thr or Tyr
aagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacacctycygagygtctgctcwmtccccttccaccctcagcggatgataatctcaagacacctcccgagtgtctrctcactccccttccaccctcagctctaccctcagcggatgataatctcaagacacctgcggagtgtctgctctacccc

SEQ ID NO: 2262 - DNA, 331 bp, Homo sapiens
  CDS 55..330
  misc_feature 319: w=a or t
  UNSURE 89: Xaa= *  or Lys
agcctgggccgctgcgcagaggcgcggcggctgtacaactcggccgttgtcaccatgccggtcgtccggaagattttccgtcgccgccggggcgactcggagtcagaggaagatgagcaggactcagaggaggttcgattaaaactggaagagaccagagaggtacagaacttgaggaagaggcccaacggggtgagtgctgtggccttgctggtgggagagaaggtacaagaggagaccactctagtggatgatccctttcagatgaagacaggtggtatggtggatatgaagaaactgaaggaaaggggcaaagatwagatcagtgagg

SEQ ID NO: 2263 - DNA, 452 bp, Homo sapiens
  CDS 68..451
ggcgtggggcggaagcacgatctccggcagcggcctgggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctca

SEQ ID NO: 2264 - DNA, 443 bp, Homo sapiens
  CDS 269..442
  misc_feature 71: k=g or t
ccttgcaccgcccacgtggccagcgccacctgcctcattgtgcccaggagttctccaaacccgcgctgcgkagtccttcctcgggaggcggcgaaggcggtccaccctgcgcgtgatccttcatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggagc

SEQ ID NO: 2265 - DNA, 481 bp, Homo sapiens
  CDS 307..480
  misc_feature 67: k=g or t
  misc_feature 69: r=a or g
  misc_feature 89: m=a or c
  misc_feature 125: k=g or t
  misc_feature 216: m=a or c
ctccaaacccgcgctgcggagtgagtgaccaagttccggccagttcgacctcgaggatccagaggtkgragacggtactacctcccagmtctgttttccatccccttcaggtccttcctcgggakacggcgaaggcggtccaccctgcgcgtgatccttcatgcccggcccctgcccctccctccgggtggaacttccccctcaccgccagacttmagctgaggatcgttggatctctggcggggtgcagaactgagcccaggccacagtaccctattcacgctctgtgcttgtgccaagggggcaatggcggcttcctgtgttctactgcacactgggcagaagatgcctctgattggtctgggtacctggaagagtgagcctggtcaggtaaaagcagctgttaagtatgcccttagcgtaggctaccgccacattgattgtgctgctatctacggcaatgagcctgagattggggagc

SEQ ID NO: 2266 - DNA, 421 bp, Homo sapiens
  CDS 169..420
  misc_feature 312: s=g or c
  misc_feature 314: m=a or c
  misc_feature 368: n=a, g, c or t
  UNSURE 49: Xaa=Ala or Glu
  UNSURE 67: Xaa=Lys or Met or Arg or Thr
gagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagaggsgmggtcttcattgttgggggagcaaatccaaacagaagcttctcagacgtgcacanggttggatctggacactctgacctggtcacagccagagacacttggaaatcct

SEQ ID NO: 2267 - DNA, 255 bp, Homo sapiens
  CDS 85..255
agagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaaggg

SEQ ID NO: 2268 - DNA, 246 bp, Homo sapiens
  CDS 58..246
  misc_feature 43: r=a or g
  misc_feature 171: y=c or t
ccgtggtgaagcaaggctttgagcctccctcctttgtgggctrgttccttggctgggatgatgattactggtctgtggaccccttggacagggccatggctgagctggctgcctgaggaggggcagggcccacccatgtcaccggtcagtgccttttggaactgtccttcyctcaaagaggccttagagcgagcagagcagctctgctatgagtgtgtgtgtgtgtgtgtgttgtttctttttttt

SEQ ID NO: 2269 - DNA, 326 bp, Homo sapiens
  CDS 150..326
atttcttcttcgtggttgtgtgcatgcggtgggattgtgagagtgcgttcatgagaactgtgggcggcgttggctgcttctaagtgtggtcttcttggcgacaggctctgtgtccgagtgtggtgtgcctgcgcggttggggtgtgtagatgtggacccttcgaggcccttctgcgttttcttcgttgcgtacgattgtgctccgttggtgttctcagcagggatctgattctgtgtgtgggggtgtgtggcccctgcgactgtgtttgggtggtgtcgtcgttatgtcgggcgtgtgtgatcccgactgtgctggattgtgtgtc

SEQ ID NO: 2270 - DNA, 300 bp, Homo sapiens
  CDS 133..300
  misc_feature 103: s=g or c
  misc_feature 104: s=g or c
  misc_feature 148: k=g or t
  misc_feature 155: r=a or g
  misc_feature 204: r=a or g
  misc_feature 257: r=a or g
  UNSURE 6: Xaa=Phe or Val
  UNSURE 8: Xaa=Asp or Gly
  UNSURE 42: Xaa=Asp or Gly
actctcgtctggccgccgcgctttcaggaggtgcttttggttctctccggtcttgtccacgctagggggtgcacgtactcccaactgtggtcgcgctctcacsscttctgctgctctcgtggccccctcgcgatggcgggcatcctgkttgaggrtattttcgatgtgaaggatattgacccggagggcaagaagtttgaccgrgtgtctcgactgcattgtgagagtgaatctttcaagatggatctaatcttagrtgtaaacattcaaatttaccctgtagacttgggtgacaagttt

SEQ ID NO: 2271 - DNA, 431 bp, Homo sapiens
  CDS 69..431
  misc_feature 32: n=a, g, c or t
aacttctccagccggccggggcgagcgccacncggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacactgggcagcttctatgctccccgggtctggtggatgttccgtgtgtttggccacc

SEQ ID NO: 2272 - DNA, 364 bp, Homo sapiens
  CDS 40..363
  misc_feature 235: n=a, g, c or t
  UNSURE 66: Xaa=Ala or Pro or Ser or Thr
cacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaancaaatggtatgtttttcagtacagttggatgtcatcctacaagatgtggtgaatttgaaaagaataaccctgatctttacttaaaggagttgctaaatcttgctgaaaacaataaagggaaagttgtgg

SEQ ID NO: 2273 - DNA, 212 bp, Homo sapiens
  CDS 17..211
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtc

SEQ ID NO: 2274 - DNA, 245 bp, Homo sapiens
  CDS 1..243
  misc_feature 30: r=a or g
atgttacttcctgtatggaggcatggccartttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccgggg

SEQ ID NO: 2275 - DNA, 296 bp, Homo sapiens
  CDS 96..296
  misc_feature 26: n=a, g, c or t
  misc_feature 260: s=g or c
aaactgagcaacagccacgacagtgnacgcgagcgtctcctctgtgcgcatgcgcccgctcagcggcctgcttctatttatgtgggggatccaacatggcggccgcggcgaccctggcgatggcggtgaagcccatcagaacgtatagcggggaaggggacacggtccgcactcaccgtggcgccggcggagacgttgagggtggtggagggaagaaaagcgacagagagcaagaggaagggcgggcaggcacgcagcgsgccgtagaagcgagcgccggctcgagcaaaagcgga

SEQ ID NO: 2276 - DNA, 250 bp, Homo sapiens
  CDS 58..249
atttttttatttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagg

SEQ ID NO: 2277 - DNA, 345 bp, Homo sapiens
  CDS 70..345
  misc_feature 144: r=a or g
  misc_feature 146: w=a or t
  misc_feature 151: k=g or t
  misc_feature 253: s=g or c
  misc_feature 254: n=a, g, c or t
  misc_feature 255: w=a or t
  UNSURE 26: Xaa=Glu or Val
  UNSURE 28: Xaa=Gly or Trp
  UNSURE 62: Xaa=Ala or Asp or Glu or Gly or His or Leu or Pro or Gln or Arg or Val
agagcaggcccgggagccgggaggtgcgggcggcggcgctggacccgacgcggcgagagaggccccgagatgccgagcaagaagaagaagtacaacgcgcggttcccgccggcgcggatcaagaagatcatgcagacggacgargwgattkggaaggtggcggcggcggtgcctgtcatcatctcccgggcgctcgagctcttcctagagtcgctgttgaagaaggcctgccaggtgacccagtcgcggaacsnwaggaccatgaccacatcccacctgaagcagtgcatcgagctggagcagcagtttgacttcttgaaggacctggtggcatctgttcccgac

SEQ ID NO: 2278 - DNA, 214 bp, Homo sapiens
  CDS 11..214
agtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaaggtactagtgtgacctctctgtggccgcattgggtgtccttaagcatgtgg

SEQ ID NO: 2279 - DNA, 487 bp, Homo sapiens
  CDS 202..486
  misc_feature 99: s=g or c
  misc_feature 146: n=a, g, c or t
  misc_feature 147: r=a or g
  misc_feature 151: s=g or c
agagaggggcgcggggggcgggggtggtggggcttctggactgagccgctgagggtgcgggctgaccctgtaagtggctgcggcgggaagatggcggastgcgcgtgctcgtagctgtcaagagggtcatcgactacgccgtgaanratcsgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaacc

SEQ ID NO: 2280 - DNA, 404 bp, Homo sapiens
  CDS 150..404
  misc_feature 136: m=a or c
  misc_feature 147: s=g or c
  misc_feature 368: s=g or c
  UNSURE 73: Xaa=Asp or Glu
agcgcaccacccctgggttccctcccgggtccgcagtggaaacactgccctctcccttcttgacccctagcccttccttccctccctccttccctcctgtcgccgtctcttctggcgccgctgctcccggaggagmtcccggcacgscgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagasggagaggaccaggtaaacttccgtggattcatgcga

SEQ ID NO: 2281 - DNA, 263 bp, Homo sapiens
  CDS 99..263
tttttctcgcttgctttctctcccggcctcatgcgtttcccccccctcgcggcgctcgcccgctctccctcgctctcgctctgtcttttttgggcgccatgctgaggggaagggaagatggagagttggaagaaggtgaattggaagatgatggggcagaggagacccaggatacctccggagggcctgagagaagccggaaagaaaagggggagaagcatcacagtgattcggatgaggagaagtcccacaggagacgaagc

SEQ ID NO: 2282 - DNA, 333 bp, Homo sapiens
  CDS 51..332
atggagaggcggcggccgcggctgctgaggcggaggctgaggcagtggcgatggcgccctttcctgaagaagtggacgtcttcaccgccccacactggcggatgaagcagctggtggggctctactgcgacaagctttctaaaaccaatttttccaacaacaacgatttccgtgctcttctgcagtctttgtatgctactttcaaggagttcaaaatgcatgagcagattgtaaatgaatacattattggtttgcttcaacaacgcagccagaccatttataatgtacattctgacaaaaactctccgagatgcttagcctctttgaaaaggg

SEQ ID NO: 2283 - DNA, 267 bp, Homo sapiens
  CDS 103..267
  misc_feature 125: y=c or t
  misc_feature 133: r=a or g
  UNSURE 8: Xaa=Leu or Pro
  UNSURE 11: Xaa=Glu or Lys
ttcccgtgcgagatgacccctccgatgtgactgacgaggatgagggccctgccgagccgcccccaccccccaagctccctctccccgccttcagactgaagaatgactcggacctcttcggggcyggggctgraggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaag

SEQ ID NO: 2284 - DNA, 424 bp, Homo sapiens
  CDS 178..423
  misc_feature 126: k=g or t
  misc_feature 381: n=a, g, c or t
attgcccactttactgttttggctccagactgtcgttaagaatgtacagcctaattctggtgtgtttcgggatattcttctgtccagtattctggaagggcggggaggcatggcagcgttttactkgacgttgatggtgctgtgaagtccattctttcctctgcaagactactgactatgcagaaatttatcgaagcggattattatgaactagactggtattatgaagaatgctcggatgttttatgtgcaccctcaggccacttttatttaaacagaagcagcggccccacagccacggggacatgtcttccagacagtagacacagtgcctgtggctgtaagagcctgacagggaagattcatgcctttctccttggncccatgaccaaagaagaaaataaaaatcacacaccatacactg

SEQ ID NO: 2285 - DNA, 365 bp, Homo sapiens
  CDS 77..364
  misc_feature 297: n=a, g, c or t
  misc_feature 298: n=a, g, c or t
  UNSURE 74: Xaa=His or Leu or Pro or Gln or Arg
agccccacgtgaggcttggtaggactgcggacgtatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgaccnntcagattctgattccaatctctctggtgaagatagcaaagcattgagtcaaaagaaaataaagaaga

SEQ ID NO: 2286 - DNA, 271 bp, Homo sapiens
  CDS 101..271
  misc_feature 226: y=c or t
  misc_feature 242: y=c or t
  UNSURE 48: Xaa=Pro or Ser
tttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttatyctgattgatttttttycttggtttctggataaaccaccctctggg

SEQ ID NO: 2287 - DNA, 312 bp, Homo sapiens
  CDS 57..311
  misc_feature 292: n=a, g, c or t
  misc_feature 295: n=a, g, c or t
  misc_feature 296: n=a, g, c or t
  UNSURE 79: Xaa=Ile or Lys or Arg or Thr
  UNSURE 80: Xaa=Ala or Asp or Glu or Gly or Val
aagaccactgggacaattcagtatggcaaaggtgaccagtgagccacagaagcctaatgaagatgtggacgaacacaccccatcaacctcaagtaccaaagggaggaagaaggggaagacaccccgtcaaacgaaggtccagaagcggcgttaagggcctaaagaccaccaggaaggcgaaaagaccccttcgagggagctcgagccaaaaagccggtgaaactaacacccctgcaggaaaacctaagaaagctagaggaccaatactgcgtggtcgttatcaccggctganagnnaaaatgaagaaagaag

SEQ ID NO: 2288 - DNA, 214 bp, Homo sapiens
  CDS 59..214
  misc_feature 206: n=a, g, c or t
  UNSURE 50: Xaa=Phe or Ile or Leu or Val
agaagatctgagcgagtcgcgtactgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgnttccggac

SEQ ID NO: 2289 - DNA, 361 bp, Homo sapiens
  CDS 54..359
  misc_feature 91: m=a or c
  misc_feature 117: n=a, g, c or t
  misc_feature 230: w=a or t
  misc_feature 315: w=a or t
  misc_feature 338: y=c or t
  misc_feature 346: k=g or t
  misc_feature 347: y=c or t
  UNSURE 13: Xaa=Ala or Glu
  UNSURE 22: Xaa=Ala or Pro or Ser or Thr
  UNSURE 88: Xaa=Cys or Ser
  UNSURE 98: Xaa=Gly or Val
agtcttgtttcgggttccggctgcgttgggcttgcgtgcggctcgctaagactatggcgtccgggcctcattcgacagctactgctgccgmagccgcctcatcggccgccccaagcncgggcggctccagctccgggacgacgaccacgacgacgaccacgacgggagggatcctgatcggcgatcgcctgtactcggaagtttcacttaccatcgaccactctctgatwccggagagaggctctcgcccaccccatccatgcaggatgggctcgacctgcccagtgagacggacttacgcatcctgggctgcgwgctcatccaggccgccggcattytcctccgkytgccgcaggtggcg

SEQ ID NO: 2290 - DNA, 313 bp, Homo sapiens
  CDS 103..312
  misc_feature 146: y=c or t
  misc_feature 169: w=a or t
  misc_feature 264: w=a or t
  misc_feature 267: k=g or t
  UNSURE 15: Xaa=Leu or Pro
  UNSURE 23: Xaa=Ser or Thr
acagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcycactcagagattcacacagaagwctggacacaattcagaagagccacccagaaggagacaacaatgtccctgctacccgtgccatacacagaggctgcctctttgtctactggttctwackgtgacaatcaaagggcgaccacttgtctgtttcttgaatgaaccat

SEQ ID NO: 2291 - DNA, 327 bp, Homo sapiens
  CDS 117..326
  misc_feature 89: m=a or c
gaaagactggagccgtttccttgtggctggagcgcttcccgtagcctcggggaaggagcaggatttagaggaccactagttggaccccmatcctcgtgctggaggaacaggagttcatggcctccttgatgcccagcctcctacattctagatgtccagaggctccaggcagggccagcttcatggaaatacaaaactgcaaccgcacagggccttgcacttggaagggccctgcatttggtaatgttctgctatcaccgtctgctggcttaataattttcaaagaggctctggatcttcattttgactgggtcctacaaattatat

SEQ ID NO: 2292 - DNA, 391 bp, Homo sapiens
  CDS 63..389
gtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagc

SEQ ID NO: 2293 - DNA, 403 bp, Homo sapiens
  CDS 88..402
  misc_feature 92: r=a or g
  misc_feature 338: s=g or c
  UNSURE 2: Xaa=His or Arg
  UNSURE 84: Xaa=Ser or Thr
ctatcccgagctcttagtgacgcagaggctggagacgactctacggcggcgaagagacgcgggttgaggaagagggacggattgcccatgcrcttgggcgcacagcggcccgcttctgtgtggtctggaggtggagctgagaggggaatcacactctataaagggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcastcctggcctcactggtgaagcgccttggggacaacatgcaacattgcagaagagcacaaggaagt

SEQ ID NO: 2294 - DNA, 240 bp, Homo sapiens
  CDS 39..239
  misc_feature 232: w=a or t
  misc_feature 233: n=a, g, c or t
  misc_feature 234: s=g or c
  UNSURE 65: Xaa=Ile or Lys or Met or Asn
  UNSURE 66: Xaa=Glu or Gln
agtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcawnsaagtgc

SEQ ID NO: 2295 - DNA, 442 bp, Homo sapiens
  CDS 166..441
  misc_feature 8: m=a or c
  misc_feature 39: s=g or c
  misc_feature 179: r=a or g
  misc_feature 401: r=a or g
  UNSURE 5: Xaa=Asp or Gly
  UNSURE 79: Xaa=Asp or Gly
atccggtmgagttagagcccgtgcggaggcggtgcggasatttcggctctgagcggctgggcgaccggcgcgtcgtgcggggctgcggcggacctccttaaggaaggtgcaagaggttggcagcttcgattgaagcacatcgaccggcgacagcagccaggagtcatgagcgacagcgrcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaagcattatacccggtcacggtctcgctcccgctcccatagrcgatcacgtagcaggtcttacagtcgagattatcgtagacg

SEQ ID NO: 2296 - DNA, 456 bp, Homo sapiens
  CDS 48..455
  misc_feature 10: k=g or t
  misc_feature 52: k=g or t
  UNSURE 2: Xaa=Leu or Trp
gcttcctggktgcgggtcagcgcccaggtcctgggctggccgccgggatgtkgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacc

SEQ ID NO: 2297 - DNA, 459 bp, Homo sapiens
  CDS 61..459
  misc_feature 10: s=g or c
gaggaggagstttgcctagcttgcaggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaaca

SEQ ID NO: 2298 - DNA, 333 bp, Homo sapiens
  CDS 77..331
agctcggggctgcgcacgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacag

SEQ ID NO: 2299 - DNA, 323 bp, Homo sapiens
  CDS 23..322
  misc_feature 9: m=a or c
  misc_feature 246: r=a or g
  misc_feature 247: r=a or g
  UNSURE 75: Xaa=Glu or Gly
agcgccgcmcagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagrrcaatatcctggtattgctgtggagacggtgacagattctagccgctactttgtaatccggatccaggatggtactg

SEQ ID NO: 2300 - DNA, 441 bp, Homo sapiens
  CDS 25..441
ttaatcctggtgcagggggcgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccagcatcctcctgatggtacaggggacagtgatagccagcacacccacaacccagacaccaatccctctgcaacgtggtggcgtgctctt

SEQ ID NO: 2301 - DNA, 260 bp, Homo sapiens
  CDS 101..259
  misc_feature 108: s=g or c
  misc_feature 153: y=c or t
  misc_feature 205: k=g or t
  UNSURE 3: Xaa=Ser or Thr
  UNSURE 18: Xaa=Ile or Thr
gtattttacaaactgagaaagtagctccagcagcacccgagagggtcaggagaaaagcggaggaagctgggtaggccctgaggggcctcggtaagccatcatgaccasccggcaagccacgaaggatcccctcctccggggtgtatctcctayccctagcaagattccggtacgctctcagaaacgcacgcctttccccactgtkacatcgtgcgccgtggaccaggagaaccaagatccaaggagatgggtgcagaaac

SEQ ID NO: 2302 - DNA, 348 bp, Homo sapiens
  CDS 132..347
  misc_feature 65: s=g or c
gaccgtagcgagggtgctgctgcgctgggggaaggaaaacgccgctttgactgtgccttgttctsacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaag

SEQ ID NO: 2303 - DNA, 284 bp, Homo sapiens
  CDS 39..284
  misc_feature 168: r=a or g
  UNSURE 44: Xaa=Gly or Arg
tttctcatccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcrggcacagtgacgtgaaagtctacaaggagttctgtgacttttatgcgaaattcaacatggccaacgccctggccagcgccacttgcgagcgctgcaagggcggctttgcgcccgct

SEQ ID NO: 2304 - DNA, 367 bp, Homo sapiens
  CDS 10..366
  misc_feature 179: n=a, g, c or t
  misc_feature 354: r=a or g
  UNSURE 57: Xaa=Ile or Lys or Arg or Thr
gaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggcagacataagcggcaacatcacgaaaatcanagctgtgtacgacaccaacccagccaagttccggaccctgcagaacatcctggaggtggagaaagaaatgtatggagcagagtggcccaaagtaggggccacactggcgctgatgtggctgaaaagaggcctccgcttcatccaggtcttcctccagagcatctgcgacggggarcgggacgagaacc

SEQ ID NO: 2305 - DNA, 303 bp, Homo sapiens
  CDS 77..301
  misc_feature 148: n=a, g, c or t
gagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcncgggtctccgagttcgacgtctacttcgaggggtctgacttcaagttctacgccaagccatactttctcagattaacccttcctggaagaattgtagaaaatggaagtgagcaagggtcctatgatgcagataaaggaatttttaccattcgccc

SEQ ID NO: 2306 - DNA, 412 bp, Homo sapiens
  CDS 139..411
  misc_feature 104: s=g or c
attgcggcggcccgcagcgggataaccttgaggctgaggcagtggctccttgcacagcagctgcacgcgccgtggctccggatctcttcgtctttgcagcgtasccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgc

SEQ ID NO: 2307 - DNA, 359 bp, Homo sapiens
  CDS 58..357
agtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccg

SEQ ID NO: 2308 - DNA, 413 bp, Homo sapiens
  CDS 211..411
  misc_feature 150: s=g or c
  misc_feature 408: n=a, g, c or t
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggasaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatcnagatt

SEQ ID NO: 2309 - DNA, 243 bp, Homo sapiens
  CDS 56..241
agcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcgg

SEQ ID NO: 2310 - DNA, 759 bp, Homo sapiens
  CDS 75..758
  misc_feature 575: y=c or t
  misc_feature 594: k=g or t
  UNSURE 174: Xaa=Ala or Ser
tggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacayaaaggcgagttggtggttkcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatactccttcc

SEQ ID NO: 2311 - DNA, 377 bp, Homo sapiens
  CDS 27..377
attattatcccgtggagcacgccgatatggctgcgctgacactgaggggtgtccgggagctgctgaagcgtgtggacttcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggactttgtgaatgaagccatctcccactgggaactgcagtctgagggtggccaatctgcaacc

SEQ ID NO: 2312 - DNA, 214 bp, Homo sapiens
  CDS 50..214
  misc_feature 124: n=a, g, c or t
  misc_feature 126: n=a, g, c or t
  misc_feature 130: r=a or g
  UNSURE 25: Xaa=Ile or Met
  UNSURE 26: Xaa=Ala or Glu or Gly or Val
gttttttccgtgagagacgtagagctgagcgacccagcccgcgagcgagatgccggtggccgtgggtccctacggacagtcccagccaagctgcttcgaccgtgtcaaaatgggcttcgtgatngngttrcgccgtgggcatggcggccggggcgctcttcggcaccttttcctgtctcaggatcggaatgcggggtcgagagctgatgggcgg

SEQ ID NO: 2313 - DNA, 301 bp, Homo sapiens
  CDS 108..299
  misc_feature 121: r=a or g
  misc_feature 234: n=a, g, c or t
  UNSURE 5: Xaa=Glu or Gly
  UNSURE 43: Xaa=Gly or Arg or Trp
gcgggtcatggcgcggctaccgaagctggcagtctttgatttggattacactctctggcctttctgggtcgacacgcacgtagaccctccgttccataagagcagtgatggaactgtacgrgataggcgggggccaagacgtccgactgtacccagaggtgcctgaggtcctaaaacgattgcagagccttggggtgcccggtgcggctgcttcaaggacaagtgagatagaangggccaaccagctactggagctctttgacctcttcaggtactttgttcatcgggaaatctatccagg

SEQ ID NO: 2314 - DNA, 396 bp, Homo sapiens
  CDS 74..394
aagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggc

SEQ ID NO: 2315 - DNA, 399 bp, Homo sapiens
  CDS 52..399
  misc_feature 32: k=g or t
  misc_feature 279: r=a or g
  misc_feature 280: s=g or c
  misc_feature 318: s=g or c
  misc_feature 342: s=g or c
  UNSURE 77: Xaa=Asp or His
aaccgccagatttgaatcgcgggacccgttgkcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggarsataaaaagcattcgtccggttgcgctttcctttctgtsaagaagcagtttgaagaattaacscttggtgaatttttgaaactggacagagaaagagccaagaacaaaattgcaaaggaa

SEQ ID NO: 2316 - DNA, 249 bp, Homo sapiens
  CDS 19..249
  misc_feature 215: n=a, g, c or t
  misc_feature 222: n=a, g, c or t
  misc_feature 233: k=g or t
  UNSURE 66: Xaa=His or Leu or Pro or Arg
  UNSURE 72: Xaa=Gly or Val
accggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcntcggtcnccaaagcctgkagccccggcggcccct

SEQ ID NO: 2317 - DNA, 270 bp, Homo sapiens
  CDS 84..269
  misc_feature 10: m=a or c
actcgccgcmgccgccgccatattcccgtggcatcttccttactttgtccatcctccggactcgcgatcttccttccggagccatgtcagaaggagtggacttgattgatatatatgctgacgaggagttcaaccaggacccagagttcaacaatacagatcagattgacctgtatgatgatgtgctgacagccacctcacagccctcagatgacagaagcagcagcactgaaccacctcctcctgttcgccaggagccatctcccaagc

SEQ ID NO: 2318 - DNA, 455 bp, Homo sapiens
  CDS 223..453
attcttttctctccttttgctatgtgaagaaggacatgtttgcttctcctgccatggctggaagtttcctgaggcctccccagccatcctgaactgtgagtcaattaaacctctttcctttataaattacctagtcttgggtatgtctttattagcagtgtgagaactaactaatacagttaattggtactgagagtggagtgctgctataaggatacctgaatgtggaatgcaactttggaacttagtaacaggcagaggttggaacagtttggagggctcagaagtagatgggaaaatgtgggaaaatttggaattcgtaaagtcttgaagggctcagaagacaggaagatgtggggtagtttggaacttcctagagacttgttgaatggctttgaccaaaatgctgatagtgatatgggaaatgaagtccagactaaggtggtctcagatgg

SEQ ID NO: 2319 - DNA, 198 bp, Homo sapiens
  CDS 27..197
acaagtgtcactggcgagaaggcagcatgtgtggctacggcatctgtgagtacagcaccgacgaggtgtacaagggctacttccaggagggcctgcggcacggatttggggtccttgagagtggtccgcagccccccagcccttcaggtacacgggccactgggagaggggccagaggagcggctatggcattgagga

SEQ ID NO: 2320 - DNA, 294 bp, Homo sapiens
  CDS 141..293
  misc_feature 125: y=c or t
  misc_feature 215: s=g or c
  misc_feature 233: s=g or c
  misc_feature 234: s=g or c
  UNSURE 25: Xaa=His or Gln
  UNSURE 32: Xaa=Glu or Gln
ctccgcctcctcccgacgccggcgccgctttctggaaggttcgtgaaggcagtgagggcttaccgttattacactgcggccggccagaatccgggtccatccgtccttcccgagccaacccagayacagcggagtttgccatgcccgagaatgtggcaccccggagcggggcgactgccggggctgccggcggccgcgggaaaggcgcctatcasgaccgcgacaagccagcssagatccgcttcagcaacatttccgccgccaaagcggttgctgatgctattagaacaagcc

SEQ ID NO: 2321 - DNA, 413 bp, Homo sapiens
  CDS 155..412
  misc_feature 137: m=a or c
  misc_feature 138: m=a or c
  misc_feature 141: y=c or t
  misc_feature 142: y=c or t
  misc_feature 146: m=a or c
  misc_feature 148: n=a, g, c or t
  misc_feature 159: m=a or c
  misc_feature 248: n=a, g, c or t
  misc_feature 287: k=g or t
  misc_feature 288: r=a or g
  misc_feature 323: n=a, g, c or t
  misc_feature 324: k=g or t
  misc_feature 400: m=a or c
  misc_feature 401: s=g or c
  UNSURE 2: Xaa=Lys or Thr
  UNSURE 32: Xaa=Leu or Met or Val
  UNSURE 45: Xaa= *  or Glu or Gly
  UNSURE 57: Xaa=Gly or Leu or Met or Arg or Val or Trp
  UNSURE 82: Xaa=His or Gln
  UNSURE 83: Xaa=Leu or Val
aagtgactgcgggagtggagccggcgagagagtggcagcgggggctgatggaagtgcagtgggggctggagagggcaccctactgtatccagcatgctccaaggccacagctctgtgttccaggccttgctggggammttyytcamcnggggggatgamagcagctggggcagctctcgtgttcgtattctctagtggacagaggcggatcttagatggaagtcttggctttgctgcaggggtcatgntggcagcttcctattggtctcttctggccccaagcagtkragaatggccacgtcctctgggggcttcggtgcctnkgccttcttccctgtggcttgttggcttcacccttggagcggcttttgtctacttggctgacctcctgatgcctcamsttgggtgcagca

SEQ ID NO: 2322 - DNA, 383 bp, Homo sapiens
  CDS 75..383
  misc_feature 131: y=c or t
gcccagaggcctgcgcccacaccctctcctgtccagccctcgcccgcctgggcagggcccggcgccgtccgtggatgagccacagaacctcttccaccttccgagcggagagaagtttccattcctcttcytcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaac

SEQ ID NO: 2323 - DNA, 219 bp, Homo sapiens
  CDS 43..219
  misc_feature 59: s=g or c
  UNSURE 6: Xaa=Ser or Thr
ccccgcgtcccgtgcctctatgggggaagcagacaatggattatgatttcaaggcgaastggcggcggacgggagcgagtggaggatttgtttgagtacgaagggtgcaaagtgggacgcggcacctacggtcacgtctacaaggcgaggcggaaagatggattccaggagggcttcgtgtatggacctcaagcgttggaggtagcagacttttcagca

SEQ ID NO: 2324 - DNA, 253 bp, Homo sapiens
  CDS 96..251
  misc_feature 159: m=a or c
  UNSURE 22: Xaa=Lys or Gln
cacgccgggcgcctcgtgtggtgtggtggtgttggctgcagccaaggctgcctttgcttcggatcctgagctgggcctctggctgcggtctaggcatgaggagccggctgaggcggggcgggcgtgacgggttggacacaaggatgacaggcgcacccmaaaggaccagccggcattcccaggagcccttccaaaccctgcgacggcgagactggtctcagaaacatctgaaaaacctcccagtaagtttcgc

SEQ ID NO: 2325 - DNA, 173 bp, Homo sapiens
  CDS 13..171
  misc_feature 171: r=a or g
gtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccarcc

SEQ ID NO: 2326 - DNA, 443 bp, Homo sapiens
  CDS 63..443
  misc_feature 168: n=a, g, c or t
  misc_feature 169: n=a, g, c or t
  misc_feature 170: n=a, g, c or t
  UNSURE 36: Xaa=any one of the twenty amino acids
agggcgccttggaatccccgtccttgggcccccgcaaggtccccggccgtgcgcgaggcagcatgatgaggcgcaccctggaaaaccggaacgctcaaacgaaacaactgcaaacagctgtctcaaatgtggagaagcattttggagaactgtgccaaatcttcgctnnntatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggttgaaagacttgaagccaaagtagttgaacccttgaaaacttatgggaccattgtgaaaatgaaacgggatgacctcaaagcaacactcacagcaaggaatcgagaagctaagcaatta

SEQ ID NO: 2327 - DNA, 214 bp, Homo sapiens
  CDS 35..214
gcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagc

SEQ ID NO: 2328 - DNA, 318 bp, Homo sapiens
  CDS 143..316
  misc_feature 68: r=a or g
cttccgcaatcggagccctcacagaggccaaactgatataaatctgcttaggaggcctgattcacagrcgctacaggatggagcggggcgcaggagccaagctgctgccgctgctgctgcttctgcgggcgactggtttcacatgtgcacagacagatggccggaacgctacacggcggtcatcgaagtgaccagcgggggtccctggggcgactgggcctggcctgagatgtgtcccgatggattcttcgccagcgggttctcgctcaaggtggagcctccccaaggcattcctggcgacgacactgcactgaatgg

SEQ ID NO: 2329 - DNA, 457 bp, Homo sapiens
  CDS 8..457
  misc_feature 76: s=g or c
  misc_feature 128: w=a or t
  misc_feature 129: s=g or c
  misc_feature 130: n=a, g, c or t
  misc_feature 184: n=a, g, c or t
  misc_feature 185: n=a, g, c or t
  misc_feature 196: m=a or c
  misc_feature 316: m=a or c
  misc_feature 386: n=a, g, c or t
  misc_feature 387: m=a or c
  misc_feature 388: n=a, g, c or t
  UNSURE 23: Xaa=Lys or Asn
  UNSURE 41: Xaa= *  or Cys or Arg or Ser or Thr or Trp
  UNSURE 59: Xaa=Arg or Ser
  UNSURE 60: Xaa=Asp or His or Asn or Tyr
  UNSURE 127: Xaa= *  or Ala or Asp or Glu or His or Lys or Asn or Pro or Gln or Ser or Thr or Tyr
gaagctcatgagtgatcctgattctagtataattgacttctatcctgaagattttgctattgatttgaatgggaasaaatatgcatggcaaggtgttgctctcttgccattcgtggatgagcgaaggwsncgagctgccctagaagaggtatacccagacctcactccagaagagaccagaagnnacagccttggmggtgatgtcttatttgtggggaaacatcacccactccatgacttcattttagagctgtaccagacaggttccacagagccagtggaggtaccccctgaactatgtcatgggattcaaggmaagttttctttggatgaagaagccattcttccagatcaaatagtatgttctcctgttcctatgttaaggnmnctgacacagaacactgtagtcagtattaattttaaagacccacagtttgctgaagattacatttttaaa

SEQ ID NO: 2330 - DNA, 514 bp, Homo sapiens
  CDS 155..514
  misc_feature 25: y=c or t
  misc_feature 353: m=a or c
  misc_feature 363: m=a or c
  misc_feature 364: w=a or t
  misc_feature 434: n=a, g, c or t
  misc_feature 435: n=a, g, c or t
  UNSURE 67: Xaa=Arg or Ser
  UNSURE 70: Xaa=Lys or Asn or Thr
  UNSURE 94: Xaa= *  or Ala or Glu or Gly or Lys or Leu or Met or Pro or Gln or Arg or Ser or Thr or Val or Trp
aagtccccggaagtgccttccctcycgggtctgcgcggacgcgcctccttacctcatttgtcctcgcccctccccgtccctctacgcgttttggttcccggttggtgcttcctgttcgcagctgcggcagtgacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtmgtaaaccaamwcagaagaagctaatcgtcctttcagatagtgaggtcatccagctgtcagatgggtcagaggtcatcactnngtctgatgaagacagtatttatagatgtaaaggaaagaatgttagagttcaagcacaagaaaatgcccatggtctttct

SEQ ID NO: 2331 - DNA, 191 bp, Homo sapiens
  CDS 1..189
  misc_feature 10: n=a, g, c or t
  misc_feature 11: y=c or t
  UNSURE 4: Xaa=Ala or Phe or Ile or Leu or Pro or Ser or Thr or Val
atgtggagcnycgggtccgcgcgggcgacacgctgcagggcatcgcgctcaagtacggtgtcacgatggaacagattaaaagggccaattggggcgcgggatgaggagaagggcgaaggcactcccagggaggaggggaaggctggtgttcagagtgtgggagaaaaggaatccctggaggctgccaagga

SEQ ID NO: 2332 - DNA, 344 bp, Homo sapiens
  CDS 136..342
  misc_feature 300: s=g or c
  UNSURE 55: Xaa= *  or Tyr
tggagtcggaggaggagcctgaatgtttggagatagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatasaccggccttactgcgacgatgacaaagtacaacacaccgtctgg

SEQ ID NO: 2333 - DNA, 418 bp, Homo sapiens
  CDS 23..418
  misc_feature 118: r=a or g
  misc_feature 195: m=a or c
  misc_feature 418: s=g or c
  UNSURE 58: Xaa=Lys or Thr
  UNSURE 132: Xaa=His or Gln
ataaggcggaggcgcgcccaagatggcggcctccatgtgcgacgtgttctccttctgcgtgggcgtggcgggccgcgcgcgggtctccgtggaagtccgtttcgtgagcagcgccaarggaaaaggggctgtttgccacacagctcatccggaagggggagaccatcttcgtagaacggcccctggtggctgcamgtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccas

SEQ ID NO: 2334 - DNA, 168 bp, Homo sapiens
  CDS 13..168
gtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggc

SEQ ID NO: 2335 - DNA, 385 bp, Homo sapiens
  CDS 168..383
  misc_feature 39: s=g or c
  misc_feature 40: r=a or g
  misc_feature 108: m=a or c
  misc_feature 110: w=a or t
  misc_feature 112: n=a, g, c or t
  misc_feature 114: s=g or c
  misc_feature 116: m=a or c
  misc_feature 119: s=g or c
  misc_feature 122: s=g or c
  misc_feature 211: y=c or t
  misc_feature 212: n=a, g, c or t
  misc_feature 322: r=a or g
  misc_feature 323: n=a, g, c or t
  misc_feature 324: r=a or g
  misc_feature 325: n=a, g, c or t
  UNSURE 15: Xaa=Ile or Met or Thr
  UNSURE 52: Xaa=Asp or Glu or Gly
  UNSURE 53: Xaa=Ala or Asp or Gly or Ile or Asn or Ser or Thr or Val
gcttccggtccgcgtgaggtgcattctcgcgccggtggsraggttagggcccgcgttgcgacgtggtgcagcgcatattttcacaagtgggtctcccttgtccgggamtwtngscmacsgastcgtgggccctggcggtggacgagcaggaagcggctgtcaagtcgatgaccaatttgcagatcaaggaagagaaagtcaaagcagataynaatggtattatcaaaaccagtaccactgccgagaaaacagatgaagaggagaaagaggacagagctgcccagtccttactcaacaagctgatcagaagcaaccttgttgrnrncacaaaccagggtggaagtcctgcaacgggatccaaactcccctctgtactcggtgaagt

SEQ ID NO: 2336 - DNA, 473 bp, Homo sapiens
  CDS 278..472
  misc_feature 100: m=a or c
  misc_feature 232: s=g or c
  misc_feature 355: k=g or t
  misc_feature 430: n=a, g, c or t
agtcgttccgccacctcccagtcgggttgcggcggaggccgttcctggctttgtagctcgctcaagatggcggcgcacaccccgcgggatacgcctcagmgcgctttgcccgaagtttttacatacaaattctactagtcacacctggccattcagtgcagttgctgaattaatagataatgcttatgatcctgatgtgaacgctaaacaaatatggattgacaaaacagtsataaatgaccatatatgcttgacattcaccgacaatgggaatggtatgacttctgataaattacataaaatgctaagctttggcttcagtgacaaagtcaccatgaatggtcatgtcccagtkggattatatgggaatggcttcaagtcgggttctatgcgtctgggtaaagacgcaatcgtttttaccaaaaatggngaaagcatgagcgtgggccttttgtctcagacctacttggaag

SEQ ID NO: 2337 - DNA, 209 bp, Homo sapiens
  CDS 14..208
  misc_feature 82: s=g or c
  misc_feature 135: y=c or t
  UNSURE 41: Xaa=Met or Thr
taaatggaatggaatggaatggaatcaactcgagtggaaaggaatggaatggaatggaaaggaatggaatgaagtcaactcsagtggaatggaatggaatggaatggattggaatggattgcaatggaatgaaayggaatggaatggaatggaatcaatcattccgagtggaatggaagggaatctaatggaggggaaagaagggaatg

SEQ ID NO: 2338 - DNA, 437 bp, Homo sapiens
  CDS 147..437
gatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacac

SEQ ID NO: 2339 - DNA, 187 bp, Homo sapiens
  CDS 22..186
  misc_feature 147: n=a, g, c or t
  misc_feature 149: y=c or t
  misc_feature 152: n=a, g, c or t
  misc_feature 153: m=a or c
  UNSURE 43: Xaa=Leu or Pro
  UNSURE 44: Xaa= *  or Cys or Phe or Leu or Ser or Tyr
atctgtagggtgaccaacatcatggtttgcccaggactgagaggtttcaggatgtgggactcctgttttacactgggaccatcccaggcaaatagagctgagttggtccccctgtcttgtaaaagtaaacaactcagagaggtgtcncyttnmgcttccacaataactcaatttgtttttaacaatg

SEQ ID NO: 2340 - DNA, 425 bp, Homo sapiens
  CDS 210..425
  misc_feature 107: w=a or t
  misc_feature 367: k=g or t
  misc_feature 389: n=a, g, c or t
  UNSURE 53: Xaa=Cys or Phe
  UNSURE 60: Xaa=Asp or Glu
agacgcccaggtcgcccgcatcccgctgccgcagagagagacagcgcgccccggccctgctccccaggcttcgcccgggcgccctcaactctgtccccagagactgwgcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtatkccccccaaacacgactcaagancaagtttatcatgcatgtgccatgcagattgtcaaa

SEQ ID NO: 2341 - DNA, 237 bp, Homo sapiens
  CDS 30..236
  misc_feature 92: r=a or g
tctcatgaggaaatgatgggaattcctttatgactctgcagtggtccctccgtgtctgctggagggggtcctggctgattcccagctctacrtcctgtagattctcacacccagggcctccttcggcctcttctcaggggagtctcagagcaggagcctctctcccttgcccagtgaaagtcattctcccctctcccatccacctcacccgcggccacaatcctgagaattcccccc

SEQ ID NO: 2342 - DNA, 342 bp, Homo sapiens
  CDS 37..342
aacagtcgcgtgctagactccggacccgccagtggtatggctgagccgactagtgatttcgagactcctatcgggtggcatgcgtctcccgagctgactcccacgttagggcccctgagcgacactgccccgccgcgggacaggtggatgttctgggcaatgctgccgccaccgccaccaccacttacgtcctcgcttcccgcagccgggtcaaagccttcctctgagtcgcagccccccatggaggcccagtctctccccggggctccgcccccttcgacgcccagattcttcccggggcgcaaccccccttcgacgcccagtctccccttgattctcagc

SEQ ID NO: 2343 - DNA, 244 bp, Homo sapiens
  CDS 92..244
  misc_feature 106: n=a, g, c or t
  misc_feature 123: n=a, g, c or t
  misc_feature 124: k=g or t
  UNSURE 5: Xaa= *  or Tyr
  UNSURE 11: Xaa=Ile or Lys or Met or Asn or Arg or Ser or Thr
agtctacaggctaggtgcacactggacagtcagggtggttgtgagctgatggagactgtaaatgaaccagaaacaggtgaagtgagcaaagatgcagtcattgtanagcaggagaaaaataankgaatattgccttcaggatattgatgataaattgtcagaatcagcagaggatgatggtgaagatgataccaatgatgaagatgatgatgaagatagtaaccctaaaaagatactcaggccc

SEQ ID NO: 2344 - DNA, 260 bp, Homo sapiens
  CDS 23..259
  misc_feature 7: n=a, g, c or t
  misc_feature 220: s=g or c
aaacagnccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagcsgcttttagccacccccaggctgcccagctctgctacgaac

SEQ ID NO: 2345 - DNA, 413 bp, Homo sapiens
  CDS 149..412
  misc_feature 242: n=a, g, c or t
  misc_feature 271: n=a, g, c or t
  misc_feature 315: n=a, g, c or t
  misc_feature 331: s=g or c
  misc_feature 332: s=g or c
  misc_feature 398: n=a, g, c or t
  UNSURE 32: Xaa=Phe or Ile or Leu or Val
  UNSURE 56: Xaa=His or Leu or Pro or Arg
  UNSURE 62: Xaa=Leu or Val
  UNSURE 84: Xaa=Phe or Ile or Leu or Val
agtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgcaacgggaacctgcagaggcgacagacgatgaaggaagccaaggacatgaagaacaagctggggatcntcagacggcggaatgagtcccctggagcncctcccgcgggcaaggcagacaaaatgatgaagtcattcaagcncacctcagaggaagcsstcaagtggggcgagtccttggagaagctgctggttcacaaatacgggttagcagtgttccaagccntccttcgcactgagt

SEQ ID NO: 2346 - DNA, 428 bp, Homo sapiens
  CDS 142..426
  misc_feature 120: n=a, g, c or t
  misc_feature 136: n=a, g, c or t
  misc_feature 301: k=g or t
  misc_feature 363: n=a, g, c or t
  misc_feature 364: n=a, g, c or t
  misc_feature 424: n=a, g, c or t
  misc_feature 427: y=c or t
  UNSURE 54: Xaa=Ala or Ser
  UNSURE 75: Xaa= *  or Glu or Lys or Gln
  UNSURE 95: Xaa=Cys or Gly or Arg or Ser
tggccaaggccattgtgttggctgccatcttccgttgcctgcacccactactggtggtcgtttcctgcctcacccgggaccccttcagcagcagcctacagaaccgggcagaggtggacnaggtgaaagcactgtngagccatgacagcggcagtgaccacctggcctttgtgcgggctgtcgccggctgggaggaggtgctgcgttggcaggaccgcagctcccgggagaattacctggaaggaaaacctgctgtacgcacccagcctgcgcttcatccacggactcatcaagcagttckcagagaacatttatgaggccttcctggtggggaagccctcggactgcaccctggcctccgcnnagtgcaacgagtacagtgaggaggaggagctggtgaagggcgtgctgatggccggcctcngcyc

SEQ ID NO: 2347 - DNA, 409 bp, Homo sapiens
  CDS 256..408
  misc_feature 2: n=a, g, c or t
  misc_feature 176: w=a or t
  misc_feature 177: w=a or t
antcgacgacaggttagcgggtttgcctcccactcccccagcctgcgtcgccggctcacagcggcctcctctggggacagtcccccccgggtgccgcctccgcccttcctgtgcgctccttttccttcttctttcctattaaatattatttgggaattgtttaaattttttttttwwaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtg

SEQ ID NO: 2348 - DNA, 352 bp, Homo sapiens
  CDS 114..350
  misc_feature 141: n=a, g, c or t
  UNSURE 10: Xaa= *  or Gly or Arg
gagttcgcggccggtggcggcggtggcgacagcggcgacctagggatcgatctggagggacttggggagcgtgcagagacctctagctcgagcgcgagggacctcccgccgggatgcctggggagcagatggaccctactngaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggaga

SEQ ID NO: 2349 - DNA, 368 bp, Homo sapiens
  CDS 106..366
  misc_feature 330: n=a, g, c or t
  misc_feature 331: n=a, g, c or t
  UNSURE 75: Xaa=His or Gln
  UNSURE 76: Xaa=Ala or Pro or Ser or Thr
aggaagctccaaagagaaaggagggcaggaagcccacggcccacaggggtgtagcccgagacccacctgcagcccccagcccttgccaggaaagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcaatcgcaagcaggactggtcagaccatgctatttggtgggaacagaagaggcagtggctgctgcanncccactggacactggacaagtacgggatcctggccga

SEQ ID NO: 2350 - DNA, 220 bp, Homo sapiens
  CDS 68..220
  misc_feature 44: s=g or c
agccgttgctcggccggttttggtaggcccgggccgccgccagsctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgcccccc

SEQ ID NO: 2351 - DNA, 355 bp, Homo sapiens
  CDS 133..354
  misc_feature 2: w=a or t
  misc_feature 140: r=a or g
  misc_feature 141: r=a or g
  misc_feature 217: w=a or t
  misc_feature 218: n=a, g, c or t
  misc_feature 219: n=a, g, c or t
  misc_feature 304: r=a or g
  misc_feature 336: r=a or g
  UNSURE 3: Xaa=Gln or Arg
  UNSURE 29: Xaa= *  or Cys or Phe or Ile or Lys or Leu or Met or Asn or Arg or Ser or Thr or Trp or Tyr
  UNSURE 58: Xaa=Gly or Arg
awctgtctcctctctgcctgcctggcaccagccagaccctgctctgcccggggggctctgagccccccaggcattcccttcactgcatccctctccattgggggggtgtctaaggaccctttccccttgggcatggcccrrccaggggtctctgtcaggtccctggtgtcgtcttatgagacccgagtggtggggatggctccggggctgccccgawnnaggggctgtgcctcttccccttgctctccccggggtgcatcccccatccgagggacatctgggcccccgccccaccgggcctggrgaggccctgggcggccttcaacccgcaggggratggacaaaaccctccgct

SEQ ID NO: 2352 - DNA, 366 bp, Homo sapiens
  CDS 52..366
ttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggc

SEQ ID NO: 2353 - DNA, 400 bp, Homo sapiens
  CDS 41..400
gaggctcgcggccggagtgcggcgctgggcggaagctaccatggcggccgagagaaagacaaagttgtccaagaatctgctgcgcatgaagtttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgtgtcagatgaagagatggctagaagatatgatacc

SEQ ID NO: 2354 - DNA, 363 bp, Homo sapiens
  CDS 201..362
cttagggagtttttcatttaatattcttggaccatggttgactatgggtgatggaaaccttggaaagtgaaactggataagacaggactgctgtgtatgtaaatccacgaaagaatgttattcagccataaaaagggagaaatcctgccatttgtaacaatatagatgaacttggaagacaatattgggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggcca

SEQ ID NO: 2355 - DNA, 434 bp, Homo sapiens
  CDS 60..434
  misc_feature 9: k=g or t
  misc_feature 31: y=c or t
  misc_feature 32: w=a or t
  misc_feature 55: s=g or c
  misc_feature 359: r=a or g
aaaagcctkcagagacctctgaaggaaaacywgtcccgaggctctgtcacttcasacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaacgaaaagaacaraaagattttgtgccactgtatcaagactttgaaaatttttatacaagaaacctttacatgcgaatcagagacaac

SEQ ID NO: 2356 - DNA, 470 bp, Homo sapiens
  CDS 155..469
  misc_feature 36: w=a or t
  misc_feature 45: w=a or t
  misc_feature 46: r=a or g
  misc_feature 51: r=a or g
  misc_feature 58: r=a or g
  misc_feature 63: s=g or c
  misc_feature 69: w=a or t
  misc_feature 70: r=a or g
agatgacaggattttcccgcgaaggagaagcgcgcwtttttcccwrgcggrggatttrgctasaaggcwrggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagt

SEQ ID NO: 2357 - DNA, 326 bp, Homo sapiens
  CDS 21..326
ctggcgcgcgctgtatcctgatgcgatccccctcccccctccgggttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtcaataggagtgaaacatccacatctgataacacagaaacttaccaagagaatacaagttcttctggtcatcctacttttaagtgt

SEQ ID NO: 2358 - DNA, 347 bp, Homo sapiens
  CDS 79..345
  misc_feature 49: n=a, g, c or t
  misc_feature 50: s=g or c
gagcttccgcgccgcccgcacgcgcgacctacctgggcgctccgcgccnsggatgctgcaggttattcagcgatagttatgacctcccggttacgtgcgttgggtggaagaattaataatatacgcacctcggagttacccaaagagaaaactcgatcagaagtcatttgcagcatccactttttagatggcgtggtacagacctttaaagttactaaacaagacactggccaggttcttctggatatggtgcacaaccacctgggtgtgactgaaaaggaatattttggtttacagcatgatgacgactccgtggactctcctagatggctggaagcaagcaaagc

SEQ ID NO: 2359 - DNA, 433 bp, Homo sapiens
  CDS 84..431
  misc_feature 297: r=a or g
  misc_feature 327: n=a, g, c or t
  misc_feature 347: n=a, g, c or t
  misc_feature 364: r=a or g
  misc_feature 370: n=a, g, c or t
  UNSURE 72: Xaa=Ala or Thr
  UNSURE 82: Xaa=Leu or Met or Val
  UNSURE 94: Xaa=Asn or Ser
  UNSURE 96: Xaa=Ile or Asn or Ser or Thr
gcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcarcaaaagttggaagcctggagtgcctaagcntgcttgtagccagtgatgcncaaattgatttatgtartaagancgggcaaacagctgaagatctcgcttggtcatgtggatttccagactgtgccaagtttcttac

SEQ ID NO: 2360 - DNA, 255 bp, Homo sapiens
  CDS 29..253
  misc_feature 56: s=g or c
  misc_feature 198: s=g or c
  UNSURE 10: Xaa=Gly or Arg
  UNSURE 57: Xaa=Pro or Arg
agtggggtgcacgcttcgggttggtgtcatggcagctgcggggcagccgcaagcasgcgcctggcggagcacggtggacgagttcctagcttcgggctttgactccgagtccgaatccgagtccgaaaattctccacaagcggagacacgggaagcacgcgaggctgcccggagtccggataagccgggcgggagccstcggccagccggcgtaaaggccgtgcctctgagcacaaagaccagctctctcggctg

SEQ ID NO: 2361 - DNA, 318 bp, Homo sapiens
  CDS 159..317
  misc_feature 10: k=g or t
  misc_feature 152: s=g or c
atctgcggakccgccgggagggagccagatcccagcgatcttccccgacggcagcgctttacccagaggctgccggcggctcgtagctgggttcagctctgcgtccacgccagcccggagcccggggggcaaggggtctgtcccgggcgcasgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtcc

SEQ ID NO: 2362 - DNA, 372 bp, Homo sapiens
  CDS 124..372
  misc_feature 110: m=a or c
  misc_feature 111: s=g or c
  misc_feature 123: m=a or c
  misc_feature 128: w=a or t
  misc_feature 153: n=a, g, c or t
  misc_feature 154: r=a or g
  misc_feature 227: m=a or c
  misc_feature 330: m=a or c
  misc_feature 367: r=a or g
  UNSURE 2: Xaa=Phe or Tyr
  UNSURE 11: Xaa=Asp or Asn
  UNSURE 35: Xaa=Asn or Thr
  UNSURE 69: Xaa=Lys or Asn
  UNSURE 82: Xaa=Ala or Thr
acttttcgcggccgggccccagcatggctgcccccacggctgagggcctggcagctgctgcgccctcgctttcttgacattccctggcttctgtgctctcttccccaggmsaccccagcagamatgtwtgccaaggcctttcgggtcaagtcnracacggccatcaaggggtcggacaggagaaagcttcgagctgatgtgacaactgctttccccacccttggaamtgatcaagtctctgagttagtacctggaaaggaggagctcaacattgtgaagttgtatgctcacaaaggggatgcagtgactgtgtacgtgagtggtggtaamcccatcctctttgaactggagaaaaatctgtatccarcagtg

SEQ ID NO: 2363 - DNA, 440 bp, Homo sapiens
  CDS 163..438
  misc_feature 119: m=a or c
agtactcggagacagcggacccgtgtcagtgacagcttccggtttggtttctccgccttctgcttggctagagctattggggctcggtggcggccgcagtggggtggagggggcagggmgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcg

SEQ ID NO: 2364 - DNA, 230 bp, Homo sapiens
  CDS 35..229
ttttttgtatttttggtggagacgggggttcgtcatgttggccaggctggtctcggactcccgacctcaggtgatctgcctgcctcggcctcccaaggtgctgggattgcaggcgtgggccaccgcgcccggcctgatctcagtctttaagagagcagcagctcatctgtggccactgcttcccagggacttgccagaagggaggtgcagggcacagggaaataacccac

SEQ ID NO: 2365 - DNA, 417 bp, Homo sapiens
  CDS 212..415
  misc_feature 181: n=a, g, c or t
aagagcggaagtgggtgtgacggggacgggggcccggtgggcccgcggaggaaagatactggggagtgggagccgcggggttcagagcgatgattcccccacaggaggcatccgctcgacggcgggagattgaggacaagctgagcaggaggaggagactctgtccttcatccgagacagnctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggcccacaggtaggctggaa

SEQ ID NO: 2366 - DNA, 234 bp, Homo sapiens
  CDS 66..233
gttgttagttttctttttagctgaattacccactcacatccttattattttatgccactgatttcatgttttgttttctattttcatggtggcttagaggaggtcttcatgtattattaaacacatgcttatatgtaccttatgggtatttgtcacttatttgtttactttgtttatggtatcttaatctatacaaattctcaattttcttttcttttctttcttttttttttt

SEQ ID NO: 2367 - DNA, 364 bp, Homo sapiens
  CDS 196..363
ccacctgcttcaatctctcaaaagtgctgggattacagacgtgagctaccgtgcctggtagaactttttgttcttcactatggtatccagactcctccagagtacatgtgttgctgttataatacatgaaaaaaaaatgaagttattaaaataatagttgatttttaaagggttcatagaggctcttctgttttcatgagcaataaacagaaactgatctttttgagacaggatctcattctgatgcccaagctggagtgcagtggggcgatcatagcttactgcagccttgacctcccgggctcaggtgatcctcccacctcagcctcccaagtagctgggaacaggtgcataccacacactc

SEQ ID NO: 2368 - DNA, 361 bp, Homo sapiens
  CDS 89..361
  misc_feature 35: n=a, g, c or t
  misc_feature 161: k=g or t
  misc_feature 229: k=g or t
  misc_feature 251: s=g or c
  misc_feature 252: s=g or c
  UNSURE 25: Xaa=Cys or Gly
  UNSURE 55: Xaa=Ala or Gly or Pro or Arg
gcggtccccgccccaccgtagcgacgccgcggtcngccggatctccagcgctcagtccgcgccgcaggtggtgcttgtctgcagagtcatgacctctttccgcttggccctcatccagcttcagatttcttccatcaaatcagataacgtcactcgcgctkgtagcttcatccgggaggcagcaacgcaaggagccaaaatagtttctttgccggaatgctttaattckccatatggagcgaaatattttsstgaatatgcagagaaaattcctggtgaatccacacagaagctttctgaagtagcaaaggaatgcagcatatatctcattggaggctctatccctgaagaggatgctggg

SEQ ID NO: 2369 - DNA, 238 bp, Homo sapiens
  CDS 8..238
tcagtagatgttaaatttagcttttataacgtttgaactcagttgtttaccttcaactctatttactaatttttttgtgtgtttgttttttggctttttgtttgtttgtttgtttgtttttgagatggaatttcactctggcctcggcaacagagcgagactctgtctcaaacaaacaaacaaacaaacaaaaggactctatattcaagttaaaataagaagtgtaacagaatcatgg

SEQ ID NO: 2370 - DNA, 367 bp, Homo sapiens
  CDS 69..365
  misc_feature 31: r=a or g
  misc_feature 32: r=a or g
agccgcccgccacgctgtcggcgctatagcrrcggtagctagctgcagggccagtggcacgctaggccatgtctggtccaactgatgagactgcaggagacttgcctgtgaaagatacaggtctaaacctctttggaatgggagggttacaagaaacttcaacaacacggacaatgaagtctcgccaggcagtgtcacgtgtcagtcgtgaggaactggaagacagatttttgcgtttgcatgatgagaacattttacttaaacagcatgcccgcaagcaggaggataaaattaaaagaatggccaccaagttaatacggctagttaatgacaagaaaagatatgagcgggttggtggcggcccaag

SEQ ID NO: 2371 - DNA, 430 bp, Homo sapiens
  CDS 77..430
  misc_feature 27: s=g or c
aagtggcctgaaggcggcgcgccagtsccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaa

SEQ ID NO: 2372 - DNA, 305 bp, Homo sapiens
  CDS 150..305
  misc_feature 13: w=a or t
  misc_feature 14: y=c or t
  misc_feature 31: s=g or c
gtcgcgatccggwyccggagccagcgcggasacctgcgcccgcggctgacaccttcgctcgcagtttgttcgcagtttactcgcacaccagtttcccccaccgcgctttggattagtgtgatctcagctcaaggcaaaggtgggatatcatggcatctatctgggtcggacaccgaggaacagtaagagattatccagactttagcccatcagtggatgctgaagctattcagaaagcaatcagaggaattggaactgatgagaaaatgctcatcagcattctgactgagaggtcaaatgcacag

SEQ ID NO: 2373 - DNA, 243 bp, Homo sapiens
  CDS 60..242
  misc_feature 4: m=a or c
  misc_feature 15: s=g or c
aaamacccggaagcsggtcgcgtggagtgacggtcccaccgcggggatatctcttccaaatgcatgatgaaggagttctcatccacagcggcaaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcaccca

SEQ ID NO: 2374 - DNA, 222 bp, Homo sapiens
  CDS 33..221
  misc_feature 8: s=g or c
  misc_feature 12: m=a or c
  misc_feature 13: n=a, g, c or t
  misc_feature 20: s=g or c
  misc_feature 47: y=c or t
  misc_feature 49: s=g or c
  misc_feature 69: y=c or t
  misc_feature 87: s=g or c
  misc_feature 105: s=g or c
  misc_feature 134: s=g or c
  misc_feature 135: s=g or c
  misc_feature 151: k=g or t
  UNSURE 6: Xaa=Ser or Thr
  UNSURE 13: Xaa=Phe or Leu
  UNSURE 19: Xaa=Ala or Pro
  UNSURE 25: Xaa=Asp or His
  UNSURE 34: Xaa=Asp or Glu
  UNSURE 35: Xaa=Glu or Gln
  UNSURE 40: Xaa=Met or Arg
acacagasgccmngccttascgcggctcagccatgagcaacaggagyascttttcccggctcacctggytcaggaagcagaggaaasctgtggtcagcaccagcsacaagaagatgcccaacggaatcttggassagcaagagcagcaaakggtgatgctgctcagcaggtcaccctcagggcccaagaagtattttcccatccccgtggagcacctggagg

SEQ ID NO: 2375 - DNA, 335 bp, Homo sapiens
  CDS 16..333
  misc_feature 13: n=a, g, c or t
  misc_feature 27: m=a or c
  misc_feature 43: m=a or c
  UNSURE 4: Xaa=Arg or Ser
  UNSURE 10: Xaa=Arg or Ser
atcaaagtaggcnagatggcgtcgagmggcggggagctagggmgtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaat

SEQ ID NO: 2376 - DNA, 168 bp, Homo sapiens
  CDS 11..166
  misc_feature 70: v=a or c or g
  misc_feature 72: w=a or t
  UNSURE 20: Xaa=Arg or Ser
  UNSURE 21: Xaa=Asp or Val
agatgaggtgatggcaacggccaacttcggcaagatccagatcgggatttacgtggagatcaagcgcagvgwtggccgaatacatcaagcaatggtaacatctttaaatgaagataatgaaagtgtaactgttgaatggatagaaaatggagatacaaaaggcaaact

SEQ ID NO: 2377 - DNA, 393 bp, Homo sapiens
  CDS 74..391
acactcgcgagtagctgggattacagataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgatctgtcagtgtttcagagctctagcccgggaggaggcggcgggggcggcggtggtgaagaagaggacagtcagcaggaatctgaaactcctgacccaagtggaggcttccgaggaacaatggaagcagaccgcca

SEQ ID NO: 2378 - DNA, 254 bp, Homo sapiens
  CDS 8..253
tctcagcatggaccgcacttgtgaggagaggcccgctgaggatgggagcgacgaggaggacccagactccatggaagccccaacccggatccggaacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggaaacc

SEQ ID NO: 2379 - DNA, 242 bp, Homo sapiens
  CDS 89..241
acaagaacgcacggcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcaa

SEQ ID NO: 2380 - DNA, 231 bp, Homo sapiens
  CDS 12..230
  misc_feature 24: s=g or c
  misc_feature 28: w=a or t
  misc_feature 81: s=g or c
  UNSURE 5: Xaa=Leu or Val
  UNSURE 6: Xaa=Glu or Val
  UNSURE 24: Xaa=Leu or Val
ctcttaggttgatggcagcggcastggwggctgcagcggcgccgggctctagagagccgcaggatcggccagagtgcggastggacacccgggtcccagatactacagacacccggagaggtggctccttcgccctgaagccttcctcggccccctacgcactcgggccccttccgcagaggattcgcagcgtgaggcccccagcccgctcaggaccagctatgagcagac

SEQ ID NO: 2381 - DNA, 369 bp, Homo sapiens
  CDS 179..367
tctccccagcagatttagcacccagggattgagctcacatttcaggctagagaggataacccttgggccacccacatctctcacccctgatgcttcttacttcgcctgagccatcagaactcctccttaccctccttcagcccctgcagtcttactcaagagaccaagaaaacaagctatgaaagtgattcaaataacaacgaaaaccttcttgatctcaaattcccattcctcaaggcccagcaccattttctgtagtgcctggctggggcacattcttgtctgccagctccgggtgcttaggcatgtggacatccttcttggccaccatgactccctcccttaccatcaaatcaattggccaccgat

SEQ ID NO: 2382 - DNA, 276 bp, Homo sapiens
  CDS 99..275
  misc_feature 103: k=g or t
  misc_feature 272: r=a or g
  misc_feature 273: s=g or c
  UNSURE 2: Xaa=Leu or Arg
  UNSURE 59: Xaa=Glu or Gln
cttcacgcaatcgaggtcctcatgggcggagtaatggagcttcgtcacacaagcctggcagcagcccatcatccccgcgggaaaaggaccttctgtccatgckgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccrsagc

SEQ ID NO: 2383 - DNA, 274 bp, Homo sapiens
  CDS 93..272
  misc_feature 37: r=a or g
  misc_feature 71: r=a or g
tattgctgtgacaaaatcatcatgggaagagctagtragggactcttttggtggttatagaaatgccagtrcatactgtttaatgtacataaatgataaggcacagtttcctaatacaagaggacagttcggctcactgcaacctctgcctcctgggttcaaatgattctcctgcctcaacctcccaagcagctgggattacaggcacccgccaccatgcccggcctattattattattttagagacagagtctcgctatgttgtccaggcatc

SEQ ID NO: 2384 - DNA, 339 bp, Homo sapiens
  CDS 88..339
aaactagaaggccagaggataatggaataaaagatcattgcaattacttatccttcctaaaaatatagttttatattaattgtgcttatggaagaaacaatgtcagccagtacaggcggctgtatattaaggttggttgcgtcattacaggaacacttcccatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagacg

SEQ ID NO: 2385 - DNA, 278 bp, Homo sapiens
  CDS 56..277
agagaaaaggggttaattgaggcttgtttggagtcgggattcccctttcccaaacatgcgtctcgccacttggacagcaggcggctcggccataggatatacggttcaggtaccagggggcagagagaagggcccggaagccggccttggtgaccagttccagctccttcatatagttcactggaatatcctctcgccacacctgtatggattgtgtctggctgaatctttactttattatcaaacacctcctgccacacacaccagcacacgcccca

SEQ ID NO: 2386 - DNA, 343 bp, Homo sapiens
  CDS 72..341
gtagagatgcagaaacattgcaaaagcaaaaggaaactataaaagcctttctaaagaaactagaagccctcatggcaagcaatgacaatgccaataaaacctgcaagatgtgggggcctcaccatgtcagccaggctggtcaggaactcctaacctcaagtgatctgcccgccccagcctcccaaattgctgggattacaggtgtgaaccaccacgcccggccagtcttcaaatatttttacttgcaagacgatggacacattccccttgggctttttgtaactgaaacgcaccacagaagacagggagtcatcgaagggctgctcggggaggtggcagggcg

SEQ ID NO: 2387 - DNA, 402 bp, Homo sapiens
  CDS 138..401
  misc_feature 237: y=c or t
  UNSURE 34: Xaa=Arg or Trp
agctgtgagtaacagcaggctgtcatgatgggatatagcagaagcagcagcagcaactcctgatttaggggcaatcgatgaagataaaataactgcacaacttactcaaaacccaggacaaattcagagagtcaaggatggaactttgggctccccagaggctgccccagacacgagggaaggtctcagcaccctcaaaggatccagaccgagggtttcggagagatggacatcatyggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactata

SEQ ID NO: 2388 - DNA, 373 bp, Homo sapiens
  CDS 108..371
agagggaatgagtgtgagctcgtgagtggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggacag

SEQ ID NO: 2389 - DNA, 304 bp, Homo sapiens
  CDS 13..303
cctaaaattgacatggaaagactcttaggaggacaactaggactagaagatttcatatttgcccatgtgaaaggaatcgaaaaagaagtgaatgtgtataaatctgaggattcacttggtctcaccattacagataatggtgttggctatgcttttataaagagaattaaagatggtggtgttattgactcagttaaaacaatctgtgttggggatcatattgaatccataaatggagaaaatattgttgggtggcgtcactatgatgttgctaagaagttaaaggaattaaaaaaggaggacg

SEQ ID NO: 2390 - DNA, 267 bp, Homo sapiens
  CDS 11..265
  misc_feature 180: w=a or t
  UNSURE 57: Xaa=Phe or Tyr
tttttttgagatggagtctctctctgttgcccaggctgcagtgcaatgtgcgatcttggcttgctgcaacctccgcctcccaggttcaagcaagtctgcctcagcctcccaagtagctgggattacaggcatctgccaccatgcccagctaatttttgtgtttttagtagagatggggtwtcactgtgttggccagggtggtctcaaactccttacctcaggtgatacgcctgccttggcctcccaaagtgctgcgattacaggtgt

SEQ ID NO: 2391 - DNA, 187 bp, Homo sapiens
  CDS 20..187
gtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagcccaaa

SEQ ID NO: 2392 - DNA, 264 bp, Homo sapiens
  CDS 91..264
acctcctagcgccggtgcgcggccgaggccgcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatagg

SEQ ID NO: 2393 - DNA, 240 bp, Homo sapiens
  CDS 58..240
catttcatttcatgactaaaataatcctctaagatagatattagctccatttcacaaatgaagcaactgagattcagagacctgagtcactttgctcctagacctacagctagagatttgaacccagcactctacctcccccggagtcatttcttcctcttccatcagctgtacctgttcctctgccatagatcatggcagcccaggtcagactgttggagttgtcctttattccatccc

SEQ ID NO: 2394 - DNA, 199 bp, Homo sapiens
  CDS 39..197
cagtcctacttgcagttctgaagaatatttctttgtttatgatgccattacaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaatt

SEQ ID NO: 2395 - DNA, 328 bp, Homo sapiens
  CDS 1..327
  misc_feature 13: b=c or g or t
  misc_feature 162: y=c or t
  UNSURE 5: Xaa=Asp or His or Tyr
atgggaagcccgbacattgaagtcgacgtcctgggcatgcctctggacagctgccatttccgcacaaagcccatccatcgaaacaccctgaaccccatgtggaacgagcagtttctgttccgcgttcacttcgaagatcttgtatttcttcgttttgcagtygtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaata

SEQ ID NO: 2396 - DNA, 335 bp, Homo sapiens
  CDS 36..335
  misc_feature 3: k=g or t
  misc_feature 41: r=a or g
  misc_feature 66: k=g or t
  misc_feature 75: r=a or g
  misc_feature 83: k=g or t
  misc_feature 109: w=a or t
  misc_feature 128: k=g or t
  misc_feature 136: k=g or t
  misc_feature 142: s=g or c
  misc_feature 232: w=a or t
  misc_feature 233: k=g or t
  UNSURE 11: Xaa=Phe or Val
  UNSURE 14: Xaa=Met or Val
  UNSURE 16: Xaa=Asp or Glu
  UNSURE 25: Xaa=Phe or Tyr
  UNSURE 31: Xaa=Lys or Asn
  UNSURE 34: Xaa=Leu or Arg
  UNSURE 36: Xaa=Ala or Gly
  UNSURE 66: Xaa=Ile or Lys or Met or Asn
agkctgccggtggggactcttgcagggccgtccccatgttrcgttttccgacctgtttcccatccktccgggtgrtgggagakaagcagctcccgcaggagattatttwcctggtctggtcgcccaakcgggatckcattgstttggccaacacagctggcgaggttttacttcatcgactggcaagttttcatcgagtttggagttttccaccaaatgaaaatacaggaawkgaggtgacgtgtctggcatggagaccagatggcaaacttttggcctttgctcttgctgataccaagaaaattgttttgtgtgatgtagaaaaacctgagagc

SEQ ID NO: 2397 - DNA, 299 bp, Homo sapiens
  CDS 89..298
  misc_feature 290: n=a, g, c or t
  UNSURE 68: Xaa=Cys or Gly or Arg or Ser
cagtcctagtgagtgtcaggagccttcctcgtccaggccttccaggatagaccctcaagagcccactcactctaaaccactagccccaatggagctggagccaatgtacagcaatgtaaatcctggagatagcaacccgatttattcccagatctggagcatccagcatacaaaagaaaactcagctaattgtccaatgatgcatcaagagcatgaggaacttacagtcctctattcagaactgaagaagacacacccagacgactctgcaggggaggctagcagcagangcagggccc

SEQ ID NO: 2398 - DNA, 210 bp, Homo sapiens
  CDS 53..208
  misc_feature 140: y=c or t
  misc_feature 141: s=g or c
  misc_feature 142: y=c or t
  UNSURE 30: Xaa=Cys or Pro or Arg or Ser
tacatggaaaccgaacaacctgctcctgaatgactactgcatacataacgaaatgaaggcagaaataaagatgttctttgaaaccagcgagaacaaacacacaacataccagaatctctgggacacattcaaagcagtgysyagagggaaatttatagcagtaaatgcccacaagagaaagcaggaaagatccaaaattgacacactaac

SEQ ID NO: 2399 - DNA, 389 bp, Homo sapiens
  CDS 120..389
taaccacccggaacaagcacgagctgagcgagagaagactccttctgctgagaccccctctgagcctgtggactggacatttgcccagagggagcttctggaaaaacaaggaattgattatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagata

SEQ ID NO: 2400 - DNA, 321 bp, Homo sapiens
  CDS 144..320
agctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccac

SEQ ID NO: 2401 - DNA, 297 bp, Homo sapiens
  CDS 135..296
  misc_feature 10: m=a or c
  misc_feature 25: r=a or g
  misc_feature 120: k=g or t
  misc_feature 148: r=a or g
  misc_feature 292: s=g or c
  UNSURE 5: Xaa=Lys or Arg
  UNSURE 53: Xaa=Pro or Arg
agcatttgcmttcggagggccagargggcaggcagagcttaattccttgggcaaggctggggctgttggaatggggtctggaggccaggagccaccctgtctgggccagaaaggggcctkggtgcagggcaggcatgtggcccaagarggggctactgggattggggctcccactgctgccccctaaccatccctcggtagcccaagggacactcgtttcctcccactctggttctggctctgagggtagggtggcgctcaggagtgatgtccacagccccaagacaacccsccaac

SEQ ID NO: 2402 - DNA, 259 bp, Homo sapiens
  CDS 83..259
  misc_feature 2: w=a or t
  misc_feature 4: r=a or g
  misc_feature 12: m=a or c
  misc_feature 87: m=a or c
  misc_feature 114: m=a or c
  misc_feature 141: w=a or t
  misc_feature 168: m=a or c
  misc_feature 222: m=a or c
  misc_feature 238: m=a or c
  misc_feature 252: b=c or g or t
  UNSURE 2: Xaa=Ser or Tyr
  UNSURE 11: Xaa=Ser or Tyr
  UNSURE 20: Xaa=Phe or Tyr
  UNSURE 29: Xaa=Ser or Tyr
  UNSURE 47: Xaa=Ser or Tyr
  UNSURE 52: Xaa=Asp or Glu
  UNSURE 57: Xaa=Ala or Gly or Val
twtrtacccgcmacctgaagaattgcccacttccccgccacctgaagcatctcgcctgtatccaccacctgaggagtcacccatgtmccctccacctgaagagtcacccatgtmtccaccaccggaggcatctcgtctgtwcccaccatttgaagagtctcctctgtmccctccacctgaggagtctcccctttccccaccacctgaggcatcacgcctgtmcccaccacctgaggamtcgcctatgtccgbaccacct

SEQ ID NO: 2403 - DNA, 255 bp, Homo sapiens
  CDS 34..255
  misc_feature 128: d=a or g or t
  misc_feature 246: r=a or g
  UNSURE 32: Xaa=Lys or Met or Arg
ccatacttgaggagccatagctactgcaaagagatgctgaagcagtgggggagcagagagtaccctcacctccagactaactgcctatgtttcccaggctccaaacccaaaccaaagccagctggcadgacagccagcaggcaaagcagccagtctgcagtgcaaaggaagctagagaatgtatttgggggtggtcaatgtagactagactgtcttcatctaggaaaaggattctataacactgtractaggact

SEQ ID NO: 2404 - DNA, 233 bp, Homo sapiens
  CDS 44..232
  misc_feature 12: s=g or c
  misc_feature 13: s=g or c
agaaaatgagassaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggcac

SEQ ID NO: 2405 - DNA, 427 bp, Homo sapiens
  CDS 171..425
  misc_feature 371: r=a or g
aagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgarctgagccctggtgtgaacagggacctgacccggcgcgttcgcaacatcaacggcat

SEQ ID NO: 2406 - DNA, 245 bp, Homo sapiens
  CDS 37..243
  misc_feature 12: y=c or t
  misc_feature 69: s=g or c
  misc_feature 214: s=g or c
  misc_feature 227: m=a or c
  misc_feature 228: m=a or c
  UNSURE 11: Xaa=His or Gln
  UNSURE 60: Xaa=Glu or Gln
  UNSURE 64: Xaa=Lys or Asn or Thr
cacgctcactayaatgcccacggcccccctcacaccatgcagccagaccgggcctctccgagccgccasgcctttaaaaaggagccaggcaccttggtgtatatagaaaagccacggagcgctgcaggattatccagccttgtagacctcggccctcctctaatggagaagcaagtttttgcctacagcacggcgacaatacccaaagacagasagaccagcgagammatgatgaaaaccacgcc

SEQ ID NO: 2407 - DNA, 231 bp, Homo sapiens
  CDS 67..231
ttatcaccgttctctccaccttttcatccttctattcatccatcagtccctcacattttttttgcaatgtttccaaggagacctctggacacttgcttctcaacattgcagcgtgtaggccctcagcaggagttcagaagtgcacatttcacagtgaaccttctgagagtgttgacagatcacagcttttctttttgtctaatgaaaagggcttgctggccattgggtgtc

SEQ ID NO: 2408 - DNA, 328 bp, Homo sapiens
  CDS 6..326
  misc_feature 70: s=g or c
  misc_feature 158: r=a or g
  UNSURE 22: Xaa=Arg or Thr
ccaaaatgaattttaaattgactggaaaagggatcacctttttctcatctgagagcaagaaatatgagasacccaaggatgatcgagaggaagagttcaacacgtgggtcaataatatgtacgtcttctttgtgaacacgctctttcatgcgtataarcgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaa

SEQ ID NO: 2409 - DNA, 420 bp, Homo sapiens
  CDS 23..418
tttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttcca

SEQ ID NO: 2410 - DNA, 336 bp, Homo sapiens
  CDS 179..334
acctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccaccaa

SEQ ID NO: 2411 - DNA, 378 bp, Homo sapiens
  CDS 178..378
  misc_feature 12: y=c or t
  misc_feature 304: s=g or c
  misc_feature 305: s=g or c
  misc_feature 378: r=a or g
  UNSURE 43: Xaa=Ala or Gly or Pro or Arg
aattcaaaaatyagctgggtgtggtgttgcgtgcctgtaatcccagctactcagaaggctgagtcatcagaattgcttgaatccaggagaaggaggttgcagtgagctgagatcacgccactgcactccagcctgggcaacagagcaagactccgtctcaaaaaaaaagaaaaattgatgctaacacccagtactgggagagatagatatgttagaactttaccctcataccttgttcgtggtattgtcaattggtcagtatctattaagagatatgaaatagttatatttgacctgttgatcssgcttatagtagtctctccatgggaaatctttttaaaaagcattaaaattctatatgcatcaagagcaccgcar

SEQ ID NO: 2412 - DNA, 231 bp, Homo sapiens
  CDS 36..230
  misc_feature 51: w=a or t
  UNSURE 6: Xaa=Arg or Trp
tcacgcacgggatccagagcgccgcgcacttcgtcatgttcttcgcgcccwggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaaaaag

SEQ ID NO: 2413 - DNA, 181 bp, Homo sapiens
  CDS 14..181
  misc_feature 150: v=a or c or g
  UNSURE 46: Xaa=Asn or Ser or Thr
tatttattttgagatggagttttgctctttttgcccaggctacagtgcaatggtgccaaactcgcctcactgcaacggtgccaacctcgcctcactgcaacctctgcctcctgggttcaagcgattctcctgccttggcctcccgaatavctgggattacagacatgcgccaccacacccg

SEQ ID NO: 2414 - DNA, 320 bp, Homo sapiens
  CDS 153..320
taaaaagttcttgaaccctagcgttacgctcttcctccaggctgagtctcttctctcacagccccaaatccttttcttcctcctgggcttggatattgtcactgtcacatctgctctaaccctgcctgggccatgaacgtcataaccttagcatggaagcgggagagaaggcaggcaggtcaagggtgcgacacggggtgatcagaatgggctgggaggttgctgggatacagacagggacaacagactcaggagtcccccaccaggtgccacagaagaagctggcccaggaggtagcagagtctccccccacccccctc

SEQ ID NO: 2415 - DNA, 196 bp, Homo sapiens
  CDS 20..196
tcaagataagtgggtacggatgcagaagctggagatggagcaggtgtggcgggccagcaccagcctgaagcccccgaccgcggacctcttcactggtagggggcttggtgtgcttcccaatggttacaacccgccaaggaatctgtgctgggatgtgctgtgtgtcgatcagccggtggtggaggaccctcgcagc

SEQ ID NO: 2416 - DNA, 227 bp, Homo sapiens
  CDS 44..226
ctaaaattcaccacatagttggaagtaaaacactcctcagcaaatgcaaaagaacggaaatcataacagtctcttagaccacagtgcagtcaaattagaactcaggattaagaaactcactcaaaaccgcacaactacatggaaactgaacctgttcctgaatgactactgggtaaataatgaaatgaagggcaaaataaagaagttctttgaaaccaatgacaact

SEQ ID NO: 2417 - DNA, 322 bp, Homo sapiens
  CDS 155..322
  misc_feature 8: n=a, g, c or t
  misc_feature 9: n=a, g, c or t
aacctgcnngaaccagcagagaaggggccaggaacatactctgatcttacctcctccttcctctctcctgccagtactcttggacctagaaacacattttgtccaggaaagcagtttcaagtgagtgagttacgttgaatgctctgaaagaataatgcaacttctggaaatcccatggtatcagccaaagttgtcaatgaatcaaaaatcaactttgaggaatgttttgaaattcaaagtatatagaaaacatcacactctatgccttcgtatgcagaaaaaccataaagaaagaaaactggcctggcatggtggctcatgc

SEQ ID NO: 2418 - DNA, 266 bp, Homo sapiens
  CDS 82..264
  misc_feature 76: v=a or c or g
  misc_feature 130: m=a or c
  UNSURE 17: Xaa=Pro or Thr
caagaaaaggaatgtgagctggagaaggaaaaggaaaaattagaggagaaaattgaacccagagaacctaatttavagcccatggtagaaaaacaagaaagtgaaaacagctgtaataaagaggaggaamccgttttcactagacaagacagcaatcgcagtgaaaaggaagccacaccagtggtgcatgaaacagaaccagaatcagggtctcaacctcggccggctgtattatctggctatttcaaacagtttcagaagtcgat

SEQ ID NO: 2419 - DNA, 289 bp, Homo sapiens
  CDS 50..289
cattctggtctcatattgtgtggaaggcgcctctggctaaattatcctgatgataggacatgcagtgtgggcttggcgtgtccgtgctaggaatgtccctcttatcaccacggtgtgtgtcagttcacaaactgcacaaatcaagccaagtgagtggaaagtcacaatttctggctctttccaggtagctggcgtctctgggaacctggccccgggcaaccagccagagaaggagggccgggcgcaccagtgcctggagtgtgaccgcgccttctcatcggcggcccaa

SEQ ID NO: 2420 - DNA, 248 bp, Homo sapiens
  CDS 21..248
  misc_feature 94: r=a or g
  misc_feature 137: s=g or c
  misc_feature 174: r=a or g
  UNSURE 25: Xaa=Glu or Gly
  UNSURE 52: Xaa=Ile or Val
atggaatggattcaacttgaatggaatggaaggaatggaatcaacacgagtggaatgacatggattggaatggaatggaatggaatcaacccgrgtacaggggaatggaatggaatgcaatggactggaatggagtsggatggaatggaatggaatggaatggaatcaactcgrttggaatggaatggaatggaatggaatggaatggaattaacccgaatagaatggaatggaatggaatggaacgg

SEQ ID NO: 2421 - DNA, 248 bp, Homo sapiens
  CDS 65..247
tagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgc

SEQ ID NO: 2422 - DNA, 342 bp, Homo sapiens
  CDS 178..342
  misc_feature 22: d=a or g or t
  misc_feature 27: w=a or t
tacagagatgagtaagtcagtdgtggwccctaccttcatggagcttatggtctagtgggagagatgaatgttacacagatgatcacataaattgcatatgtaattacaaagcatgaaaaatgttgaaaaaccctagatgctttaaaaagaatgtaatagaaaattttatgtagattgatggcattaagggattcttctcctctgaaaaagaaacacttaagccaagacttcattcattcaacagaactattcaaacttgatatgggaaagttgaagtttagggagagaggtatcaagaattacttccaaatttctggcatgagcaactgggtggataaagga

SEQ ID NO: 2423 - DNA, 243 bp, Homo sapiens
  CDS 16..243
gacactgggcaggtcatgggtcgggggcctcccagtgccagggacctgtgcccacgtggtctcaccccaccctgtgctacctcatcttcccgggaggaagctccttcagacaagctggtgagtgaggtggaggagctgaacatgtccatcacagcgctgtgggagaagcttctagaaggggagcagtccctttgcaacctcgaggacatccacatgagcctggagaaggatgttaccgccatc

SEQ ID NO: 2424 - DNA, 168 bp, Homo sapiens
  CDS 13..168
  misc_feature 42: w=a or t
  misc_feature 63: m=a or c
  misc_feature 107: d=a or g or t
  misc_feature 111: r=a or g
  misc_feature 123: k=g or t
  misc_feature 131: m=a or c
  UNSURE 32: Xaa=Glu or Gly or Val
  UNSURE 40: Xaa=Lys or Thr
ttggccgcctccatggcccggggaggcgtgagtgccagggtwctgctgcaggctgccaggggmacctggtggaacagacctgggggcacttccgggtcgggggaggdggtrgcgctggggackaaccagamagtttcaagcgacaggctcgcgcccggcgggagaggt

SEQ ID NO: 2425 - DNA, 340 bp, Homo sapiens
  CDS 159..338
cagaggcttttatttgcataaatgtcggaccgtcttagctctcttgtgaaaggaactttttgccatattatagtggctcaccttacctcctggaatgcattctggcctcaagtctgtacctagcattgatagaggaagcccagcctggtgtgcacagcatgtacctggtgtgcacaacatgcacctggtgtgtattttctgaaatgtttgttcatggattaaacatcactcagctcgtgctgagccagctggattactttttccattccaatctgacaaacttggtcttgtatttcttagtccatttacttttttcccttagcctgtttatgccgctgac

SEQ ID NO: 2426 - DNA, 385 bp, Homo sapiens
  CDS 215..385
  misc_feature 219: r=a or g
  misc_feature 262: r=a or g
  misc_feature 293: r=a or g
  misc_feature 297: m=a or c
  misc_feature 306: w=a or t
  misc_feature 315: m=a or c
  misc_feature 321: w=a or t
  misc_feature 327: w=a or t
  misc_feature 329: r=a or g
  misc_feature 336: w=a or t
  misc_feature 345: m=a or c
  misc_feature 357: w=a or t
  misc_feature 363: n=a, g, c or t
  misc_feature 379: m=a or c
  UNSURE 2: Xaa=Lys or Arg
  UNSURE 27: Xaa=Glu or Lys
  UNSURE 28: Xaa=Ala or Asp
  UNSURE 31: Xaa=Asp or Val
  UNSURE 34: Xaa=Ala or Asp
  UNSURE 36: Xaa=Asp or Val
  UNSURE 38: Xaa=Asp or Val
  UNSURE 39: Xaa=Glu or Lys
  UNSURE 41: Xaa=Asp or Val
  UNSURE 44: Xaa=Ala or Asp
  UNSURE 48: Xaa=Asp or Val
  UNSURE 50: Xaa=Ala or Glu or Gly or Val
caagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgarggacaaacaggacgaggagcagaggcttaaggaggaggaagargacaagaaacgcaaagaggaggaggaggcaraggmcaaggaggwtgatgaggmcaaagwtgaggwtraggaggwtgaggaggmcaaggaggaagwtgaggnggaagatgtcccggcmaggcct

SEQ ID NO: 2427 - DNA, 235 bp, Homo sapiens
  CDS 29..235
agaatcaatcggaatgtaatggaatggaatgcaacggaatggaatggaatggaatggagtggaatggaatggaatggaatgcaaaggaatggaatcaacccgagtggagtggcatggaatggagtgcaatggaatggaatggaatggtatcaactcgagtagaaaggaatggaatggaatggaaaggaatggaatgaaatcaactcgagtggaatggaatggaatggattggaat

SEQ ID NO: 2428 - DNA, 227 bp, Homo sapiens
  CDS 74..226
  misc_feature 14: s=g or c
  misc_feature 37: y=c or t
  misc_feature 38: y=c or t
  misc_feature 158: s=g or c
  misc_feature 190: s=g or c
  misc_feature 213: n=a, g, c or t
  UNSURE 29: Xaa=Glu or Gln
  UNSURE 39: Xaa=Asp or Glu
  UNSURE 47: Xaa= *  or Leu or Ser or Trp
aacgcccagcagtscccaccgtcgctgccgccgccayygccctcggccgctgccgaggcctcctgcagccatcatgtccgccagcgccgtctacgtgctggacctgaagggcaaggtgctcatctgccggaactaccgtggcgacgtggacatgtcasaggtggagcacttcatgcccatcctgatggasaaggaggaggaggggatgctgtngcccatcccggcca

SEQ ID NO: 2429 - DNA, 248 bp, Homo sapiens
  CDS 21..248
atggaatggattcaacttgaatggaatggaaggaatggaatcaacacgagtggaatgacatggattggaatggaatggaatggaatcaacccgagtacaggggaatggaatggaatgcaatggactggaatggagtgggatggaatggaatggaatggaatggaatcaactcgattggaatggaatggaatggaatggaatggaatggaattaacccgaatagaatggaatggaatggaatggaacgg

SEQ ID NO: 2430 - DNA, 463 bp, Homo sapiens
  CDS 41..463
  misc_feature 344: m=a or c
  misc_feature 415: m=a or c
  misc_feature 420: m=a or c
  UNSURE 102: Xaa=Lys or Gln
  UNSURE 125: Xaa=Asp or Glu
  UNSURE 127: Xaa=Ala or Glu
gaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgmaacaatttaaaaattcgttcaagaaaattcttcagagagcattaaaaaatgtgacagtcagcttcagagamactgmggagaatgcagtctggattcgaattgcctggggaacacagtac

SEQ ID NO: 2431 - DNA, 225 bp, Homo sapiens
  CDS 30..224
ataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagcct

SEQ ID NO: 2432 - DNA, 187 bp, Homo sapiens
  CDS 3..185
agatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgccaccgccttctccaggctggcttcagtgaactcaaggt

SEQ ID NO: 2433 - DNA, 385 bp, Homo sapiens
  CDS 111..383
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaaga

SEQ ID NO: 2434 - DNA, 196 bp, Homo sapiens
  CDS 17..196
gcggcgggcgttgaaaatgcaatggggcatgtgggatgaggaggtggggaagggtactggggcagagagatgccgatcgatagaaacagcgaggagagacggagagagaccagagactcaagggcaaagagagacgaaggaccggcgggaggaagagagagagagacagagagacagactcacagactgggaggag

SEQ ID NO: 2435 - DNA, 245 bp, Homo sapiens
  CDS 79..243
aagtgaaggcttccgtccctggagaggaggcggtgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcca

SEQ ID NO: 2436 - DNA, 301 bp, Homo sapiens
  CDS 93..299
tagctttaagatcgggggagggtaaataatgcaaaaattgcacagtggaagaaggggtctcacaaaaagcaatccatcctgtagtataggtaatggagttgggggaagcagcttccattctggatgtttggaacccttttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccat

SEQ ID NO: 2437 - DNA, 393 bp, Homo sapiens
  CDS 70..393
  misc_feature 137: k=g or t
  UNSURE 23: Xaa=Cys or Phe
aaaaaggctggggcggctgcctgtgcacctgggccgtgccgggcctgtgtgtgggtcgtggtttctgcaatggtattggcttcactcgagctccttcgagagcagtggatccgggccaagtacgagcgacaggagtkcatctacccggagaagcaggagccctactcggcagggtaccgtgagggttttctctggaagcgtggccgggacaacgggcagtttttgagccggaagtttgtgctgacagaacgagagggtgctctgaagtatttcaacagaaatgatgccaaggagcccaaggccgtgatgaagatcgagcacctgaacgccaccttccagccggccaagatcggccacccccacggcctgcaggtcacctacctgaaggacaac

SEQ ID NO: 2438 - DNA, 273 bp, Homo sapiens
  CDS 84..272
acataaattttgatattttgtttccttgttttcattcagcttatgcaattctcttaatattcttgtggtttctttcttggcttatggattgtttagaagtgcattgcttggtttccaaatattttccaaaatccccttctgtattttccaaatgtgtattttccaaattttctcctgtattttctatttttaatttcattgtgattggagagcatactgtgtatgatttcagttgcttaaaatgtattgagacttgttttcaacctagccccc

SEQ ID NO: 2439 - DNA, 370 bp, Homo sapiens
  CDS 199..369
  misc_feature 12: s=g or c
  misc_feature 13: h=a or c or t
  misc_feature 100: m=a or c
  misc_feature 103: n=a, g, c or t
  misc_feature 115: r=a or g
  misc_feature 116: r=a or g
  misc_feature 124: m=a or c
  misc_feature 153: s=g or c
  misc_feature 159: m=a or c
  misc_feature 160: s=g or c
  misc_feature 181: r=a or g
  misc_feature 205: s=g or c
  misc_feature 206: m=a or c
  misc_feature 213: m=a or c
  misc_feature 313: y=c or t
  misc_feature 326: y=c or t
  misc_feature 327: w=a or t
  misc_feature 329: m=a or c
  UNSURE 3: Xaa=Ala or Asp or His or Pro
  UNSURE 39: Xaa=Pro or Ser
  UNSURE 43: Xaa=Phe or Leu or Ser
  UNSURE 44: Xaa=Lys or Thr
ttccctcacctshacctgccaagatcaccccaagcagaaaccagtaggcataataattaggatcataacaaactctacctcacggggctgacccgaagamtgnatgcatagcagrrcacatggmtcagctggccagccggcaggtcttagcasgtcatmstggcggaatgaccagcccacragtcttagcaggtcgcaatggtgsmtgcaggmtgtttctgcctgaccagcctccattctcacttccgtttctgcctggatatgacaaatgtcgacctggagctgttggggccatctgggcagaaaggctgtycgggaatgaagtywamgagatggaagaagagaaaaagaggccggcgtctggggtcat

SEQ ID NO: 2440 - DNA, 253 bp, Homo sapiens
  CDS 35..253
  misc_feature 5: m=a or c
  misc_feature 24: r=a or g
  misc_feature 143: m=a or c
  misc_feature 164: r=a or g
  UNSURE 37: Xaa=Arg or Ser
  UNSURE 44: Xaa=Ile or Val
attgmgttacagatttaacagctrtgctttcaagatgtctggccacggtaagggcggaaagggtctaggtaagggtggcgccaagcgtcaccgtaaggtattgcgtgacaatatccaaggaatcaccaagcccgctatccgcmgcctggctcgccgcggcggcrtcaagcgtatttctggcctcatttatgaggaaactcgcggagtgctgaaagttttcctggaaaatgtaatccgcgatgctgtcaccacg

SEQ ID NO: 2441 - DNA, 453 bp, Homo sapiens
  CDS 235..453
  misc_feature 7: y=c or t
  misc_feature 8: y=c or t
  misc_feature 329: k=g or t
  misc_feature 330: n=a, g, c or t
  misc_feature 333: w=a or t
  UNSURE 32: Xaa=Leu or Arg
tatttcyyaataagacttgaaagctgaaatgattccttgatccatgggctacagaatgaatgttgtgtttgcaggcatgaaaacagcattcatttccttgaacatctccatcagaactcttgggtgaccaggtgtgttgtcagtgagcagcagtattttgaaaggaatttttttttctgagcagtagttcttaacagtgggcttaaaatattcagtaaaccatcctgtaaacagatgtgctatcttccagaccctgttgtttcgtccctggagcataggcagagtagatttagcatagttgttttgttttgttttttgagacagggacknatwctgtcacccaggctggggtgctggagcgcagtggtgcaacctctgcctcctgtgttcaagcgattttcctgtctcagccacctgagtagtggggatacaggtgtacacaccacacctggc

SEQ ID NO: 2442 - DNA, 235 bp, Homo sapiens
  CDS 26..235
caaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccactttttttggagtttggtgaggca

SEQ ID NO: 2443 - DNA, 464 bp, Homo sapiens
  CDS 255..464
  misc_feature 7: m=a or c
  misc_feature 8: m=a or c
aggctgmmttcgcttctcaaggtaaggaagtggaggattaaatgatttgcccaaagtctcacagtaatttgtagagctgagattgaaattcgggtgaaacttcacatatcacattctttttatcaggtatgttgagaatatggtttgctgaacacagaaagcaagtagttatctagaattatggtccagttgtgtaaaagcttttatattttaattatatatgacaataatgggcttttacccttctttttgagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctggga

SEQ ID NO: 2444 - DNA, 189 bp, Homo sapiens
  CDS 21..188
  misc_feature 14: s=g or c
  misc_feature 15: m=a or c
  misc_feature 91: r=a or g
  misc_feature 92: s=g or c
  misc_feature 96: s=g or c
  misc_feature 110: s=g or c
  misc_feature 146: r=a or g
  misc_feature 172: m=a or c
  misc_feature 182: r=a or g
  misc_feature 183: n=a, g, c or t
  UNSURE 24: Xaa=Asp or Glu or Gly
  UNSURE 26: Xaa=Glu or Gln
  UNSURE 30: Xaa=Asp or Glu
  UNSURE 51: Xaa=Ala or Glu
  UNSURE 55: Xaa=Ala or Pro or Ser or Thr
gatggcgtttttasmtcctgatgatgatgcacagccttcagcgggggacatttaagacgcagaacaccaggtccaggctgcagctgcgggrstcasaggcgaagcttgasgggctcagggaggacgaagaaccacccttgagagargaggcagcagcagcggcggcagcagmagcggcagcrnccccac

SEQ ID NO: 2445 - DNA, 275 bp, Homo sapiens
  CDS 40..273
  misc_feature 20: s=g or c
  misc_feature 21: r=a or g
  misc_feature 259: s=g or c
  misc_feature 260: r=a or g
  UNSURE 74: Xaa=Glu or Gly or Gln or Arg
attatcagctttctggacasrcagacagagacagacaggatggacttcctccggctatacctccctgggctgcaccaggccttgaggggggcactggattccctcggcacctttgtctcctacctcctgggagatgcagtccccactgtagagcgggaggcgcaggcggctgaggaactgggggtggtggcggtgggaaagacagggaagattgtagaggaggaagcccaggaggacctggagggccttagaggcagcsraaacgaggggggcta

SEQ ID NO: 2446 - DNA, 363 bp, Homo sapiens
  CDS 116..361
  misc_feature 13: y=c or t
  misc_feature 92: w=a or t
gggtggttaggayccttgtgctgaagcatacaccgggtgtttctgtgcagtattttgaggtctttttcaacctattgtatttaatctgtgawtccttataacactgacaatcggtatgattgatccggattttgcagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggacaa

SEQ ID NO: 2447 - DNA, 324 bp, Homo sapiens
  CDS 137..322
gtaggcgctggagctgaggacgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtaagacgtgaagggagagggaaagcgccggaacgactgggtcgccccactagtaagcttcctgcgctcccccgccgatacccgcc

SEQ ID NO: 2448 - DNA, 201 bp, Homo sapiens
  CDS 25..201
gacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggcccc

SEQ ID NO: 2449 - DNA, 183 bp, Homo sapiens
  CDS 6..182
catcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcggc

SEQ ID NO: 2450 - DNA, 246 bp, Homo sapiens
  CDS 74..244
gtcccgcgttcggggagtatgtcaaggccgtgacccgtgtattattgtccgagtggccggaacgggagccaacatggcagcggggttcgggcgatgctgcagggtcctgagaagtatttctcgttttcattggagatcacagcatacaaaagccaatcgacaacgtgaaccaggattaggatttagttttgagttcaccgaacagcagaaagaatttcaagctactgctcgtaaatttgccagaca

SEQ ID NO: 2451 - DNA, 397 bp, Homo sapiens
  CDS 175..396
  misc_feature 82: s=g or c
  misc_feature 210: s=g or c
  misc_feature 211: s=g or c
  misc_feature 363: n=a, g, c or t
  UNSURE 12: Xaa=Asp or Glu
  UNSURE 13: Xaa=Ala or Pro
attgctgagaagatggcattggagcaaggacctgaaggaagggaggctgccctccctgccaccggaagtgactcccctcagsaaggccaaggtggctcacgtgtcccatcaccctttcatctctgcccttctctctcgagtgacagcatggcgtgacatgagggctctccagccatggccttgcagccctcttggaacgtgcgcatcgassccagtagcctgtccttcaacatgtggaaggagatccctatccccttctatctctccgtctacttctttgacgtcatgaaccccagcgagatcctgaagggcgagaagccgcagtgcgggagcgcgggccctacgtgtacagggagttcaggnacaaaagcaacatcaccttcaacaacaacgacac

SEQ ID NO: 2452 - DNA, 342 bp, Homo sapiens
  CDS 6..341
agagaatgcagtggccacgtgggacaggcatcggaggagcagggagacccaccagggtctgggagcaacccaggcagtggatggggctcagtccggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagtccacgagcacatcaagcg

SEQ ID NO: 2453 - DNA, 427 bp, Homo sapiens
  CDS 78..425
cttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcga

SEQ ID NO: 2454 - DNA, 445 bp, Homo sapiens
  CDS 230..445
  misc_feature 36: v=a or c or g
  misc_feature 44: w=a or t
  misc_feature 45: w=a or t
  misc_feature 393: r=a or g
  UNSURE 55: Xaa=Glu or Gly
tctccccgcagaggaggatcctggaaggacgcggavtgagggcwwgggggatgcagtggcctggacgaggtgactccaacccgggggagcagagtccgtcacgccggcagggaccgagggtctctgcggagctggaggaccttttgtgggatgcctcacggctgctgaggggctgcagcggcagccattgtttgatgtcctgtgactgagaaaccaggctttaaactttatgcctttggagatggagcccaagatgagcaaactggcctttggctgtcagagaagttccacatcagatgatgactctggctgtgcattggaggagtacgcctgggtccccccgggcctgagaccagagcagatccagctctattttgcttgcttaccagaggraaaagttccttacgttaacagccccggagagaagcatcggattaaacagctt

SEQ ID NO: 2455 - DNA, 354 bp, Homo sapiens
  CDS 175..354
  misc_feature 320: w=a or t
  UNSURE 49: Xaa=Ile or Lys
tttaataaatggtgctgggaaaagtggctagccatatgtagaaagctgaaactggatcccttccctacaccttatacaaaaatcaattcaagatggattaaagacttaaactttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagawaatttttgcaacctactcatctgacaaagggcca

SEQ ID NO: 2456 - DNA, 255 bp, Homo sapiens
  CDS 15..254
  misc_feature 194: w=a or t
ataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtwtctgaatatattataaaaacagatgagaatgttcgtaaagaaaacaacaaaaaagagagac

SEQ ID NO: 2457 - DNA, 283 bp, Homo sapiens
  CDS 6..281
aggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagctgagaagtcatcaggagaacagcaacagaatggtgacttcaaagatggcaaaaataagacagacaagaaggatcactctaacatcggaaatgattcaaagaaaacagatggcacaaaacagcgttctcacggctcaccagcccc

SEQ ID NO: 2458 - DNA, 344 bp, Homo sapiens
  CDS 162..344
  misc_feature 203: v=a or c or g
  misc_feature 204: r=a or g
  misc_feature 319: s=g or c
  misc_feature 343: y=c or t
  UNSURE 15: Xaa=Glu or Lys
  UNSURE 53: Xaa=Ala or Gly
  UNSURE 61: Xaa=Leu or Ser
taaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtvraacagcctgagaaagtggcagctaccaggcaggagatcttccaggagcagttggcagcagtgccagagttccgcggtcttgggcccctcttcaagtcctcgcctgagcccgtggscctcaccgagtcagagacggagtya

SEQ ID NO: 2459 - DNA, 161 bp, Homo sapiens
  CDS 4..159
  misc_feature 133: m=a or c
  misc_feature 135: s=g or c
  misc_feature 137: m=a or c
  UNSURE 44: Xaa=His or Lys or Asn or Gln
  UNSURE 45: Xaa=Ala or Glu
aaaatgaaaaagaaaagaaaagaaaagaaaagaaagaaagaaggaaagaaagaaagaaagaaagaaagaaagaaagaaagaaagaaagaaagaaggaaggaaggaaggaaggaaggaaggaaggaaggaaggmasgmaggaaggaaagaaagaaagagaaa

SEQ ID NO: 2460 - DNA, 248 bp, Homo sapiens
  CDS 95..247
  misc_feature 179: m=a or c
  misc_feature 187: k=g or t
  misc_feature 202: w=a or t
  misc_feature 208: w=a or t
  misc_feature 230: m=a or c
  UNSURE 29: Xaa=Pro or Thr
  UNSURE 31: Xaa= *  or Tyr
  UNSURE 36: Xaa=Lys or Asn
  UNSURE 38: Xaa=His or Gln
  UNSURE 46: Xaa=His or Asn
ctaaaaacacaaaaattagctggacatggtggcaggtgcctgtaatcccagctactcaggaggctgaggcaggagaattgcttgaacccaggagatggaggttgcagtgagccaagattgtgccatgccactccagccagggggacaagagggagacttcacctcgaaagacagacagmcaggctaktacgttttccacaawtttcawttttactctcttcccccaccamacacacacacacacacag

SEQ ID NO: 2461 - DNA, 248 bp, Homo sapiens
  CDS 95..247
  misc_feature 16: d=a or g or t
gtttctattcagtgtdatactagaagtactacccagagcagtgacactaaaaagcaaccacacaaacaagtctgcataataactagctaacatcatgatgacaggatcaaatctacacatatcaatacaagccttgaatataaatgagctaaatgtcccaattataaaacacacagtggtaagctggataaggaaccaagacccattggcatgctgtcttcaagagacctctcacatgcaaagacaca

SEQ ID NO: 2462 - DNA, 361 bp, Homo sapiens
  CDS 89..361
  misc_feature 46: m=a or c
  misc_feature 204: r=a or g
  misc_feature 361: n=a, g, c or t
  UNSURE 39: Xaa=Lys or Arg
  UNSURE 91: Xaa=His or Gln
gaaaccgtttggcaggggcggcggtggcggcggcgttggcggcagmggccgagcggaaagcttgcgtgtggtggtgccagattggattatggaagtgggaagtgaagaagaaaaatgggagaagctggatgcagaatttgatcactttgtggttgatatgaagccctttgttctaaaattacctcataggacagaacggcagargtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggcan

SEQ ID NO: 2463 - DNA, 251 bp, Homo sapiens
  CDS 98..250
  misc_feature 46: s=g or c
  misc_feature 50: h=a or c or t
  misc_feature 150: w=a or t
  misc_feature 207: m=a or c
  UNSURE 18: Xaa=Phe or Tyr
  UNSURE 37: Xaa=Pro or Gln
agcgggcggccgcggctgtgccctctcctactcctcaccgcgcgasccghggaaccagtagccgcggctgcttcggttgccgcggtcggtggtcgttatggattctccatgggacgagttggctctggccttctcccgcacgtccatgtwtcccttttttgacatcgcgcactatctagtgtcagtgatggcggtgaaacgtcagcmgggagcagctgcattggcatggaagaatcctatttcaagctggt

SEQ ID NO: 2464 - DNA, 282 bp, Homo sapiens
  CDS 119..280
ctgtactagttaacattccaaccaatattgtgtaatagtttcattttctccacatccatgccagcatttgttattttttgttttttgttttgaaaatagccattctaactgaggtgggatgataattcattgtgatttcaatttgcatttccatgatgatagtgatgttgatcagtttttcacatatttgttggtcatttctatgtcttcttttgagaaatgtctgttcagatcatttgcccattgcataatcagattattattattattattttgctttga

SEQ ID NO: 2465 - DNA, 218 bp, Homo sapiens
  CDS 64..216
  misc_feature 217: h=a or c or t
acattggaatcaacccgagaggaatggaatggaaaggactggaatggagtggaatggaatggaatggaatggaatggaatcaactcgattacattcgaatggaatggaatggaattaaaacgaatagaatggaatggaatggaatggaacggaacggaatggaatggaatggaatggaatggaatggaatggaatggaacggaacggaacggagtgha

SEQ ID NO: 2466 - DNA, 158 bp, Homo sapiens
  CDS 5..157
ccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggccgggtactg

SEQ ID NO: 2467 - DNA, 419 bp, Homo sapiens
  CDS 217..417
  misc_feature 229: n=a, g, c or t
  UNSURE 5: Xaa=Leu or Met or Val
tttttatttttattttgttttattttgagatagtgtctctgttgcttagtctgagtgcagtggtgcaatcttggctcactgcaagctccgcctcccgggttcacaccattctcctgcctcagcctctccagtagctgggactacaggcgcctgccaccatgcccggataattttttttatttttatttttatttttagtagagatggggtttcaccatgttagccaggntggtctcgatctcctgcatcccccttctttccagccctagctcaggcccatcgtccccagctgatgtcgccctgtctgcacgatgcctgggcacctactccacactcctcactggcctcaggccccaccagccctgcctcgagctagcccctccacccgtcatcactcctgccagactccagatgtccaa

SEQ ID NO: 2468 - DNA, 176 bp, Homo sapiens
  CDS 22..174
atgatgctgctgtgaacattcatgttcgtgattttatgtggacataagattccatatgagaagtttgtgtttaaacgtttgagaaactggcagccttttccaaagtggctgtacattttacattttcatgggcaatggttgagagttccagttttgccacatccttgccaacaccg

SEQ ID NO: 2469 - DNA, 180 bp, Homo sapiens
  CDS 27..179
aatggaatggattcaacttgaatggaatggaaagaatggaatcaacacgagtggaagggcatggattggaatgcaatggaatggaatcaacccgagtacaggggaatggaatgggaatggaatgcaatggaatggaatcatccgtaatggaatggaaaggaatggaatggaatggaatgg

SEQ ID NO: 2470 - DNA, 261 bp, Homo sapiens
  CDS 22..261
atccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagact

SEQ ID NO: 2471 - DNA, 161 bp, Homo sapiens
  CDS 6..161
  misc_feature 14: d=a or g or t
  misc_feature 149: k=g or t
  misc_feature 150: k=g or t
  UNSURE 3: Xaa=Lys or Asn
  UNSURE 49: Xaa=Gly or Trp
ccaaaatgactaadagtctccactacgatttacctataggggtcttccaaaggctccaagctgctatgcaagctgctctgccacttgggccatatgatccagtatatccaatggtatttgaggtgtcagtggcagacagggatgctgtkkggagcctttgg

SEQ ID NO: 2472 - DNA, 396 bp, Homo sapiens
  CDS 84..395
  misc_feature 255: n=a, g, c or t
  misc_feature 262: s=g or c
  UNSURE 58: Xaa=Ala or Pro or Ser or Thr
  UNSURE 60: Xaa=Ser or Thr
atcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcgggggncgcggascctgaagatggtccctcagccaggcagcctctgcccagaaggaacgtgccggttggcatcactgaaggagatggctcaaggactgggagtctcccagcaagttctgtgcacttttgcaagactagctccttgct

SEQ ID NO: 2473 - DNA, 275 bp, Homo sapiens
  CDS 20..274
tcgcccaggctggagtgcaatggcgtggtctcagctcgctgcaacctctgcctcccaggttcaggtgattctcctgcctcagcctcagctaattttttttgcatttttagtagagatggggtttcaccatgtcagccaggctggtctcgaactcctggcctcaagtgatctgcctgtctctgcctcccaagatgctaggcttaacaggtgtgagccaccgtgcccggctggaaggggtcttgaatcacatcctaaatatgtgtctccaggggcga

SEQ ID NO: 2474 - DNA, 196 bp, Homo sapiens
  CDS 33..194
attataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctccccccaa

SEQ ID NO: 2475 - DNA, 190 bp, Homo sapiens
  CDS 38..190
tatgatacatacataacctccaaagagtggcaataaaatgaacagccataaagctatcactctacttaaaaaaataaacatggccagtgctagtgaagcccctgctgtccctcccagattaaatcccatcctacccccagtacccagaagtaaccatcatcctagcttcttgttgatctgccccctgcct

SEQ ID NO: 2476 - DNA, 340 bp, Homo sapiens
  CDS 122..340
  misc_feature 20: w=a or t
  misc_feature 309: k=g or t
  UNSURE 63: Xaa=Gly or Val
tagaatgcaagatagtttcwtggcaccgggcatggtggctcgtgcctgtagtcccagcactttgggagaccgaggcaggcagatgacttgagctcacgagtttgagaccggccttggcaacatggggagacaccatcccccacttcccgtgtctgcaaacactatgaaaattagccaggcatggagttgtgtgcttgtggccccagctacgtgggaggctgaggttggggatggcttgagcctggaaggcagagggtgcaacgagcctggattgtaccactgcactccatcctgggagacagaaacagkgcttgtctcaaacaaaacaaaacaaaaccac

SEQ ID NO: 2477 - DNA, 344 bp, Homo sapiens
  CDS 28..342
  misc_feature 71: n=a, g, c or t
  UNSURE 15: Xaa=Ala or Glu or Gly or Val
taattaaaccgaatagaatggagtggaatggaatggaacggaacagaacggaacggaacggaacggagtgnaatggaatggaatggaattgtatggaatggaatggaatggtacggaatagaatggaatggaaagaattggaatggaatggaatcgaatggaatggaatggaatggaatggaatcaacccgagtgcaggggaatgtaatggaacggaatgcaatggaatggaatcatccggaatggaatggaatggaatggaatggaatgcaatggaatggaatcaacccgagcgcaatggaatggagtggaatggaatggaatgtaaatggaacaacccgaaa

SEQ ID NO: 2478 - DNA, 160 bp, Homo sapiens
  CDS 1..159
  misc_feature 128: r=a or g
  UNSURE 43: Xaa=Gln or Arg
atgtcaggtttgtttaaaacagcaagagaggccttgactgagttggatgcccctgctcccattcagatggtccccacaacaaaggaacggaatggcagtggaggagaccagtgtggtttagagatgcraatcatcacgcgttatggagaaaacagacacc

SEQ ID NO: 2479 - DNA, 225 bp, Homo sapiens
  CDS 3..224
  misc_feature 13: m=a or c
  misc_feature 119: y=c or t
  misc_feature 120: y=c or t
  misc_feature 225: k=g or t
  UNSURE 4: Xaa=Asn or Thr
  UNSURE 40: Xaa= *  or Arg
caatggaatggamtggaaaggaatggaatggaatggaatggaaaggaatgccttcaaaccgaatggaattgaaaggaatggaatcaacacgagtggaatggaatgcaatggaatggaayygaatggaatggaatgccatgatacggaatagaatggaatggaacgaaatggaatggaatggaatggaatggaatggaatcgttccgagtggaataggagggagak

SEQ ID NO: 2480 - DNA, 233 bp, Homo sapiens
  CDS 3..233
ccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccta

SEQ ID NO: 2481 - DNA, 194 bp, Homo sapiens
  CDS 35..193
  misc_feature 20: v=a or c or g
  misc_feature 153: r=a or g
  UNSURE 40: Xaa=Cys or Tyr
cggaatagaatggaatggavcgaattgtaatggaatggaatggaatggaatcaacgtgagtacaggggaatgtaatggaacgaaatgcaatgcaatggaatcatccggaatggaatggaatgcaatggaaatggaatggaatcaacccgagtrcaatggaatggagtggaatggaatggaatggaatggaccaa

SEQ ID NO: 2482 - DNA, 382 bp, Homo sapiens
  CDS 172..381
  misc_feature 14: r=a or g
  misc_feature 91: r=a or g
  misc_feature 92: b=c or g or t
  misc_feature 93: s=g or c
  misc_feature 111: s=g or c
gccactctttccargttccttagctgtccctttagacagggcttctcagccagcactgttgaggtcgggactggacacttccttgttgtgrbsgcgccctgtgtgtcatasgatgtttagcagcatctgtgcctccctcagtggacgcctgtagcaccagggctcccgggcatgacagccggaaatgtcccctggcaggcaacggtgaccccagttgagaagcactgcgttatgtctgtccaattaccttcccagaagcatcgggcctgcacccggtggagctttggctacatctccttgagcccctctgtgcctgtctgcagcctggtctcggtgccgattgggaaagaatcctttggagtgccctccctcccccggtgca

SEQ ID NO: 2483 - DNA, 278 bp, Homo sapiens
  CDS 25..276
acggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctaccctt

SEQ ID NO: 2484 - DNA, 247 bp, Homo sapiens
  CDS 38..247
  misc_feature 66: b=c or g or t
  UNSURE 10: Xaa=Cys or Phe or Ser
ggatggaaggatttgtagatggttggtcattggatcaatggatggatggatagaagtgtgggagtbttattttttatttattttattttattttatttcatttttatttgagatggagtctcactctgtcacccaggctggagtgcaatggcacaatctcagctcactgcaagctccgcctcccgggttcacaccattctctcgcctcagcctcccgagtagctgggactacaggcgcccgccacct

SEQ ID NO: 2485 - DNA, 243 bp, Homo sapiens
  CDS 18..242
  misc_feature 8: w=a or t
  misc_feature 12: w=a or t
  misc_feature 13: w=a or t
  misc_feature 17: m=a or c
  misc_feature 27: h=a or c or t
  misc_feature 32: m=a or c
  misc_feature 46: h=a or c or t
  misc_feature 51: h=a or c or t
  UNSURE 4: Xaa=His or Asn or Tyr
  UNSURE 10: Xaa=Ala or Glu or Val
  UNSURE 12: Xaa=His or Asn or Tyr
aatggagwtggwwtggmatggaatgghatggmacaacacgaatgghatgghatgtaatggagagtaagggagttgaatggaatcaacccgaatgtagtggaatggaatggaacggaatggaatggaatggattgcaatggaatggaatcaacccgaatacaatggaatggaatggaatggaatggaatgccttcaaaccgaatggaatggaaaggaatggaatcaacacgagtggaatggaat

SEQ ID NO: 2486 - DNA, 271 bp, Homo sapiens
  CDS 55..270
aggatccaatttaattctgctacatgtgggtatctaattttcctagcagcatttatgacggtcctttccccattttatattattagcacctttttaaaagatcagttgaccataaaatttattttaatttatttctggaatctctcttttcttttcttttttcctttcctttcctatcctttcctttcttttcctttctttcttttttttctggaaacctggtctttctctgtcacccaggctggaatgaagtggtgcaatcaccggtcac

SEQ ID NO: 2487 - DNA, 203 bp, Homo sapiens
  CDS 27..203
gagcaagactccgtctcaaaacacacatgcgcggactgaaaggtgtggcaatttgtcccatgtcacagatgaaacgggggctcagggcccttctgcgctggcccaggttgcacgcctcatgtgcacttatgtcaagcagggatcagaggctgcctagctgggcccgtgctgtctgctgcgccagggccacacacacacacaca

SEQ ID NO: 2488 - DNA, 291 bp, Homo sapiens
  CDS 99..290
  misc_feature 245: n=a, g, c or t
  misc_feature 246: d=a or g or t
  misc_feature 285: d=a or g or t
  misc_feature 286: r=a or g
  UNSURE 50: Xaa= *  or Glu or Lys
  UNSURE 63: Xaa= *  or Glu or Gly or Lys or Arg
caactcgattggaatggaatggaatggaatggaatggaattaacccgaatagaatggaatggaatggaatggaacggaacggaatgtaatgtaatggaatggaatggaatggaatggaatcaactcgactgcaggggaatggaatggaatggaatgcaatggaatggattcaacttgaatggaatggaaagaatggaatcaacacgagtgcaatggactggagaggaatggaatggaatgcaacndaacggaatggaatggaatggaatggaatggaatggaacdraaccc

SEQ ID NO: 2489 - DNA, 256 bp, Homo sapiens
  CDS 84..254
  misc_feature 178: s=g or c
  UNSURE 32: Xaa=Ser or Thr
tgggaggccgaggcgggcagatcacgaggtcaggaggtcgagaccatcctggctaacacggtgagaccctgtcactactgaaaatgcaagaaattagccgggcgtggtggcgggcgcctgtggtctcagctgcatgggaggctgaggcaggagaatggcgtgaacccgggaggcggasttgcagtgagcggagatcttgccactgcactccagcctgggtgacagagccagactccatctcaaaaaaaaaaaaaaa

SEQ ID NO: 2490 - DNA, 189 bp, Homo sapiens
  CDS 8..187
  misc_feature 137: v=a or c or g
  misc_feature 138: m=a or c
  UNSURE 44: Xaa=Ala or Asp or His or Asn or Pro or Thr
caatggaatggaatggaatggaacagaatggagtggaatggaatggaatcaacccgagtgcaggggaatggaatggaatggaatgcaatgtaatggaatcatccggaatggaatgggatggaatggaatggaatggvmtggaatggaatggaatggaatcaacgcgagtgcaggggaatggaatggaaa

SEQ ID NO: 2491 - DNA, 190 bp, Homo sapiens
  CDS 8..190
  misc_feature 45: s=g or c
  misc_feature 58: r=a or g
  misc_feature 110: s=g or c
  misc_feature 120: k=g or t
  misc_feature 131: s=g or c
  misc_feature 132: m=a or c
  misc_feature 135: k=g or t
  misc_feature 147: m=a or c
  misc_feature 148: m=a or c
  misc_feature 174: s=g or c
  misc_feature 188: m=a or c
  UNSURE 13: Xaa=Ser or Trp
  UNSURE 35: Xaa=Gly or Arg
  UNSURE 38: Xaa=Leu or Trp
  UNSURE 42: Xaa=Ala or Glu or Pro or Gln
  UNSURE 43: Xaa=Leu or Trp
  UNSURE 47: Xaa=Ala or Asp or Glu
  UNSURE 56: Xaa=Arg or Thr
  UNSURE 61: Xaa=Lys or Gln
caatggaatggaatggaatggaacagaatggagtggaatggaatsgaatcaacccgartgcaggggaatggaatggaatggaatgcaatgtaatggaatcatccggaatsgaatgggatkgaatggaatgsmatkgaatggaatggmmatggaatggaatcaacgcgagtgcasgggaatggaatggmaa

SEQ ID NO: 2492 - DNA, 221 bp, Homo sapiens
  CDS 65..220
tcttcaacgctgtcacacagggacatttaagtctgcagaagtttccgctgccttttgttcagctatgccctcccctcagagatggagtctacagaggcaggcaggcctcattagctgcggtgggactccacccagttcgaccttcccggccactttgtttacctactcaagcctcagcaatggcggacaccacgcccatggagccttggtcactggtagca

SEQ ID NO: 2493 - DNA, 391 bp, Homo sapiens
  CDS 186..389
  misc_feature 248: b=c or g or t
  misc_feature 249: n=a, g, c or t
  misc_feature 250: n=a, g, c or t
  misc_feature 265: w=a or t
  misc_feature 266: r=a or g
  misc_feature 318: w=a or t
  misc_feature 334: w=a or t
  misc_feature 335: w=a or t
  misc_feature 336: w=a or t
  misc_feature 338: w=a or t
  misc_feature 348: w=a or t
  misc_feature 349: w=a or t
  misc_feature 350: k=g or t
  misc_feature 353: w=a or t
  UNSURE 22: Xaa=Ala or Cys or Asp or Phe or Gly or His or Ile or Leu or Asn or Pro or Arg or Ser or Thr or Val or Tyr
  UNSURE 27: Xaa=Glu or Val
  UNSURE 45: Xaa=Leu or Met
  UNSURE 50: Xaa= *  or Phe or Leu or Tyr
  UNSURE 51: Xaa=Phe or Ile or Leu
  UNSURE 55: Xaa= *  or Phe or Ile or Lys or Leu or Met or Asn or Tyr
  UNSURE 56: Xaa=Phe or Leu
ttcagggcatataatctgaccatggaataagacaagttaattataatttggtggattggaatcagataccctagcctcattggtaccatgttctgcctagctaaacagttacttcttttgctaggggggagccaaagacatggtatggtgtgccatctcatgctgcagagcaactggaggaggtgatgagagagctggcccccgagttatttgaatcccagcctgatcttctgcatcagttagttacbnncatgaaccccaacgwrctaatggagcatggtgtgcctgtgagtcttttggtgtcttccttcagttgtwtgtttgtttgtttgtwwwtwtcttttttcwwkttwtttgaaacagggtcttgctctgttgcccaggctggagt

SEQ ID NO: 2494 - DNA, 197 bp, Homo sapiens
  CDS 36..197
cctacttcagcctcctgagtgctgggattacaggcatgagccactgtaaagaattttttttaacatctttttctttttttctttttgagagggagtcttgctctgttgcccaggatggagtgcagtggcgcgatctcggctcactgcaacctctgcctcccaggttcaagagattctcctgcctcagcctcccaagc

SEQ ID NO: 2495 - DNA, 331 bp, Homo sapiens
  CDS 66..329
agaccggaaggtgaacatgccctgcacgggtctggcagcaagcgtctcccccgtctcctcacaggatggacctgacagcttacgctgagctgctgaaagaatccggcaaccaggttcttaagaatgggaacttctctttggccatcagaaagtacgatgaagccatccagattctcctgcagttataccagtggggggttcccccgagggacttggctgtgctgctgtgcaacaaatcaaatgcatttttcagccttgggaagtggaatgaggcatttgttgctgccaaggaatgtctccaatgggatccaacctacgtgaagggatgcac

SEQ ID NO: 2496 - DNA, 181 bp, Homo sapiens
  CDS 23..181
  misc_feature 13: y=c or t
  misc_feature 14: y=c or t
  misc_feature 160: s=g or c
  misc_feature 161: m=a or c
  UNSURE 46: Xaa=Arg or Ser
  UNSURE 47: Xaa=His or Asn
aaatggaatggayycaacttgaatggaatggaaagaatggaatcaacacgagtggaagggcatggattggaatgcaatggaatggaatcaacccgagtacaggggaatggaatggaatggaatgcaatggaatggaatcatccgtaatggaatggaaagsmatggacatggaatggaatgg

SEQ ID NO: 2497 - DNA, 293 bp, Homo sapiens
  CDS 130..291
taatgggtacaaaaaaaagagagaaagaatgaataagacctactatttgatagcacaacagggtgactatagtcaataataacttaattgtgtatttttaaataacttagaggccgggcggggtggctcatgcctgtaatcccagcattttgggaggccgaggtgggtggatcacctgaggtcaggagtttgagaccagcctggccaacatggcggaaccctgtctttactaggaatgcgaaggttggctgggcgttgtggcgcatgcctgtaatcccagctgctcgggaggt

SEQ ID NO: 2498 - DNA, 161 bp, Homo sapiens
  CDS 4..159
aatatgattgaggacgttttctcactagcattaacatctgttgataattcttgccagaattattattataaggtttgccaaatgatgatttttctgattccatcatcctttctgcatctattaactgtctcttactgtaaggaagagcttggaagagctag

SEQ ID NO: 2499 - DNA, 199 bp, Homo sapiens
  CDS 22..198
acacgaatagaatggaatggaatggaattgaatggaacagaaaggaatggaatggaatggaatggaatcaacccaagtgaagtggaatggaatggaatggaattcaatggaatggaatcatccggaatggaatggaatggaatgaaatggaatggaatggaatggaatcaacccgagtgcaatggaatggagaggaatc

SEQ ID NO: 2500 - DNA, 217 bp, Homo sapiens
  CDS 57..215
  misc_feature 12: m=a or c
  misc_feature 13: s=g or c
  misc_feature 23: m=a or c
  misc_feature 191: s=g or c
  UNSURE 45: Xaa=Asp or Glu
aacttccagccmstgtgtatggmaataacctgaattgtattaatagcagttcttcaatgtgggcctgctgggggatgcttggttgttttccgttgtttgttccctgggtgcccgtcttgggcaagcatttctctgatgtctctatttatgtggcaggtcaccctgctgattgccttcatctgtgtgcggastccctgtggaccaactacagcgcctg

SEQ ID NO: 2501 - DNA, 263 bp, Homo sapiens
  CDS 27..263
agccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctctt

SEQ ID NO: 2502 - DNA, 215 bp, Homo sapiens
  CDS 10..213
  misc_feature 2: r=a or g
  misc_feature 24: r=a or g
  misc_feature 50: w=a or t
  misc_feature 56: k=g or t
  misc_feature 59: k=g or t
  misc_feature 69: k=g or t
  misc_feature 140: n=a, g, c or t
  UNSURE 5: Xaa=Ile or Met
  UNSURE 14: Xaa=Ile or Asn
  UNSURE 16: Xaa=Cys or Phe
  UNSURE 17: Xaa=Cys or Phe
  UNSURE 20: Xaa=Phe or Leu
  UNSURE 44: Xaa=Leu or Pro or Gln or Arg
trtatatatatgagatctcatatrtataccatctcatatatatactacawttcttkttktatttcattktattattatactttaagttttagggtacatgtgcacaatgtgcaggtttgttacatatgtatacatgtgcnatgttgctgtgttgcacccattaactcgcatttagcattaggtatatctcctaatgctatccctcccccctccct

SEQ ID NO: 2503 - DNA, 202 bp, Homo sapiens
  CDS 30..200
aatcgaagagaatcatcgaatggacccgaatggaatcatctaatggaatggaatggaataatccatggactcgaatgcaatcatcatcgaatggaatcgaatggaatcatcgaatggactcgaatggaataatcattgaacagaatcgaatggaatcatcatcggatggaaatgaaaggagtcatcatctaatggaattgca

SEQ ID NO: 2504 - DNA, 190 bp, Homo sapiens
  CDS 30..188
cactggtattttctacaaggagcctggtaatgaaactaaggaaaatacagtttgaggttctcttgaagatgaagagaaaacttggaaggtggttgagagtctcacgcctcgtctgctattgggtgggagctgctgctccagccgcctctggcctcacgtctggccctccgctgtgctcccgtgcccccct

SEQ ID NO: 2505 - DNA, 311 bp, Homo sapiens
  CDS 87..311
  misc_feature 7: m=a or c
  misc_feature 8: m=a or c
  misc_feature 160: w=a or t
  misc_feature 193: r=a or g
  misc_feature 268: m=a or c
  misc_feature 303: m=a or c
  misc_feature 305: m=a or c
  UNSURE 25: Xaa=Phe or Tyr
  UNSURE 36: Xaa=Lys or Arg
  UNSURE 61: Xaa=Ala or Asp
  UNSURE 73: Xaa=His or Lys or Asn or Gln
tcatttmmaacaacatgttctttaggcaatataaagctcttaggcaaaattatgtcaaaacataaagagctgtctcatttgttgtaatgaatgcgaagtatatattttatatacaaaggtgtgcctccaagttatatgtatttttttttattttttattwttttttgagatggagcctcactctatcgcccargctggagtacagtggcgccatctcggcccactgcaaactccgcctcccgggttcacttcattctcctgcctcagmctcccgagtagctgggactacaggcatgcgccacmamgcacgt

SEQ ID NO: 2506 - DNA, 268 bp, Homo sapiens
  CDS 85..267
cctgacctggcacctttgcctctctgctctcctctcttaccacactcctccttagttctccagcttgagtcacaggcttcatttatgcttttccaggaaccccaacccatgcttgcatcaggccctctgcacctgttcactctcctgacaaaaatggtagcagaaatgctccatcctcacatcttcccttcattcagaccttggctcagacatcacatgctcagacaggacttttctgaatcactgcttttttttttttttttttttt

SEQ ID NO: 2507 - DNA, 281 bp, Homo sapiens
  CDS 32..280
  misc_feature 237: n=a, g, c or t
  UNSURE 69: Xaa= *  or Leu or Ser
tacagtaggtgaattatgggatcgtgcattcatggatatttctgcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaaattcatacttnagtggaaagtttgaaactttctatcacagatcaacaactgcctt

SEQ ID NO: 2508 - DNA, 201 bp, Homo sapiens
  CDS 19..201
  misc_feature 2: n=a, g, c or t
  misc_feature 13: h=a or c or t
  misc_feature 28: n=a, g, c or t
  misc_feature 164: n=a, g, c or t
  UNSURE 4: Xaa= *  or Glu or Lys or Gln
  UNSURE 49: Xaa=Ala or Glu or Gly or Val
cnactcgattgthatggaatgcaatggnaatggaatggaatggaatggaatggaatggaattaacccgaataaaatggaatggaatggaatggaacggaatggagtggaatggaatggaatcaacccgagtgcaggggaatggaatggaatggaatgcaatggnaatggaatcatccggaatggaatggaatggaatggaa

SEQ ID NO: 2509 - DNA, 161 bp, Homo sapiens
  CDS 4..159
ggaatggaatggaatggaatggaatgcaatggaatggaatcaacccgagtgcaatcgaatggaatcgaatggaatggaatgcaatggaatggattcaacttgaatggaatggaaagaatggaatcaacacgagtggaatggcatggattggaatggaatgc

SEQ ID NO: 2510 - DNA, 234 bp, Homo sapiens
  CDS 52..234
  misc_feature 126: w=a or t
  UNSURE 25: Xaa=Asp or Glu
ttgacacagctctctttgtaagagaggaaagaaactaaacccacccaagggatgatttcagggggagaggtggagggcagatgtcctgggcaaaccgggcccctctgcccacacacctcacttgawccttttgccaaacttgtcaaactcaggggaactggcttcccagttgcccctttgccatattccaagtccccctcagacttcatgtctctgctcatcagcactgtccat

SEQ ID NO: 2511 - DNA, 234 bp, Homo sapiens
  CDS 21..233
taagattcttctaggctcaaatgtttatttttacaatctctattagtttcttttctttactatttatttatttatttatttattttttgagtcagattctccctctgtctcccaggctggagtgcagtgttgtgatctcagctcactgcaacctccacctcctgggttcaagcgattcttatgccttagcctcccaagcagctgggaccacaggcacatgccaccatgcccaac

SEQ ID NO: 2512 - DNA, 219 bp, Homo sapiens
  CDS 21..218
aaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagaccct

SEQ ID NO: 2513 - DNA, 212 bp, Homo sapiens
  CDS 2..211
  misc_feature 109: w=a or t
  misc_feature 122: n=a, g, c or t
  misc_feature 124: y=c or t
  misc_feature 125: w=a or t
  misc_feature 126: m=a or c
  misc_feature 133: w=a or t
  UNSURE 36: Xaa=His or Gln
  UNSURE 41: Xaa=Cys or Gly or Arg or Ser
  UNSURE 42: Xaa=Asn or Ser or Thr or Tyr
  UNSURE 44: Xaa=Phe or Leu
tatggattatcaacctgttcagttgactcttagttttaattctctctcatttcaatcctttctccatattggttgtaatgctcctaattcaggctccttttgtctccawctggatgattgtngywmtcctttwgtctccatctggatgattgttgtaacctccttaatggacattgaatgtccattctttcttcttttatcccctccacagc

SEQ ID NO: 2514 - DNA, 337 bp, Homo sapiens
  CDS 171..335
  misc_feature 311: n=a, g, c or t
ctacaaatggggagaaagtttgggggaggcatatatctcctagggggttgttataaaagatatgcaatgcgttaacagcgctaagcagcaataaccacaataagataacaccaaattgggcagggaccctgaatagacatttctgcacaggggacgtaacactgagcagaatggagagaaccaggtcctcagcatcgccgtcatcaggggtgggtccccgtcaggctcgcactagggtgtccctcccccctggtcaggtggtcgtgaccagagggacagaaggggacataggcttccctgggggcgggggntggaggggggtgaaagagtcccgatt

SEQ ID NO: 2515 - DNA, 276 bp, Homo sapiens
  CDS 82..276
  misc_feature 122: w=a or t
  misc_feature 124: y=c or t
  misc_feature 131: r=a or g
  misc_feature 134: w=a or t
  UNSURE 14: Xaa=Asp or Val
  UNSURE 15: Xaa=Phe or Leu
  UNSURE 17: Xaa=Asn or Ser
  UNSURE 18: Xaa= *  or Leu
ccctttagatttctcagttcttgcttatattttgaatctatattatcagatttcacacatttttattgttatgtattcctaatgaatcaacctttttattataacatgactctatttcttgwcyttggaarctwactttgtcttacattgatatattactacctttcttatatttacgttttacatggtaaatcactttccctctttttaatccatctgcgacttatacttattaaattttgtctctcatataagctaacatatagttgggccctt

SEQ ID NO: 2516 - DNA, 252 bp, Homo sapiens
  CDS 92..250
  misc_feature 198: k=g or t
  misc_feature 246: w=a or t
  UNSURE 36: Xaa=Leu or Trp
  UNSURE 52: Xaa= *  or Leu
tcctgaagacagattctctagagaaaatcattacaatgaagaaaatgaatattttttagattattgtcatgtttttaaattactttttaaaatggcttacaagtttactctcccaccagagcagtatgtttcactgcattttttccaaattatctccctttcgatttgctatttctataatttcctaatttttttttkgtttttttttaacactgcatacaaatacaagtatttctttcttttttwaaaaaa

SEQ ID NO: 2517 - DNA, 322 bp, Homo sapiens
  CDS 81..320
  misc_feature 119: k=g or t
  misc_feature 125: y=c or t
  misc_feature 280: n=a, g, c or t
  UNSURE 13: Xaa=Phe or Leu
  UNSURE 67: Xaa=Ile or Lys or Arg or Thr
tggaaaagccaaatctcatttacatcatctaaacacatagcacctcttctaaaagaggaacttgaaataaatgtaattgcatgtgtttgttactcaactttttaaaaatttgccccttkgaaatycctttaatgtttaatcttttctatcttttatcatacagaaatggtgattatgcacactgtacaatggcacaggccaatgtaggctggggcttagagaactggagaaaagcgtgtttgtgtgtagtacctcaggtactccttgccttgcagtccanagcaaatgtaccgcttctcctggttttctttctagaaactac

SEQ ID NO: 2518 - DNA, 215 bp, Homo sapiens
  CDS 31..213
agaagagatagcagatcttcagaaaagctgatggaaggccgggtgcagtggctcacgcctgtaatcccagcgctttgggagtccaaggcgggtggatcgcgaggtcaggagtttgggaacagcctgaccagcgtggtgaagccctgtctgtactggaagtgcagaaattggctgggtgtggtggcgcgtgcctggtcccagctgcttgagaggcc

SEQ ID NO: 2519 - DNA, 294 bp, Homo sapiens
  CDS 125..292
  misc_feature 119: y=c or t
  misc_feature 273: w=a or t
  misc_feature 274: n=a, g, c or t
  misc_feature 275: n=a, g, c or t
  UNSURE 50: Xaa=Ile or Lys or Met or Asn
  UNSURE 51: Xaa=Phe or Ile or Leu or Val
ttttctttctagttcaatccttgttgctctatttgttcattttcttgctgagttcatattatgttttattgtggtaaaatatatgtaacaaaatctaccattttaactatttttttttycccagatggagtctcgctctgtcacccaggctggagtgcaatggcgcgcaatctctgctcactgcaacctctgccttccgggttcaggcgattctcctgcttcagcctcccgagtagctgggattacgggcgtgtgccaccgtgcccagctaawnnttgtatttttagtagagat

SEQ ID NO: 2520 - DNA, 291 bp, Homo sapiens
  CDS 132..290
  misc_feature 17: w=a or t
  misc_feature 135: k=g or t
  misc_feature 147: r=a or g
  misc_feature 172: n=a, g, c or t
  misc_feature 180: b=c or g or t
  misc_feature 211: v=a or c or g
  misc_feature 255: b=c or g or t
  misc_feature 256: n=a, g, c or t
  misc_feature 270: s=g or c
  UNSURE 2: Xaa= *  or Gly
  UNSURE 6: Xaa=Glu or Lys
  UNSURE 14: Xaa=Ala or Asp or Gly or Val
  UNSURE 17: Xaa=Phe or Leu or Val
  UNSURE 27: Xaa=Pro or Gln or Arg
  UNSURE 42: Xaa= *  or Ala or Glu or Gly or Leu or Pro or Gln or Arg or Ser or Val
  UNSURE 47: Xaa=Ala or Pro
cactagcaagacagtawaacacccctggcacactaggggtgccacaggtgctgcctgtagccttgccagctaagcacatgacctctcttagagaagggctttctcaatgccttggctcctaaagtgaagtcatgkgaaaagtaaggragaaacgggtgcttgaaaaagcagnctcagtcbttctggatggcccccaggcagacaggagccvaggcctctggctccagcttgccagggtcacagagatgttcttcbnaactggcacttggsctcaccagcttctccccccac

SEQ ID NO: 2521 - DNA, 223 bp, Homo sapiens
  CDS 54..221
tgagttcctctccataacagagcgtcttactgtagggctcagcatacttttacatgtatagtattttaagttttttaaactatatgcatattatatataggtcttgcatatacattgataaatgtatccttacatatttcctgttttttaatgctgttgtaaaggtattggttttaaaattcaattttcacttgttcgttgtgagtatagaaatccagttttt

SEQ ID NO: 2522 - DNA, 240 bp, Homo sapiens
  CDS 86..238
  misc_feature 112: s=g or c
  misc_feature 114: w=a or t
  misc_feature 117: m=a or c
  misc_feature 118: s=g or c
  misc_feature 123: w=a or t
  misc_feature 146: h=a or c or t
  misc_feature 148: w=a or t
  UNSURE 9: Xaa=Asp or Glu
  UNSURE 10: Xaa=Lys or Met
  UNSURE 11: Xaa=Lys or Asn or Thr
  UNSURE 13: Xaa= *  or Leu
  UNSURE 21: Xaa= *  or His or Lys or Asn or Gln or Tyr
ctgtatttgttgttgtcctttatccctcgcccccccctccactcttcccccaagttcccaaagtccactgtatcattttttttcaatgctacttaatgctttttatttagasawgamsgtgtwggctttcttttttttttattathawactttaagttctgggatacacgtgaagaacatgcaggtttattacataggtatacactgccatggtggtttgctgcacccatcaacctgtca

SEQ ID NO: 2523 - DNA, 276 bp, Homo sapiens
  CDS 5..274
ctgaatggagaagagcagcaaatgtgagtgcaataaacgttttcaaatgatctttttctgcttgaattatgtttcactaaaatatatgagtctcaattccttgagtctgtcaaaaaacatctgcagcttagagaaaagttatggaataatgttgttttccactcagcccatttactttgaagccttatcagaggagggatcaaatgaaactgatcatccccaggtttccccaggttattaccatgtggacatggaattaacctccttccagcacct

SEQ ID NO: 2524 - DNA, 410 bp, Homo sapiens
  CDS 79..408
  misc_feature 132: b=c or g or t
  misc_feature 374: n=a, g, c or t
  UNSURE 99: Xaa=Cys or Phe or Ser or Tyr
ctcttggagctgagctataagacaacaggactgaacagggagccaactgtttctttgaacagtaaatcaggaacaccaatggaccaaaatgaacacagtcactggggaccacatgcaaagggccaatgtgcbagcagatctgagctgagaatcatcctggtgggcaaaacaggaactggcaaaagtgctgcagggaacagcatcctcaggaagcaagcatttgaatcgaagctgggttcccagaccttgactaagatttgcagcaaaagtcagggaagctggggaaatagagagattgtcattattgacacaccagatatgttttcttggaaggaccactgtgaagctctgtacaaagaggtgcagaggtgctncttgctgtctgcaccaggaccccatgtgctgctcct

SEQ ID NO: 2525 - DNA, 222 bp, Homo sapiens
  CDS 13..222
  misc_feature 142: m=a or c
  misc_feature 153: m=a or c
  misc_feature 163: m=a or c
  misc_feature 169: m=a or c
  misc_feature 189: m=a or c
  UNSURE 44: Xaa=His or Asn
  UNSURE 47: Xaa=Asp or Glu
  UNSURE 51: Xaa=His or Asn
  UNSURE 53: Xaa=His or Asn
caatggaatggaatggaatggaatggaatggaatggaatggaatggaatggaatgcaatggaatggaatcttccggaatggaatggaatggaatggaatggaatggaatgcaatggattcaactcgattgcaatggaatggmatagaatggamatggaatggmatggamatggagtggagttaaaccgmatagaatggaatggaatggaatggaaaggaaca

SEQ ID NO: 2526 - DNA, 350 bp, Homo sapiens
  CDS 53..349
  misc_feature 130: k=g or t
  misc_feature 131: d=a or g or t
  misc_feature 132: w=a or t
  misc_feature 163: r=a or g
  misc_feature 239: n=a, g, c or t
  misc_feature 268: n=a, g, c or t
  misc_feature 269: n=a, g, c or t
  misc_feature 285: r=a or g
  misc_feature 286: b=c or g or t
  misc_feature 291: d=a or g or t
  UNSURE 26: Xaa=Arg or Ser
  UNSURE 27: Xaa= *  or Glu or Lys or Leu or Met or Val
  UNSURE 63: Xaa= *  or Glu or Lys or Gln
  UNSURE 72: Xaa=Phe or Leu
  UNSURE 73: Xaa= *  or Glu or Lys or Gln
  UNSURE 78: Xaa= *  or Cys or Trp or Tyr
  UNSURE 80: Xaa=Ile or Asn or Ser
gctctcgtagttagagaggcccggatggaggacgcagaggcacgctgttgccatggcagtgtggtcctggctgccgcggaggcaggtgccggggtctcctttgcctcaatgtgaagagcttagaaagagkdwggagaggagaactcccccggccatctctgtratcccagccgccgcattttacacagcatatttccttcacaaacagaaaatgaatgaaaataaagatactgattcanagaaaagtgaagaatacgaagatgacttnnaaaaggacctggagtrbttaadtaatgaaaatgaaaaaagtgatgccagcataatagagatggcttgtgagaaggaaggtt

SEQ ID NO: 2527 - DNA, 326 bp, Homo sapiens
  CDS 155..325
  misc_feature 120: w=a or t
  misc_feature 310: m=a or c
  UNSURE 52: Xaa=His or Gln
cagcttccattgtggtgtataaatagaatatgaaaagtttgttcgtttgttatttaaatttaaaggtacatcgtaagctctagtctttgtgattcttaaaaacaaatgtattatgttaawtttcaaaatacaaaaaatctgagtgactatcttcatgaaccctcatgtccatcacccagtttcaataattaagaacacattgtcaagtctgcattatctcttacactcctactttcctcctcccctggattattttaaggcaaatcaaagaccacatctctcttctgaaaaccctttcagtacttcccamttcctctgccccaccc

SEQ ID NO: 2528 - DNA, 202 bp, Homo sapiens
  CDS 30..200
  misc_feature 119: m=a or c
  misc_feature 139: r=a or g
  misc_feature 141: m=a or c
  misc_feature 150: r=a or g
  UNSURE 30: Xaa=Asp or Glu
  UNSURE 37: Xaa=Glu or Gly
  UNSURE 38: Xaa=Pro or Thr
  UNSURE 41: Xaa=Glu or Lys
aatcgaagagaatcatcgaatggacccgaatggaatcatctaatggaatggaatggaataatccatggactcgaatgcaatcatcatcgaatggaatcgaatggaatcatcgaatggamtcgaatggaataatcattgramcagaatccraatggaatcatcatcggatggaaaatgaaaggagtcatcatctaatggaatt

SEQ ID NO: 2529 - DNA, 291 bp, Homo sapiens
  CDS 97..291
  misc_feature 142: r=a or g
  misc_feature 150: r=a or g
  UNSURE 16: Xaa=Glu or Lys
aagttttgtattaggttgttttcacactgctataaagaaatgcctgagactgggtaatatataaaagaaagaggtttaatttactcacagttctgcatggctgaggaggcctctggaaacttgcaatcatggcggaaagtgraggggaargcagacaccttctttacaaggcaccaggagagagagaaagaccaggagaaactgccatttataaaactatcagatctcatgagaatttactcactatcacaagaacagcataggggaaaccgctcccatgatccagccaca

SEQ ID NO: 2530 - DNA, 249 bp, Homo sapiens
  CDS 81..248
  misc_feature 40: s=g or c
  misc_feature 41: s=g or c
  misc_feature 152: v=a or c or g
tggaccgacgggcgcacccaggtaggggggcggctgagcssgcagtgcggaccctcgcggggaactgcgccgccgccaccatgtctcaggaaggtgtggagctggagaagagcgtccggcgcctccgggagaagtttcatgggaaggtatcvtccaagaaggcgggggctctgatgaggaaattcggcagcgaccacaccggagtggggcgctccatcgtgtacggggtaaagcaaaaagatggccacc

SEQ ID NO: 2531 - DNA, 238 bp, Homo sapiens
  CDS 62..238
  misc_feature 109: d=a or g or t
  misc_feature 186: r=a or g
  UNSURE 42: Xaa= *  or Trp
atcagatttggagttggaatggagtaaccaaggacagccttgtctctttggatggctgaggatgggcatgaggaaagtacagtcccgtggttatccagaatacaccccdgttgatgtcgccagggtcagtgagccccatacaggtcaaagaggagcagacatgggggccagtagcacccctcagtrgcccagccccgctcctcgccttggatggacacatacaaacccgctccccact

SEQ ID NO: 2532 - DNA, 197 bp, Homo sapiens
  CDS 16..195
  misc_feature 134: b=c or g or t
  UNSURE 40: Xaa= *  or Leu or Ser
aaaacatgggccaccatgttcagctatttatttatttgtttgtttatttattttgagatggaagcacgctctattgccaggctggagtgcagcggcgctcttggctcactgcaaccctcccgccttccaggttbaaacgattcttcagcctcggcctccagagtagctggaaatataggtgcccaccaccacgccca

SEQ ID NO: 2533 - DNA, 267 bp, Homo sapiens
  CDS 18..266
  misc_feature 134: r=a or g
  misc_feature 241: s=g or c
  UNSURE 75: Xaa=Ala or Gly
agccacaccagcagaggatgacgaggatgatgacattgacctccttggcttgcctggtgggggaaggggaggaggggaagaaggaaagggaagagtcttccaaggccagaaggaaggggggacaaccccccaaraaaccatccctgaagacgagcatccccctcctctccctgttagaaatgttagtgccccgcactgtgccccaagttctaggccccccagaaagctgtcagagccaggstctccgggcctttctctggcttcctt

SEQ ID NO: 2534 - DNA, 265 bp, Homo sapiens
  CDS 73..264
ctagaatataagttaacttgaatactaggctgtctctcccagctttttttattttcttttttcttttttgagatggggtctcactctgtcacccaggctgacatgcagttgcatgatctcggctcactgcaacctctgcttcccaggttcaagcaattctcacgcctcagcctcccaagaagctgggatataggcgtgcatcaccacacctggctaatttttgtatttttagtagaaatggggtttcaccacattgccccggcta

SEQ ID NO: 2535 - DNA, 201 bp, Homo sapiens
  CDS 22..201
  misc_feature 131: r=a or g
  UNSURE 37: Xaa=Lys or Arg
attggaatcaacgcgagtggaatggaatggaaaggactggaatggagtggaatggaatggaatggaatggaatggaatcaactcgattggaatggaatggaatggaatggaatggaaattaaaccgaataraatggaatggaatggaatggaacggaacggaaatggaatggaatggaatggaatggaatggaatggaaaa

SEQ ID NO: 2536 - DNA, 305 bp, Homo sapiens
  CDS 70..303
ctacctccgcctcccaggttcaagagattctcctgcctcagcctcctgagtagctaggatttcaggcgaatgccaccatgcccagctaagctttttaattttaaaatacttgattcttttgtaataacctttagtttaaaacacaaacagggcccatcgtggtggctcacacctgtaatcccagcactttggaaggctgaggcgggtggatcacctgaggtcaagagttcgagaccagcctggccaacatggcgaaatcccatctctactaaaaatacaaaaattaggcatggtggcatgcgcct

SEQ ID NO: 2537 - DNA, 189 bp, Homo sapiens
  CDS 8..187
  misc_feature 129: w=a or t
  UNSURE 41: Xaa=Lys or Met
caatggaatggaatggaatggaacagaatggagtggaatggaatggaatcaacccgagtgcaggggaatggaatggaatggaatgcaatgtaatggaatcatccggaatggaatgggatggaatggaawggaatggaatggaatggaatggaatggaatcaacgcgagtgcaggggaatggaatggaaa

SEQ ID NO: 2538 - DNA, 302 bp, Homo sapiens
  CDS 119..301
acttggtcatgtgcgtagtgatttttaaatgttgttggacttagtttgccagtattttgtttaggctttttgtatctatattcataaagattattgacctgtggttttcttttgtgtgatgtttttgtctagttttttttttattattttattttattattattacactttaagttttagggtacatgtgcacaatgtgcaggttagttacatatgtatacagtgccatgctggtgtgctgcacccattacctcgtcatttagcattaggtatatctcctaatgctatccctccccccacaa

SEQ ID NO: 2539 - DNA, 273 bp, Homo sapiens
  CDS 51..272
cttttgattataatagaaatataaatggcctggagaaagttaaggaacagatgccaaacctcagtatatccactagtgacaacttctttttttgctgtgtcgcccagattggagtgcagtggtgcgatctcagctcactgcagcctccacctcttgggttcaagcgattgtcttgcctcggtctcctaagtagctgggattgcaggtctgcaccaccacgcccagctaatttttgtatttttagtagacttactaaaaatgtcttgccccaat

SEQ ID NO: 2540 - DNA, 441 bp, Homo sapiens
  CDS 277..441
  misc_feature 300: n=a, g, c or t
  misc_feature 301: h=a or c or t
  misc_feature 302: s=g or c
  misc_feature 344: n=a, g, c or t
  misc_feature 345: n=a, g, c or t
  UNSURE 9: Xaa= *  or Pro or Arg or Ser or Thr
  UNSURE 23: Xaa=Ala or Asp or Glu or Gly or Val
gcgtatgtgttgaggttggtgagggtagcccagaatttgctggtagagagggaacttggccatggggctgcctttgccaagctcttccttgtggtttgataagaaaaactctggtgggtaatagcatctgtctcttgggggtgaagtgagaatgacagaatctaatttctcccatctgttaaaggaggccacaagacttcagtactccaatgatctaagcagctgtccctgacctttttcttttttgagcccaggttggagtacagtgacgcgatcatggctctctgcagcctcgacctnhsaggctcaggtgatgctctcaccttagcctcccaaagtactgnntttacagacgtgagctactgcgcccggccccaaatagatttttcaaatgaggaatatctgtccatattctgggactctgtgccccacatttttact

SEQ ID NO: 2541 - DNA, 185 bp, Homo sapiens
  CDS 25..183
  misc_feature 15: d=a or g or t
tggaatcgaaaggadtagaatggaatggatcgttatggaaagacatcgaatggaatggaattgactcgaatggaatggactggaatggaacggactcgaatggaatggactggaatggaatggattgaacggaatggactggagaggaatggactcgaatggaaaggaaacgagtggaatggaat

SEQ ID NO: 2542 - DNA, 289 bp, Homo sapiens
  CDS 76..288
  misc_feature 145: k=g or t
  misc_feature 164: y=c or t
  misc_feature 182: y=c or t
  misc_feature 188: w=a or t
  misc_feature 216: k=g or t
  misc_feature 221: k=g or t
  misc_feature 268: s=g or c
  UNSURE 24: Xaa= *  or Glu
  UNSURE 30: Xaa=Phe or Ser
  UNSURE 36: Xaa=Ala or Val
  UNSURE 38: Xaa=Leu or Gln
  UNSURE 49: Xaa=Leu or Arg
  UNSURE 65: Xaa=Asp or His
ttataatctataagatgcaatctataattattaatctgtctcaattttaaaaagattattttgaaacaatttcgaatgtatagagaagttgcaagactactacaaaagactcctgcatgcctttctttcttttcttttttttttkaatttataatttttttttycttttatagagatggggycttgcwatgtttaccaggctggcctcgaactcckggtckcaagcattcctcccatctcagcctcccaaagtgctgggattacaggsatgagccaccatacccgacaa

SEQ ID NO: 2543 - DNA, 242 bp, Homo sapiens
  CDS 19..240
caacccgagtacaatggaatggaatggaatgcaatggaatggaatcttccggaatggaatggaatggaatggaatggaatggaatgcaatggattcaactgtattgcaatggaatggaatagaatggaatggaatggaatggaatggaatggaatggaattaaaccgaatagaatgcaatggaatggaatggaacggaaaagaacggaacggaacggaacgttgtggaatggaatgggaggc

SEQ ID NO: 2544 - DNA, 214 bp, Homo sapiens
  CDS 51..212
  misc_feature 134: y=c or t
aattcacatagaccacagagccatagttgtttgtttgcattgaaaaattaatggacagatttggatttttttttaaatttcagattgactttttcctctctccctactactcctgtaaattatttattaaaatyctcaacaatatgctaattgtcatatataagagaaatactcagcacacagcacacttttttttcaattttttcattttttt

SEQ ID NO: 2545 - DNA, 185 bp, Homo sapiens
  CDS 25..183
tggaatcgaaaggaatagaatggaatggatcgttatggaaagacatcgaatggaatggaattgactcgaatggaatggactggaatggaacggactcgaatggaatggactggaatggaatggattgaacggaatggactggagaggaatggactcgaatggaaaggaaacgagtggaatggaat

SEQ ID NO: 2546 - DNA, 228 bp, Homo sapiens
  CDS 44..226
  misc_feature 71: m=a or c
  misc_feature 91: w=a or t
  misc_feature 120: h=a or c or t
  misc_feature 126: m=a or c
  misc_feature 127: w=a or t
  misc_feature 133: m=a or c
  misc_feature 134: m=a or c
  misc_feature 136: w=a or t
  misc_feature 140: m=a or c
  misc_feature 143: w=a or t
  misc_feature 144: k=g or t
  misc_feature 179: m=a or c
  misc_feature 180: m=a or c
  misc_feature 192: w=a or t
  misc_feature 206: w=a or t
  UNSURE 10: Xaa=Ile or Leu
  UNSURE 26: Xaa=Ala or Glu or Val
  UNSURE 28: Xaa= *  or Ser or Tyr
  UNSURE 30: Xaa=Phe or Leu
  UNSURE 31: Xaa=Ile or Leu
  UNSURE 33: Xaa=Lys or Gln
  UNSURE 34: Xaa=Cys or Phe or Ile or Ser
  UNSURE 46: Xaa=Lys or Pro or Gln or Thr
  UNSURE 50: Xaa=Glu or Val
  UNSURE 55: Xaa= *  or Lys
ataaaatcactatgaatgtggcgtttcagagtttcccaccaacatgctagtccactgtcacccttcagcamtttgccaagatgtccattcwattctccctaccagtttatggattccaghattttmwgctttmmtwaggmaawkctcagatctgtatctatcaaatgtgtcactgtctmmagattttgaggwagcacttgccctgwaacctcagttctctgttgagcc

SEQ ID NO: 2547 - DNA, 197 bp, Homo sapiens; identical to SEQ ID NO: 2494
  CDS 36..197

SEQ ID NO: 2548 - DNA, 256 bp, Homo sapiens
  CDS 87..254
  misc_feature 121: w=a or t
  misc_feature 151: m=a or c
  misc_feature 155: y=c or t
  misc_feature 157: b=c or g or t
  misc_feature 158: n=a, g, c or t
  misc_feature 241: w=a or t
  UNSURE 12: Xaa=Phe or Tyr
  UNSURE 22: Xaa=Ala or Glu
  UNSURE 24: Xaa=Leu or Pro or Arg
  UNSURE 52: Xaa=Leu or Gln
gtggcactcagtcctacggcctccgaggctgggtagtgagtgtgtcgctggccttagccagactccacaggccacgctggctgcgaatggagccgaggactcgcgcggaggcgagatgctwccaggccggcgagatcggcgcctctcctgmagcycbntgctgctctgaaagtggtgacgaaaggaagaacctcgaggagaaaagtgacataaatgttacagttcttattggaagtaaacwagtcagtgaaggtac

SEQ ID NO: 2549 - DNA, 276 bp, Homo sapiens
  CDS 28..276
gacggcggcagtgcgagaaagccgaagatggcggtccccgcggcgctgatcctacgggagagccccagcatgaagaaagcagtgtcactgataaatgcaatagatacaggaagatttccacggttgctcactcggattcttcaaaaacttcacctgaaggctgagagcagtttcagtgaagaagaggaagaaaaacttcaagcggcattttctctagagaaacaagatcttcacctagttcttgaaacaatatcatttattttagaacaggcagtg

SEQ ID NO: 2550 - DNA, 403 bp, Homo sapiens
  CDS 173..403
taagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaa

SEQ ID NO: 2551 - DNA, 210 bp, Homo sapiens
  CDS 22..210
attgtgtcagaggaagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctc

SEQ ID NO: 2552 - DNA, 282 bp, Homo sapiens
  CDS 72..281
gctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcggg

SEQ ID NO: 2553 - DNA, 356 bp, Homo sapiens
  CDS 191..355
aaaaactcaggccccactgctggaacaccatttctactattgcatatcctgtgtgcctaaaaagcaacagtgaccctggctgatgatcaagaagcccctctttttacccagggagttggacaattgttaacatcccagaagacatatttttaacccagttgctgggaagaacatgtgctgaagtataaggatggaatcactacacggagatgacttgattgtgactccatttgctcaggtcttggccagtctgcgaactgtacgaaacaactttgctgcattaactaatttgcaagatcgagcacctagcaaaagatcacccatgtgcaccaaccatccatcaacaaagccacgcc

SEQ ID NO: 2554 - DNA, 420 bp, Homo sapiens
  CDS 257..418
  misc_feature 71: s=g or c
  misc_feature 72: s=g or c
  misc_feature 115: r=a or g
  misc_feature 116: w=a or t
  misc_feature 119: s=g or c
  misc_feature 194: y=c or t
  misc_feature 195: n=a, g, c or t
  misc_feature 360: r=a or g
  UNSURE 35: Xaa=Asp or Gly
acaccgacgctcacgtagtcgcgcttgccacaaccctgcgggctctccgatgcggcgagcgagctggggassgggcttctccgcggcccaaaagcctgttcatctagccccatgrwtgsctgttggacatcgagtacagatacaactgcatggctccttccttgcgccaagagaggtttgcctttagatctcaynaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgrtgacccgctagatatgccattcaacatcaccgagctcctagacaacattgtgagcttgac

SEQ ID NO: 2555 - DNA, 229 bp, Homo sapiens
  CDS 29..229
  misc_feature 110: r=a or g
  misc_feature 113: r=a or g
  misc_feature 116: w=a or t
  misc_feature 122: r=a or g
  UNSURE 28: Xaa=Glu or Lys
  UNSURE 29: Xaa=Ala or Thr
  UNSURE 30: Xaa= *  or Lys
  UNSURE 32: Xaa=Gly or Ser
tgccatgaggtcttgattgtctgcatttatgaatgaaactgacctaaatcacctgttacctccagtttccagattgtttgaacttctctggccgcacaatacaggaaggragrctwaaagcrgcaaagggacctacagcgtctgcagcatgggctggttaactaggattgtctgtcttttctgggagtattacttacagcaagagcaaactatcagaatgggaagaact

SEQ ID NO: 2556 - DNA, 187 bp, Homo sapiens
  CDS 4..186
acaatggctcattcacaccacaggcagtggaagctaactgtcagcgggagcccagctggggctgtcaaccacccctccccttgcgaacatgtggcttctccagacttcttacatatggctggcttcctccagagcaagcatcctgagagagccaggcagaagcttcccagcctcacaagtcccaggc

SEQ ID NO: 2557 - DNA, 298 bp, Homo sapiens
  CDS 137..298
  misc_feature 157: b=c or g or t
  misc_feature 158: d=a or g or t
  UNSURE 7: Xaa=His or Gln
  UNSURE 8: Xaa=Leu or Met or Val
cttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcabdtggccaaggagcctgtgcagaatgagatcagtgccacatacatcaggcgagccttgggccaagggcagagcgtaaagtacctgattcccgatgctgtcatcacgtacatcaaggaccatggcctctacaccaagggcaga

SEQ ID NO: 2558 - DNA, 341 bp, Homo sapiens
  CDS 133..339
  misc_feature 254: m=a or c
  misc_feature 255: w=a or t
  UNSURE 41: Xaa=Lys or Asn or Thr
gtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgamwcagcatatagattcatttaactatttcattaatgtagagataaagaagataatgaaagccaatgaaaaggttacaagtgacgctgc

SEQ ID NO: 2559 - DNA, 335 bp, Homo sapiens
  CDS 176..334
  misc_feature 119: m=a or c
tgatcatctgttttctcggggtggcagacgcagccatgtcttggtatcaccacccatgtgacagctactcctggacaactgggacaaatgtcagggccagagccatgaaggtgtggtamccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcactccatattttccccaccactctacaccgaaagc

SEQ ID NO: 2560 - DNA, 422 bp, Homo sapiens
  CDS 253..420
  misc_feature 166: k=g or t
  misc_feature 194: b=c or g or t
  misc_feature 335: n=a, g, c or t
  UNSURE 28: Xaa= *  or Leu or Ser or Trp
taatctatttatttaataagtttagcataagaaacttaggcaaagcagtttcttgatatttgagttttgtatctggcttacttaaatccttgtgagttatgaagttccttaggatagataattcaaattaggtttaagtagtcttgggggaggggactacggagtkaaactacttaaattttctaagtataaabtttaaatcaatagcaaaacaggattaagataaatgtgggcataattaggtgtattgacatgcctttgatgtatcaaactgagggggaaccactaaatccagtcaagcagtttcataagatcttcacaaaatgcctctactngcggaatcatgttgattttagtcctgctgatgtgtgtaccgttagcactttggtttatcaatatttgactggctcaaatgatggata

SEQ ID NO: 2561 - DNA, 314 bp, Homo sapiens
  CDS 157..312
gtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagct

SEQ ID NO: 2562 - DNA, 251 bp, Homo sapiens
  CDS 67..249
atcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgccccaa

SEQ ID NO: 2563 - DNA, 263 bp, Homo sapiens
  CDS 26..262
cgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaagtcttcctgcagtcatcaccacacc

SEQ ID NO: 2564 - DNA, 278 bp, Homo sapiens
  CDS 83..277
tcaatgaactagagaccgctgtagggaggttgtgggaactgttcagaacggcttaatctgggaggacacgacttccactagaatgcatgcgctgaacgacaattcgttttcacctcaaaaacctgtactgcagttttgtctctccttccgtacgatgacccaagatggcggacccgtgattgaaaacccagattcaagatggcgacttcctgcttccccgatagcgtcgcgcgtggccaccgaggccacgcctacttccggctaccccggctactccg

SEQ ID NO: 2565 - DNA, 359 bp, Homo sapiens
  CDS 189..359
  misc_feature 88: w=a or t
  misc_feature 332: m=a or c
  misc_feature 335: s=g or c
  UNSURE 48: Xaa=His or Gln
gcacaaagctctagaaaactatgaaagtgccttcagcataaacaaatccagaaatctcccaggacaaatcatttgccaactgaaagawaggcctggggtttatggtttcccttggagctagaggtagaaactctccggggggataagtcagaccaggcaccagtggatgtcaccgcagcaaaacaaggatggacgaggagtcactagatgggctgctcttcaaagaccacgacttctcttctgacttgttgaggcagctcaacagcttaaggcaaagcaggatcctgactgatgtgagcatctgtgccggtgcccgggagatcccctgccamcgsaacgtgctggcctccagcagcccc

SEQ ID NO: 2566 - DNA, 368 bp, Homo sapiens
  CDS 191..367
aaaaaattgctgcagccgggtcttgtcaggtggctgctggtggctccccaccggattttccttctccctctctctatctccacagatcccttcccaagaggagtctcctgctaaaacttcatcatctcaagttgacctgccacttcacccaaggaggcaagctcttgcctgtgacagtgtatttgccaacatggcacccaaaaagaagattgtcaaaaagaacaaaggagatatcaatgagatgactataatcgtagaagatagccccctaaacaaactgaatgctttgaatgggctcctagagggaggcaatggccttagctgcatttcttctgaactacagatgcttcttatggccccaacctctt

SEQ ID NO: 2567 - DNA, 186 bp, Homo sapiens
  CDS 12..185
taagtgaaaacatgcaatatttgattttctgttcctgtgctaatttgcttaggataatggcctccaggggcatccatgtttctgcaaagggcctgatttcattcttttttatggctgtgaagtattccatggtgtatatgtaccacatattctttatccaatccagcatcagtgagcacccacggg

SEQ ID NO: 2568 - DNA, 177 bp, Homo sapiens
  CDS 5..175
taagatgaggtggcagaatgaggttgtggccaaatcaagcagagtttggcttttattaagatcagtctggttgctagaattggaggtgggtaaaagagtagatgctgacagtcatcaggtgagagaggatggtgttatagattatggcagtagcagtggagatagaaagaggtgtcg

SEQ ID NO: 2569 - DNA, 187 bp, Homo sapiens
  CDS 19..186
aatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccaa

SEQ ID NO: 2570 - DNA, 219 bp, Homo sapiens
  CDS 50..217
cagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcccg

SEQ ID NO: 2571 - DNA, 174 bp, Homo sapiens
  CDS 16..174
atatttttagtagaaatggggtttcaccgtgttgggcaggctggtctcgactcaggtggtctgcccacctcagcctcccaaagtgttgggattacaggtgtgagccactgcaggcagccatttttttttaaccactttactgtccttttttccccagaatatatatgcctgact

SEQ ID NO: 2572 - DNA, 246 bp, Homo sapiens
  CDS 9..245
gcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggagca

SEQ ID NO: 2573 - DNA, 306 bp, Homo sapiens
  CDS 69..305
  misc_feature 241: r=a or g
  UNSURE 58: Xaa=Lys or Arg
aaaagatttctgctgtcacagagcttagaactgtgtgtgtttattaatgtttctctcccctagactatatgcctgttactggtattcattctgtacagccctcattctccaagcctaattgcactattattacgctaccacggaacaaaaattttcaaggactatacagcccaaaattttgttcgagtgagcatttgttaattcatatataccacacgaaattttcttctttaaaaaagaraaaaaaaaggcctgtggcgtggctcccgtctgtaatcccagcactttcggaggccaagttaggca

SEQ ID NO: 2574 - DNA, 166 bp, Homo sapiens
  CDS 3..164
ttatgtctactgggaaatggaggcatcaattaagtgacaggtccattagtagtcactatatcacctcttgctttaaaataatacctcgttgcttggagacaagggttggttacaagcagcttgaaatgttactttgtgtcgtatccaaagaaccacaccccacact

SEQ ID NO: 2575 - DNA, 172 bp, Homo sapiens
  CDS 16..171
cttcataacaagaaaatgagcctgagaaagtgtggttacactttgctgacagctccacgtgctgttgccagagtgagctccagaaccaaagtggcagtgggcccatccacctgccttgagtgtaagtcacatatgatgctatccacagttcaatctaacacaccctgcaacc

SEQ ID NO: 2576 - DNA, 337 bp, Homo sapiens
  CDS 28..336
  misc_feature 318: s=g or c
agctgtggacagcttcccggacacaggatggaaggaccacgggctgcctgtctcttgaaagaggctcgagaaagacaggcaagagaaccccaagggagcggggaaaggaacgggagggctttggggctgtggcttgagtgtgaacagattgtctccccttgtctgtctgtctcccctggtggggaccccaaccgcaacaatgcacccggaaatccggcagtccaaggcagaaacggcaggccagcgaagtgtgtgcttgtccctattttggttgtgatggtttgggggggatatgagacagccacagcgcgggaggcstggacagacggacatgccg

SEQ ID NO: 2577 - DNA, 260 bp, Homo sapiens
  CDS 68..259
catcgtttctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatccat

SEQ ID NO: 2578 - DNA, 336 bp, Homo sapiens
  CDS 49..336
  misc_feature 2: r=a or g
  misc_feature 258: m=a or c
  misc_feature 263: r=a or g
  misc_feature 271: m=a or c
  UNSURE 72: Xaa=Glu or Gly
  UNSURE 75: Xaa=Leu or Met
artagcgggccgtcggttgggcgcagacaggccgcagaagatggagagatggagccaccccaagagacaaataggcctttcagcacacttgataaccgcagcgggcaggtccaagtcctgtccgccaccccgctattgcagaggaatccctacagcagcccggatatcatgcacattaaagggtcggaggcttcttcggtcccttacgccctgaaccagggcacgacggccctgcctaagaacaagaaccaggagggmaccgrgcaccggmtgctgaacatgctgagaaaaactcttaaagagtctgatagtgaagaactggaaataacacaggag

SEQ ID NO: 2579 - DNA, 264 bp, Homo sapiens
  CDS 4..264
gaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccca

SEQ ID NO: 2580 - DNA, 318 bp, Homo sapiens
  CDS 121..318
atacagtagtaccagtgaagactactaaccagattataggtttagactggcaagactttggactgacccaagaccgaatctgttttattgtaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtgtcagcagttgagtctttggtgggcccc

SEQ ID NO: 2581 - DNA, 245 bp, Homo sapiens
  CDS 91..243
tattatccattacataacatacatgcttgattatttgcttcaaggaaatacacctttataagtaatactcaataactactgggtttgagaatgaaggtgtcagaacgaatgagattgtcctatgaaagaagaggcaggagccagggaggaggatcccacctggccggggctcagccaggaggcagggccattggggcagggtggcagtccaaggaaccgctctgggaaggtttgcaaaggtcgga

SEQ ID NO: 2582 - DNA, 288 bp, Homo sapiens
  CDS 32..286
ctaaaaaagcagatgcagcccttctgactaaatgggaaaaactgctgaacgtaggcactgtatagacaggtatgccatcaactaccaattccgcatttttatcggtttaggtttttttaacgaaggttggaaaaaagctgggaacagcagacaccaagccagaacagtctgtgtgggttcgtgttgctttgttatcagctgctcttcaccatggaggcttacgtggtcacagccctggtgctgtgttcagccaggcctggcacccactgagcacacaaacagtcactc

SEQ ID NO: 2583 - DNA, 362 bp, Homo sapiens
  CDS 79..360
  misc_feature 19: s=g or c
  misc_feature 22: n=a, g, c or t
agatcgcgggcgagcggasgcnaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagcccacg

SEQ ID NO: 2584 - DNA, 252 bp, Homo sapiens
  CDS 49..252
  misc_feature 163: r=a or g
  misc_feature 179: r=a or g
  misc_feature 184: w=a or t
  misc_feature 197: r=a or g
  misc_feature 200: m=a or c
  misc_feature 210: r=a or g
  misc_feature 214: w=a or t
  misc_feature 218: m=a or c
  UNSURE 39: Xaa=Gly or Arg
  UNSURE 44: Xaa=Lys or Arg
  UNSURE 46: Xaa=Phe or Ile
  UNSURE 50: Xaa=Lys or Arg
  UNSURE 51: Xaa=Asn or Thr
  UNSURE 56: Xaa=Phe or Ile
  UNSURE 57: Xaa=Lys or Thr
tggaagaacattccatgttcatgggtaggaagaatcaatatcgtgaaaatggccatactgcccaaggtaatttacagattcaatgccatccccatcaagctaccaatgtctttcttcacagaattggaaaaaactactttaaagttcatatggaaccaaaaargagcccgcattgccargtcawtcctaagccaaargamcaaagctggrggcwtcamactacctgacttcaaactatactacaaggctcca

SEQ ID NO: 2585 - DNA, 313 bp, Homo sapiens
  CDS 65..313
  misc_feature 243: r=a or g
  misc_feature 244: s=g or c
  UNSURE 60: Xaa=His or Gln or Arg
cattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccrsccgcccgccctgctgcagatacatgcggcacagcaggcacgtgcctggagagaacagctcctgagcaca

SEQ ID NO: 2586 - DNA, 357 bp, Homo sapiens
  CDS 126..356
cgttcttagggaaaaaagaaggaacagggacaagctcctggcggttggctgtggcagacacttcaccaggggctgactcgcgggggctgagtgtacaggccccaggtggtggttgatgagaggtgatgagtgtgccagccaccttgcaggggtctttcctggcgagctggcaggagcagggaggagcacgttgctcctgctgctggtggggcagtaacgtgttcaacctgacagcgacgtttttgctgaaaccgaagccaagggtggtgtggttggccgtcagggatacagggccccgcgtgggaatggtgctttcagtgaggctggcaggattcttgcggctcaggtgggagcacc

SEQ ID NO: 2587 - DNA, 334 bp, Homo sapiens
  CDS 161..334
  misc_feature 275: k=g or t
  misc_feature 292: k=g or t
  misc_feature 297: n=a, g, c or t
  misc_feature 301: k=g or t
  misc_feature 327: k=g or t
  UNSURE 39: Xaa=Ala or Ser
  UNSURE 44: Xaa=Asp or Glu
  UNSURE 46: Xaa=Lys or Met or Arg or Thr
  UNSURE 47: Xaa=Lys or Asn
  UNSURE 56: Xaa=Ile or Ser
gttaggaggatggaagatggggaatggcggggaggctctgcctcactcttgcgagtaggatggaagacttgttctctgtctgagacttcagctacgggacggacgagtacgacggagaggggaatgaggagcagaaggggcccccgaaggctcagagaccatgccgtacatcgatgagtcgcccaccatgtccccgcagctcagcgcccgcagccagggcgggggggatggcgtctccccgactccacctgagggactggctcctggggtggaakcagggaaaggcctggakatgangaakctggttctctcggggttcttggccakcgaagac

SEQ ID NO: 2588 - DNA, 246 bp, Homo sapiens
  CDS 51..245
  misc_feature 137: r=a or g
  misc_feature 138: r=a or g
  UNSURE 30: Xaa=Ala or Thr
cagcttgaaacaacagattctcttatagctctgaaggtcagaactctgacatgggtcccactgggctaaaatcaaggtttggttttgttttgttttgttttgttttgtctgagatggagtctcgctcagttgcccarrctgcagtgcggtggcacaatctcggctcactgcaagctctgcctcccgggttcacgccattctcctgcctcaacctcctgagtagctgggactacagacacccgccac

SEQ ID NO: 2589 - DNA, 380 bp, Homo sapiens
  CDS 224..379
  misc_feature 5: s=g or c
  misc_feature 31: y=c or t
  misc_feature 32: d=a or g or t
  misc_feature 119: k=g or t
  misc_feature 120: d=a or g or t
  misc_feature 121: k=g or t
  misc_feature 144: k=g or t
  misc_feature 167: k=g or t
  misc_feature 168: y=c or t
  misc_feature 257: d=a or g or t
  misc_feature 258: r=a or g
  misc_feature 273: n=a, g, c or t
  misc_feature 274: n=a, g, c or t
  misc_feature 289: k=g or t
  misc_feature 290: k=g or t
  misc_feature 308: k=g or t
  misc_feature 369: k=g or t
  UNSURE 12: Xaa= *  or Glu or Gly or Lys or Arg or Trp
  UNSURE 17: Xaa=His or Leu or Pro or Gln or Arg
  UNSURE 23: Xaa=Gly or Trp
  UNSURE 29: Xaa=Ala or Ser
  UNSURE 49: Xaa=Gly or Val
ttgtstccctggttttgtgccctgcatcccydtggaaatttgtatgtcctcctttctcattctttgaggttgcagattacattctttctccctctgtagtgcccggtgtcaggccatgkdkgcagcaagtgagcaattaatgtkaaccatgggtaagtatggcccakytatctctctagcctgagcctggtcacaaagtattgacagaagcaacaaactcaagatgagagctctccagcagaaagctctttggagtdrggaagacaggaagcnnatgtgcatagaggtkkggatctctgcctcctgtkcagagcagtgtgagcacaatgacctatttttgttggtaagacaagtcgacttctacttggkgcagcataact

SEQ ID NO: 2590 - DNA, 289 bp, Homo sapiens
  CDS 108..287
ctgaaggagatggcccagtctatcttcatggcaggtatactgattggagggctcgtgcttggagacctgtctgacaggtgagacatgggggcacagcccatggaagcatgacccatagggacaacccttccctactctgctccacccgtgcacccccaaagaggcaaagagctgggggagggtgggatggctcttgctgtgtggccttgggcaaacctcactacctttctggaccacagccttctctccaccccaaagcccttacaactggaatcttccagccttcctt

SEQ ID NO: 2591 - DNA, 400 bp, Homo sapiens
  CDS 235..399
  misc_feature 148: s=g or c
  misc_feature 149: s=g or c
catgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatssttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatcctttactcagtgcatatgtgagggttgttgctggaagacaggaggtct

SEQ ID NO: 2592 - DNA, 299 bp, Homo sapiens
  CDS 105..299
  misc_feature 24: s=g or c
  misc_feature 41: k=g or t
  misc_feature 63: r=a or g
  misc_feature 69: k=g or t
  misc_feature 70: s=g or c
  misc_feature 124: k=g or t
  misc_feature 166: k=g or t
  UNSURE 7: Xaa=Gly or Val
  UNSURE 21: Xaa=Leu or Trp
aagagctacgcggcggcggcggasgcaggcctcgtgccgtkacggccatcacggcggccgcartggcgksctggagccctcctcagtgctgaagctgctgaaagatggcagaagaagtggtggkagtagccaaatttgattatgtggcccaacaagaacaagagtkggacatcaagaagaatgagagattatggcttctggatgattctaagtcctggtggcgagttcgaaattccatgaataaaacaggttttgtgccttctaactatgtggaaaggaaaaacagtgcccggaaagca

SEQ ID NO: 2593 - DNA, 354 bp, Homo sapiens
  CDS 124..354
  misc_feature 10: d=a or g or t
  misc_feature 11: h=a or c or t
  misc_feature 12: w=a or t
  misc_feature 33: d=a or g or t
  misc_feature 34: d=a or g or t
acttaagccdhwgtacatgctgcttgccaggcddaacttcccactttcctccagatcttggtgtcaatgtcatttcctccaggaaggcctccagggtgtctagctcgataacccctgttaaccatgcccatggtagcatgctccatttaccaggtccagaacatccacggagctttcaatgctctcgggggagcagacagactcacctccaaccctaaccagtgggaaggtggacccagccccgtccagacccagaccctgacggagaaggaagaaggcttgtcccggggcacagcagacgcacgcacgcagtggataccagctattaccattattgttgctctcatcacagcc

SEQ ID NO: 2594 - DNA, 422 bp, Homo sapiens
  CDS 23..421
  misc_feature 34: s=g or c
  misc_feature 38: r=a or g
  misc_feature 78: m=a or c
  misc_feature 175: k=g or t
  misc_feature 208: m=a or c
  misc_feature 209: s=g or c
  misc_feature 313: k=g or t
  misc_feature 393: k=g or t
  misc_feature 402: n=a, g, c or t
  UNSURE 4: Xaa=Asp or Glu
  UNSURE 6: Xaa=Glu or Lys
  UNSURE 19: Xaa=Asn or Thr
  UNSURE 63: Xaa=Asp or His
  UNSURE 124: Xaa=Leu or Arg
  UNSURE 127: Xaa=Cys or Phe or Ser or Tyr
gccaggcccggcgctcctcaagatggctgccgasagtragcccgaatccgaggtatttgagatcacggacttcaccamtgcctcggaatgggaaaggtttatttccaaagttgaagaagtcttgaatgactggaaactgattggaaactctttgggaaagccactcgaaaagggkatatttacttctggcacatgggaagagaaatcmsatgaaatttcctttgctgacttcaagttctcagtcactcatcattatcttgtacaagagtccactgataaagaaggaaaggatgagttattagaggatgttgtkccacaatctatgcaagatttgctgggtatgaataatgactttcctccaagagcacattgcctggtaagatggtatgggckacgtgagtncgtggtgattgcccctgctt

SEQ ID NO: 2595 - DNA, 377 bp, Homo sapiens
  CDS 49..375
  misc_feature 48: n=a, g, c or t
cagaaggagctaagtgttttggaagaggatattaagagagtggaaganatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaaaccagttggatgaatttcaggaatgcttgtccaagtttactcgatataattcagtacgacctct

SEQ ID NO: 2596 - DNA, 355 bp, Homo sapiens
  CDS 138..353
aagacaatacatattagatattttttaaacctggcttttatgtgggcctgccacctgactaatttagcctgttcttgacttcttttggaaaatgaattcatgatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagatc

SEQ ID NO: 2597 - DNA, 229 bp, Homo sapiens
  CDS 63..227
cttcctcttgctgccagtggtagcgctcgtctggcggagtggttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacaggc

SEQ ID NO: 2598 - DNA, 393 bp, Homo sapiens
  CDS 127..393
atttggtcccaagtatgactcagggttaggctgggtcctcaggctccgtgctgttggaaggaagtgggaggattccaggggagttctgggaccttttcaaactgaagagaggaggctggctgcatcatgggagaagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttcca

SEQ ID NO: 2599 - DNA, 236 bp, Homo sapiens
  CDS 13..234
aggggaagtgggatgcggaaaaatgagttcggattaaggagactaataccctactggaagacaggcatagtagacatctatcgggctggactgagaactcggtgggaactagaggatgtcagggagggggacccagattttagtaaagaaggttctaaatggcttctaagaagttgggtgcagattttcatgggactttcagttaccttgatgatgtcccatttaagacaggaatg

SEQ ID NO: 2600 - DNA, 309 bp, Homo sapiens
  CDS 128..307
gagcaaccactacagtccatgtggcttttcttcctagcacagagtcttgtacacagtacttaccaattggtgtacttagcatgaatggatgcacagatggacggatacagggataaatgcatagttgatgcatggatggaagggtacttggatggtggctgcatggatagatgattactatgtttctcctaatagcatgtctgtacatttcccaaagcctcaccagggtgtgaaatctcatgccccgggagaatgcttccaactgaaaaactcagttatccaacaccacatctctttctgcccagcacc

SEQ ID NO: 2601 - DNA, 297 bp, Homo sapiens
  CDS 76..297
aaagacatggttccggcaggaaacaggcaaggagagccttgacttgacggagtctggctatatcgccaggctggaatgcaatggcgcgatctctcctcactgcaacctccgcctcccgggttcaagcgattctcctgcctcagcacctcgagtagctgggactacaggcgcgcgccaccacgcccagatgagaaaactgaggcacagagaggtgaaataaggcccccagaatgctcttctccaagacttagaaaaatcaaatgctatccatccctcaagatacatccctccagcgcc

SEQ ID NO: 2602 - DNA, 170 bp, Homo sapiens
  CDS 5..169
  misc_feature 32: w=a or t
  UNSURE 10: Xaa= *  or Lys
agaaatgttgtgtttcgtctctgctaaaaacwaaacaaggtaccatctcatggcctcttggttcaaatccgttttcttgctccgcagggagagactgcccctggagtattctgcttttaataagcttcccaatcagctctcgagtgcaaagcgctctccctccctcgccc

SEQ ID NO: 2603 - DNA, 251 bp, Homo sapiens
  CDS 65..250
  misc_feature 7: n=a, g, c or t
  misc_feature 218: r=a or g
  UNSURE 52: Xaa=Gly or Arg
atatgangtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttrgatcggttaggagtcggctttatgtgggacgag

SEQ ID NO: 2604 - DNA, 442 bp, Homo sapiens
  CDS 126..440
  misc_feature 32: k=g or t
aaatgtggctgtcagagagggaagtgcacatkaatttgaagacagcattagaaagcgttccgcccacagtttctctgttctcaacggctcagttttaacaggataaattttaagttaagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagca

SEQ ID NO: 2605 - DNA, 228 bp, Homo sapiens
  CDS 40..228
  misc_feature 5: s=g or c
  misc_feature 7: n=a, g, c or t
  misc_feature 10: k=g or t
  misc_feature 12: k=g or t
  misc_feature 18: s=g or c
  misc_feature 20: r=a or g
  misc_feature 27: k=g or t
  misc_feature 44: y=c or t
  misc_feature 45: w=a or t
  misc_feature 111: r=a or g
  misc_feature 112: k=g or t
  misc_feature 137: w=a or t
  misc_feature 138: h=a or c or t
  UNSURE 2: Xaa=Phe or Leu or Ser
  UNSURE 25: Xaa=Ala or Ser
  UNSURE 33: Xaa= *  or Phe or Leu or Tyr
tacasangtktkaatttsaracagctkgagatcaaagagatgtywgccagggagctccgccccaccctaccccgcccctcggagctggtctgcctttgttcatcctggaarkcatctctttggatttgcaaatattwhaattcacagaaactcaaggagagggtgggggtgggggctggggtggtgtgttgccgcccttctgtctttatccaggccttctccagcccc

SEQ ID NO: 2606 - DNA, 432 bp, Homo sapiens
  CDS 192..431
  misc_feature 289: s=g or c
  misc_feature 360: s=g or c
  UNSURE 33: Xaa=Pro or Arg
  UNSURE 57: Xaa=Glu or Gln
atctccagccccgcaggtagggctgtctacactggctacagatccccgagggccgtcggtttgaaagctttgtgtgactccctttgctgtgcccaggactttgtgtggatcgacttttggcctcaatctctggatgcgtggcctgtccagtccaggagcaggaggcctgtggacgcctcccaataggacaaatgtgtccatgctcacggaccttttcttccaggggtcatttcctctcaaacctacagccaacaaggccaccagtccgctcaacccagggccacttccstaatgaccagccaccagcagaagcagatggcctcaggcagatggccggagtcacccactctctagggcgtsaactcccctggctgccccgctcagaccaggcatcgctcacctgcgaccagcagaagagactgatttcatcaa

SEQ ID NO: 2607 - DNA, 321 bp, Homo sapiens
  CDS 76..321
  misc_feature 10: b=c or g or t
cacctcagcbacttgagtagctgggactacaggcgctttgtatttttgtattttttgtagagacggaatctcgccatgttgcccaagctggtctcgaacttgggagctactggcgtggacagtgcaggcctgggggaaaggttgtcaccctcactgtgtgtcactggggcttttacaaaacactgcttggtgggctcttccctccctccacaggttccgtttagggggcccagccacaagaccccaggctctagaatctctgcccttgagcatcaggctaaagagtttagatttgtctttttttgttgttcttttcttttt

SEQ ID NO: 2608 - DNA, 251 bp, Homo sapiens
  CDS 3..251
  misc_feature 43: w=a or t
  misc_feature 209: s=g or c
  UNSURE 14: Xaa=Leu or Gln
  UNSURE 69: Xaa=Asp or Glu
tgatgaccgtggacagcagcatgagcagtgggtactgcagccwggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagasaagaactgcctgggcatgaaactgagtgaagacggcaccatc

SEQ ID NO: 2609 - DNA, 272 bp, Homo sapiens
  CDS 31..270
  misc_feature 121: k=g or t
  misc_feature 122: k=g or t
  misc_feature 123: k=g or t
  misc_feature 124: w=a or t
  misc_feature 263: w=a or t
  misc_feature 264: r=a or g
  UNSURE 31: Xaa=Cys or Phe or Gly or Leu or Val or Trp
  UNSURE 32: Xaa= *  or Lys
  UNSURE 78: Xaa= *  or Leu
cttgcttatcttattctgctgctagattgcatgttccttaaggaggaggtcttactgaattttgtatctcagagtatgatgcagaataggcacttagtagacattgaattttataattttkkkwaattatactttaagttctggtatacatgtgcagaacgtgcaggtttgttacataggtatacgtgtgccatagtggtttgctgcaccccgtcaaaccgtcttctacattgggtatttctcttaatgctatccctcccctwrccccccgt

SEQ ID NO: 2610 - DNA, 330 bp, Homo sapiens
  CDS 169..330
  misc_feature 10: k=g or t
  misc_feature 135: w=a or t
  misc_feature 136: w=a or t
cagtactatkttcaatttgttttttcctatcagtaaaaaaagattactttattgtttggttgtttcttatatccccaaaggatataagaaaaatttaaaaaatttttatggtatctaagacaatgctgtgctctwwtgagcactacatatgtgttaaaagatcaaactatgttaagtaactttgctatcaaagggagactgcattctttttttttcttttccgagacagagtctcgttctgtgaccttggctgaagagcaatggcacaatcttggctcactgcgacttctgccttccaggttcaagagattctcctgcctcagcctcctc

SEQ ID NO: 2611 - DNA, 267 bp, Homo sapiens
  CDS 56..265
  misc_feature 42: r=a or g
acgcaaatcaataaatgtaatccagcatataaacagaaccaragtcaaaaaccacatgattatctcaatagatgcagaaaaaacctttgacaaaattcaacaacccttcatgctaaaaactctcaataaattaggtattgatgggacgtatttcaaaataataagagctatctatgacaaacccacagccaatatcatactgaatgtgcaaaaactggaagcattccctttgaaaactggcacaagacagggatgccctctctcaca

SEQ ID NO: 2612 - DNA, 483 bp, Homo sapiens
  CDS 95..481
  misc_feature 311: s=g or c
  UNSURE 73: Xaa=Asp or His
gtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgcgsaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctga

SEQ ID NO: 2613 - DNA, 385 bp, Homo sapiens
  CDS 136..384
aatgggcagggaccgaggctgaaagagacaggagtcctccagccgaggagaagctgatgcagctgggcttgtcccagagggagaggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtacctgctgggagtcagctccca

SEQ ID NO: 2614 - DNA, 191 bp, Homo sapiens
  CDS 8..190
ctcacctatgtttgtctgtctttcaggagcccagcagccggggccgccctattacaccgacccaggaggaccggggatgaaccctgtcgggaattccatggcattggctttccaggtcccacccaactcaccccaggggagtgtggcctgcccgccccctccagcctactgcaacacgcctccgcccccga

SEQ ID NO: 2615 - DNA, 413 bp, Homo sapiens
  CDS 236..412
  misc_feature 38: d=a or g or t
  misc_feature 95: s=g or c
  misc_feature 228: w=a or t
  misc_feature 235: r=a or g
  misc_feature 243: r=a or g
  misc_feature 244: r=a or g
  misc_feature 246: w=a or t
  misc_feature 328: r=a or g
  misc_feature 384: r=a or g
  misc_feature 391: r=a or g
  UNSURE 3: Xaa=Glu or Gly
  UNSURE 4: Xaa=Ile or Lys
  UNSURE 50: Xaa=Asn or Ser
agaagtatgggactaggtgaaaagaccaaatttatgtdtgattggtgtacctgaaagtgatggggacaaaggaaccaagttagaaaacactcttsaggatattatccaggagaatttccccagcctagcaaggcaggccaacattcaaattcaggaaatacagagaacatcacaaagatattcctcgagaagagcaaccccaagacatataatcatcatattcaccawggttgaratgaaggrrawaatattaagggcagccagagagaaaggtcgggttacccacaaaaggaagcacatcagaataacaggggatctcttggcagaratcctacaagccagaagagagtgggggccaatattcaagattcttaaagaaaagarttttcarcccagaattttatatccagcca

SEQ ID NO: 2616 - DNA, 468 bp, Homo sapiens
  CDS 258..467
  misc_feature 9: r=a or g
  misc_feature 10: k=g or t
  misc_feature 11: w=a or t
  misc_feature 27: y=c or t
  misc_feature 104: k=g or t
  misc_feature 407: w=a or t
ttttgctgrkwcttcacatttaataaytctttgaactaagaaccaggcccattttcctggttaaaaatgcctactcatacaaaagtgccctggggacatgagtkaccatggctaataccaagtttgttggcataaaaactacaaaaccatgaccaacctagcagacacctcatagataagtcacagttaaagagatacagcctaggaaaccaaaatgtattttcaaaataattttgcttgcgtttatcaaacactgaatggagacatggttcataaaattccctttccctccccatccactttcctttcatgggcagttcacagagttcctctctaatccaaacctttcaaaaaactcttttcccacctctgccacaagaatcttatttcccccatcactttatggwggccttgatgattcatttacccagtctctatttttcagtcctaacatcttgatatcatcgt

SEQ ID NO: 2617 - DNA, 366 bp, Homo sapiens
  CDS 205..366
  misc_feature 10: r=a or g
  misc_feature 31: k=g or t
  misc_feature 32: d=a or g or t
aaaaatcccrttcagtgaagctcagacacakdtcacaacttcttcattggcctcaaacacacagtcccccactgaaataagaacgagtttttatgctgctacacagcatttcacattttcatatgcattataataaaatgataacagtaaaacttagtataaaatctagtcagtgtggatccctgtgctcaatgctttacacgaatgttccaggtcaaccctcaaaataactctctcacagagtatcatccccatctcacggacaaggactctggggctcaggggacaggcagtgtcagcatgcacacacaggttgaccgatgcccagtgtctttctacagtgtccagctgtctcccccacacccc

SEQ ID NO: 2618 - DNA, 158 bp, Homo sapiens
  CDS 5..157
  misc_feature 126: k=g or t
  misc_feature 131: r=a or g
  UNSURE 41: Xaa=Leu or Trp
  UNSURE 43: Xaa=Glu or Lys
tcaaatggatgctgaacatagagaagtattgccagaatcattacctgtgttgcacaatcaaagagaatttagcatggctgattttctcttagaaaccactgtatcagattttggccagtctcattkgactraagagaaagttatttcagattgcgagt

SEQ ID NO: 2619 - DNA, 479 bp, Homo sapiens
  CDS 277..477
  misc_feature 22: n=a, g, c or t
  misc_feature 54: k=g or t
  misc_feature 207: m=a or c
  misc_feature 208: r=a or g
  misc_feature 244: m=a or c
  misc_feature 245: r=a or g
  misc_feature 308: r=a or g
  misc_feature 367: r=a or g
  misc_feature 399: w=a or t
  misc_feature 406: k=g or t
  misc_feature 441: d=a or g or t
  UNSURE 11: Xaa=Glu or Gly
  UNSURE 31: Xaa=Ala or Thr
  UNSURE 44: Xaa=Cys or Gly
aatggattgagatggggaaganaaaaagccccaaattcatgaaatgtagctgckacagtccccacctccttagctgtccccaaaacctaagcaggtaatcataacttccattctgtgctcaccttacctctgctggcacctttttggacagggttctctacttggcgaggtgacccaaatcttcattcctgcagggtctgagtcctmrgccgctgcgatcgtttgaacattgtttgtccccacmraaactcatcttgaggcttggtccccactgtaatgatgttgagaggtggcgggacatttaaggrgtgtttgagtcatgagggatccagcttcacgaagggattagcgcaggagtgcgtgagtrcttcttgtgggactcgattgattactgcagtwgccagtkgttacaaagcaaggctgcctctggccgcgtgcccdcttctgcttcctattttctcccatgctagaagcagcac

SEQ ID NO: 2620 - DNA, 365 bp, Homo sapiens
  CDS 64..363
atagcgcgcgtctgtttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagacaat

SEQ ID NO: 2621 - DNA, 292 bp, Homo sapiens
  CDS 76..291
  misc_feature 58: s=g or c
ctagccgtcgcagtccaaccgccgcctgccctcagccgcccgctggccgggagcggasccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagct

SEQ ID NO: 2622 - DNA, 194 bp, Homo sapiens
  CDS 14..193
  misc_feature 22: n=a, g, c or t
aagggagaggagcatgtctgcnactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgagtgcc

SEQ ID NO: 2623 - DNA, 176 bp, Homo sapiens
  CDS 13..174
cagagaggtctaatgcctgaccttcccctcctatcacaggccttctctgcctgggaacctgacccagagccgcaaccctgggttacagacaggaggatccaagtcaacgtgcctcaggcactgctgagtgacaggtcacactccctcctctcccctggggggtccttggcccaccc

SEQ ID NO: 2624 - DNA, 181 bp, Homo sapiens
  CDS 1..180
  misc_feature 40: b=c or g or t
  UNSURE 14: Xaa=Cys or Gly or Arg
atgcgctcacctccctgcggcctcctgaggtggtttggtbgccccctcctcgcgagttggtgccgctgccacctccgattccgagctttcggcacctctgccgggtggtaccgagccttcccggcgccccctcctctcctcccaccggcctgcccttccccgcgggactatcgcccccaca

SEQ ID NO: 2625 - DNA, 270 bp, Homo sapiens
  CDS 1..270
  misc_feature 68: s=g or c
  misc_feature 113: r=a or g
  misc_feature 114: n=a, g, c or t
  misc_feature 115: k=g or t
  misc_feature 146: s=g or c
  misc_feature 155: s=g or c
  misc_feature 185: s=g or c
  misc_feature 238: s=g or c
  misc_feature 258: n=a, g, c or t
  UNSURE 23: Xaa=Arg or Thr
  UNSURE 38: Xaa=His or Gln or Arg
  UNSURE 39: Xaa=Ala or Ser
  UNSURE 49: Xaa=Cys or Ser
  UNSURE 52: Xaa=Ala or Gly
  UNSURE 62: Xaa=Pro or Arg
  UNSURE 80: Xaa=Glu or Gln
atgagcatgtaccagagctatggctccccttcccagtatgggatggccggctcctatggctcagccasaccccagcagccatccgcaccccaacaccaagggactctgaaccrnkccccagtccccggcatggatgagagcatgtsctaccaggstccccctcagcagctgccgtcggctcagcsccctcagccctcaaatcccccacatggggctcacacgctgaacagtggccctsagcctgggacagctccagcnacacagcacagc

SEQ ID NO: 2626 - DNA, 276 bp, Homo sapiens
  CDS 63..275
  misc_feature 45: k=g or t
ttgataaataacattttccatatttatggggtccatgcaattttkttttttacagttatagaatgtgtaatgatcaggtcagggtatctgaggagtctatgactttgagtatttgtcattctgtgttgggaaccatcagtctattttgtaatatgtcatacattgttgttaactatagtcactctgctcttatgtctaactatagaacttataccttttatctaactgtatatttatacctcttaatctacttctcctcctctccccctcccgacc

SEQ ID NO: 2627 - DNA, 476 bp, Homo sapiens
  CDS 286..474
  misc_feature 18: k=g or t
  misc_feature 448: r=a or g
  misc_feature 465: r=a or g
  UNSURE 55: Xaa=Gly or Arg
gagaaggaggtgcaagtkctagccaacatgtgctaccaggaaggagggaggataaagggggatggactctgaggaagcctggtcaagtgggcctgaccaaaaaattggatagagaagaggtactctcctgatgtccaacaccatggtagggatccctggggatggtgtgaactctctactgggatggctcctaaaatatgcaaaaagagatgctgaaatgtcagaaaagccctgacagcttgcagaagaagggattaaagggcctaggagcttgggcatgctacaatggatctaccatgtatgcccagaatacctggggatgagcatgttccacaggaaagaccaaacagcacactgttctccagggtcataaggattgtgccagtgagagggccaagcatcactgagaagttcagcagtggctcccctctgctggccagggatggarggctgacagaaggagargctgacagaga

SEQ ID NO: 2628 - DNA, 243 bp, Homo sapiens
  CDS 76..243
ctcctccttatcagaatctaatgcctgatgatctgtcactcttgatgatctgtcactgtctcccatcacccccagatgggaccgtctagtttcagtaaaacaagctcagggctcccactgattctacgttatggtgagttgtataattatttcattatatattgcaatgtaatcataatacaaataacctgcacaataaatataatgcatttgaatcatcctgaaactaccctgcgaccccct

SEQ ID NO: 2629 - DNA, 228 bp, Homo sapiens
  CDS 38..226
caacagctcagggtcagctgaccgaatgcctcggtgaatgaatgactctacaagagaggaagggagcctcggtgggcatcatctcccctcgactactggccagagccctggctcttacaccccagcgacgggaagcagttgtggcctgtggcttcagtcttcatcaccacaatccctgaagcccacccttgcccagacacctgtgccccagccccaaccccaggccac

SEQ ID NO: 2630 - DNA, 331 bp, Homo sapiens
  CDS 159..329
atacgccaagacgatctgaagagaacaggagttcccccgggcctgggaaggctgcctggaggaggaggtgctggtagatgcggggttagggtggaaaagctggagcaggacaccgcagcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaatt

SEQ ID NO: 2631 - DNA, 194 bp, Homo sapiens
  CDS 18..194
tgcctgcagcagaagccatgtgtggtacatctggtccagccacagactcacatggagctggcacctgtgccagtgcccggagctgtccatcctgtcgcagcaaccagcgtacctggctgtgcacagtggctggaccctgtgctaccagcctagatcacacacctgctaagggcaagccaggcgtgaagcagcaa

SEQ ID NO: 2632 - DNA, 391 bp, Homo sapiens
  CDS 39..389
atcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaa

SEQ ID NO: 2633 - DNA, 232 bp, Homo sapiens
  CDS 66..230
atgctacccaggacaatgctaggggcacatgggcacagcatgaaataactgcatctcagaatggaatggttacgcccctcccaaatctccttctatccgggttacagcaaggaaaggctccgtttggtgctactatgcatgtccctaacctttctagcactttctactctccgctttttaacacagagagtgcagatgcaggctgggtgccctctgcggagtccacgcctct

SEQ ID NO: 2634 - DNA, 315 bp, Homo sapiens
  CDS 136..315
  misc_feature 311: s=g or c
  UNSURE 59: Xaa=Ser or Thr
actttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcastcaa

SEQ ID NO: 2635 - DNA, 234 bp, Homo sapiens
  CDS 73..234
aagggatgtgaaggacctcttcaaggagaactacaaaccactgctcaaggaaataaaagaggatacaaacaaatggaagaacattccatgctcatgggtaggaaaagaatcaatatcgtgaaaatggccatactgcccaaggtaatttacagattcaatgccatccccatcaagctaccaatgactttcttcacagaattggaaaaaactactttaaagttcatatggaacctt

SEQ ID NO: 2636 - DNA, 231 bp, Homo sapiens
  CDS 50..229
agtggtcctggccgtgcgccggaggagcggcggcgtggcgcacggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgaa

SEQ ID NO: 2637 - DNA, 266 bp, Homo sapiens
  CDS 25..264
  misc_feature 5: y=c or t
  misc_feature 50: m=a or c
  misc_feature 51: h=a or c or t
  misc_feature 59: w=a or t
  misc_feature 74: s=g or c
  misc_feature 124: k=g or t
  misc_feature 125: y=c or t
  misc_feature 162: s=g or c
  misc_feature 193: w=a or t
  misc_feature 194: r=a or g
  misc_feature 226: r=a or g
  misc_feature 227: k=g or t
  misc_feature 228: s=g or c
  UNSURE 9: Xaa=Ala or Asp or Glu
  UNSURE 12: Xaa=Glu or Val
  UNSURE 17: Xaa=Ser or Thr
  UNSURE 34: Xaa=Ala or Phe or Ser or Val
  UNSURE 46: Xaa=Asp or Glu
  UNSURE 57: Xaa= *  or Lys or Arg or Trp
  UNSURE 68: Xaa=Gly or Ile or Met or Arg or Ser or Val
ctgayaaaagccaattgatttttcatgctggcaatgtgctcccacacagmhagggctgwgatgatggcaaagasttcccttcccaaaccacgctgggctgagtctggagatccctggcttccakytgtttgtgaggtcaattacacccctctgcatggggasgagacaaggttcctttggctcatcatccttwrgctcaatgttggaaattcaccaacattgattrkstcatttgtagattatctcatgttgtataatacagccaa

SEQ ID NO: 2638 - DNA, 207 bp, Homo sapiens
  CDS 25..207
accctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctaact

SEQ ID NO: 2639 - DNA, 198 bp, Homo sapiens
  CDS 44..196
tgtttacactgtgagggtaaaaccacctactcaagcctcagcaatggcaggcacccctcccccaaccaagcaggtaatttctgcgtttccaactgaggtacctggttcatctcattgggactggttggacagtgggtgcagcccatggagggcgagcagaagtagggtggagtgttgcctttcccgggaagcgcaagg

SEQ ID NO: 2640 - DNA, 454 bp, Homo sapiens
  CDS 97..453
agatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaagagcaatgggtcaaggacgcgatgcagcatctggaccgccagctgctgccctaactcgaaatggcggcaccttcgagaagcagatcggcgaggtgaagccaggaccacccctgccgccgggggaa

SEQ ID NO: 2641 - DNA, 299 bp, Homo sapiens
  CDS 11..298
caaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacactt

SEQ ID NO: 2642 - DNA, 317 bp, Homo sapiens
  CDS 136..315
  misc_feature 170: r=a or g
  UNSURE 12: Xaa=Glu or Gly
tatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagagtgracgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtgga

SEQ ID NO: 2643 - DNA, 309 bp, Homo sapiens
  CDS 39..308
  misc_feature 255: r=a or g
  misc_feature 256: h=a or c or t
  misc_feature 257: n=a, g, c or t
  UNSURE 73: Xaa=Ala or Asp or Glu or Ile or Lys or Met or Asn or Thr or Val
actataaatcatgctgctataaagacacatgcacacgtatgtttattgaggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcrhnattctcactcataggtgggaattgaacaatgagatcacatggacacaggaag

SEQ ID NO: 2644 - DNA, 370 bp, Homo sapiens
  CDS 100..369
cacacagtggacaacagcagtttgggggtcagccttggcccccccactccgaactcctcgccgcctatgccctccactcctttccactgttaacccaagatggaaaagcttatgccaagggtcatttctcaggatatgcacataacaggaaaatgtgtttttatccaaattcccacaacccaccagccatgtgatcttgggcaacttagaacctccaaggagggtctggctctgttatctatgctggagtgcagtggcatgagcatagctcactgcagcctcaaccttccgggcataagcaatcctcctgcctcagccttccgagtagctgggactacaggtgtgcaccgtcatgcccagctaattttta

SEQ ID NO: 2645 - DNA, 331 bp, Homo sapiens
  CDS 115..330
  misc_feature 164: v=a or c or g
  UNSURE 17: Xaa=Ala or Asp or Gly
agagctaggctttaggaccatcagtcaagcagccatggaggatgcttgggaggcagagcctcccatcaggaaaccccaggagtcttgtgtagagatccaggagagggcggcgtgatggatgacaagagtgaagattccatgtccgtctccaccttgagcttcgvtgtgaacagacccatcacggggtcttttgatcataccgttgtagtgtgggacgctgatactggaaggaaggtaaatatcttaattggtcattgtgctgagattagcagtgcctcattcaattgggattgctctctaatattaactggctctatggacaaaacctgca

SEQ ID NO: 2646 - DNA, 209 bp, Homo sapiens
  CDS 5..208
tattatgttacgaaaacacacttttggaaaaaaaagagaatcccagcatcctaactcagtcacttatgatcttctgtatttccttggtcttccctctgagcatgtgtacttttacttaacctttgaagtaattacagttacagcatatatacagtctagcttctgctttttaaacttaaatagcatagatatttttccctgtcactccc

SEQ ID NO: 2647 - DNA, 381 bp, Homo sapiens
  CDS 102..380
  misc_feature 327: k=g or t
  misc_feature 329: k=g or t
  misc_feature 330: k=g or t
  UNSURE 76: Xaa=Phe or Leu or Val
  UNSURE 77: Xaa=Phe or Val
atgaatttatcagtcctaagatttttttggtgccacttttggagtttagggttttctatatatttgatcccgtcatgtgcatacagggataatttgacttcatgcttcctgatctgcatgccctttatttctttgtcttgcctgattactctgtctcagaccttttgtactttgttaaaaggtgtgaaagtgggcatacttgttttgtttcagattatagagagaaagctttcagcactttcccattatgcatgatgttagctgtgggtatgttacttattacctttattatgttgaggtacgttctttctattattattataattktkkttaattttttttttgagatggagtctcgctctgtcacccagctggagtgca

SEQ ID NO: 2648 - DNA, 399 bp, Homo sapiens
  CDS 145..399
aaagttgctgtatttacagagaatgcatcagaggtcaaaatagcggaagaaaatggagctgcatttgcaggaggcactagtctgatacagaagatttgggatgatgaaattgttgcagacttttacgtagctgttccagaaataatgcctgaacttaatcgattaaggaagaaactgaataaaaaatatccaaagctttctcgaaattccattggccgtgacatccccaaaatgcttgaattatttaaaaatggacatgaaattaaggtagatgaagaaagggagaactttctccagaccaaaatagcaacattggatatgtcaagtgaccagatagctgccaatctgcaagcagttattaatgaagtttgtaggcacagaccgctgaatttgggtacc

SEQ ID NO: 2649 - DNA, 421 bp, Homo sapiens
  CDS 227..421
  misc_feature 347: n=a, g, c or t
  misc_feature 348: v=a or c or g
  UNSURE 41: Xaa= *  or Ala or Glu or Gly or Lys or Pro or Gln or Arg or Ser or Thr
acatttgatgtactgctttaaacttaaagacctctttggacccgaaattgtaaggttaaccacctgggacggtaaactaccgaagtctgcttctgcttccaaaggagaaccgcagtgaaaggattctataaacctggagagtaatcctaagaaaaatcatcagaagaaaggaatttgtagaactaaaactgcaaacatccagaatcttgatggtgtgccaagccaaatgtcaactggaactcaaccaaaaactaaaaaattgaggcaaaagaagcatgtgactggctccgtgctgccgggttcccgcaatacgctcagttatatgaggattcacaatttcccatcanvattgtggctgtcaagaatgatcatgattttcttgaaaggaccttgtagaacctctttgcagacgactaaatac

SEQ ID NO: 2650 - DNA, 272 bp, Homo sapiens
  CDS 21..272
gtataggtctctataacgtgatgtttacagcaatgcctcctttaactcttggaatatttgagagatcatgcagaaaagagaacatgttgaagtaccctgaattatacaaaacatctcagaatgccctggacttcaacaccaaggttttctgggttcattgtttaaatggcctcttccactcagttattctgttttggtttccactaaaagcccttcagtatggtactgcatttggaaatgggaaaacctcggattatctgctactgggaaga

SEQ ID NO: 2651 - DNA, 199 bp, Homo sapiens
  CDS 23..199
atgtcttccttctaccaatctaatgaaatttcagcactgtctgctccatacctcctgttactgtaaaggaaattatctttcttccctatcctttcaggaacctctattatggattatcccatctccttgtctttccaacaattccttcgttaagatatccttactgccaattcgttgtgctgaagtccctcacgtagtt

SEQ ID NO: 2652 - DNA, 482 bp, Homo sapiens
  CDS 66..482
aggacagccccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcaggtggaaattctttgtgagcaccacgtttccgagtgtttgtgga

SEQ ID NO: 2653 - DNA, 323 bp, Homo sapiens
  CDS 36..323
  misc_feature 297: s=g or c
  UNSURE 88: Xaa=Glu or Gln
taaatacgataaaaaatgaagcagaggtcatcaacatgtcagaggaacttgcccaactggaaagtatcctcaaagaagctgagtccgcttccgaaaacgaagaaattgacatttccaaagctgcacaaactactatagaaactgccattcattctttaattgaaactttgaaaaataaagaatttatatcagctgtagcacaagtcaaagctttcagatctctctggcccagtgatatctttggcagttgtgaagatgaccctgtacagacactgttacatatatatttccatcatsaagacgctgggccagacaggaagcaa

SEQ ID NO: 2654 - DNA, 420 bp, Homo sapiens
  CDS 53..418
  misc_feature 8: r=a or g
  misc_feature 11: m=a or c
  misc_feature 13: n=a, g, c or t
  misc_feature 294: s=g or c
  misc_feature 299: n=a, g, c or t
  misc_feature 300: n=a, g, c or t
  misc_feature 332: b=c or g or t
  UNSURE 81: Xaa=Pro or Arg
  UNSURE 83: Xaa=Ala or Cys or Asp or Phe or Gly or His or Ile or Leu or Asn or Pro or Arg or Ser or Thr or Val or Tyr
  UNSURE 94: Xaa=Ala or Pro or Ser
gtcgcgtratmgnacgtcgtgggggcctggccggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggccccsgggannctcagaccctcctgccgaccatgctgtgcggbcgttgcacggggcccgggggggccagcctcctgtcccgcagcagcatgtccttgagagacaggtccagctcagtcagggtcagaacgt

SEQ ID NO: 2655 - DNA, 459 bp, Homo sapiens
  CDS 66..458
gcacttcggggcgcgtcactcggagcggcgggtcccgtctcgacaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgatacttcattcagaggaccaagcagcgatataataatcccaggtctct

SEQ ID NO: 2656 - DNA, 397 bp, Homo sapiens
  CDS 190..396
attacttcttatctccatccctgaataatctcattctactttacaaccacactctgaagagatgaattattatctggctcttgtagggaaacaactctttatgaatattttcatgtttctgtatgattggagccttctgagcaaagaacatcagcacccaggttaaagggtgattgacggacaactgtaatggccccaactgtccaaaagtgtaaaggcagagagcttcggagacatagacacttcctctctcccctgaagacatttgcttacatggcaggatgttggaggaaagaccttctttcttccctcccaaaagatgattttttaaaattgcatagcaaaagtctctttatatctctccagagcgatgcagggacagatggaaaagcaccct

SEQ ID NO: 2657 - DNA, 442 bp, Homo sapiens
  CDS 143..442
  misc_feature 115: h=a or c or t
  misc_feature 134: m=a or c
  misc_feature 406: w=a or t
atcagctgagaattgcagctgagggctccggggtaggtgggtgacggcggtcggaggtgtaggagggagccgtggaggtccaggtgactgcttagaaaactgcacagcatctgahgaaatttagcgaataagamcatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatwcagaaggatcgcttagtggcagagttcacaacatca

SEQ ID NO: 2658 - DNA, 241 bp, Homo sapiens
  CDS 15..239
tcaccaaagttgaaatgaaggaaaaaatgttaagggtagccagagagaaaggtcgggttacccacaaagggaagcccatcagactaacagctgatctctcagcagaaactctacaagccagaagagagtgggggccaatattcaacattcttaaagaaaaggattttcaccccagaatttcatatgcagccaaactaaacttcgtaagtgaaggagaaataaaatactttacagacaagta

SEQ ID NO: 2659 - DNA, 342 bp, Homo sapiens
  CDS 105..341
  misc_feature 284: s=g or c
  UNSURE 60: Xaa=His or Gln
gtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcastccagcagctgcagcagatgcaccagaagcaaatgcagtgcgtgcttcagcccgcacc

SEQ ID NO: 2660 - DNA, 269 bp, Homo sapiens
  CDS 39..269
ctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgca

SEQ ID NO: 2661 - DNA, 318 bp, Homo sapiens
  CDS 99..317
acagatgtacaattaacagcttctctcatttttctgactcggtgatcccaagaaggcctatactggagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggtgca

SEQ ID NO: 2662 - DNA, 442 bp, Homo sapiens
  CDS 132..440
  misc_feature 373: n=a, g, c or t
  UNSURE 81: Xaa=Leu or Pro or Gln or Arg
cttacatcaaagttcaaaactacagccgaggcaacagagcaagaccctgcctcaaaaagaaaacagaaagttcaaaaactaaatggcatattttttagggatgtgcagatacgtggtgaaagaaacgtactatgaagaaaagtgtgggaataataaagactaaagcaggaactgattccctctgcaggagaagggaagggacccgggactcaggcagggcctccagggagcatccacagttatgtttcttgagattctactccctaaacttggtggaggtcctctgtgtccaatgtgtcaatattctttataccttacccatcctgtacaaatgctttatttctattcaatacttagaaggcagttataaacnagatgcattcaatagcaaggtggcagatgaacatcaggaaggaacattcatgagcttccatccacggaa

SEQ ID NO: 2663 - DNA, 221 bp, Homo sapiens
  CDS 24..221
  misc_feature 186: r=a or g
  misc_feature 188: m=a or c
  misc_feature 189: w=a or t
  UNSURE 55: Xaa=Asp or Glu or Lys or Asn
  UNSURE 56: Xaa= *  or Arg
cccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggtaattggramwgaacttcttggagtgttcttgttcctggtaga

SEQ ID NO: 2664 - DNA, 313 bp, Homo sapiens
  CDS 87..311
  misc_feature 81: s=g or c
  misc_feature 313: m=a or c
aaacggatccgcgccatgaagaaagccaacaaggagcgagaactcaagtgccagcacatgcaggagctgaccaagcgcaasaggagatggtggcgctgcggctggagcaccagcggctgagcgccaagctgaaggactactacatcttcaacaagtacctagagaaggtggtggagaactccgaggaatctcgctgggcgcacatccagaacaccgcagccaagaagaccctcctgcttggcaccattaagatggccacgctgaacctcttccagatcgtgagcaagcacctgaaggaggtgactgaggtggm

SEQ ID NO: 2665 - DNA, 259 bp, Homo sapiens
  CDS 38..259
caaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgaaca

SEQ ID NO: 2666 - DNA, 253 bp, Homo sapiens
  CDS 92..253
  misc_feature 30: y=c or t
  misc_feature 31: y=c or t
  misc_feature 53: y=c or t
  misc_feature 90: w=a or t
  misc_feature 91: y=c or t
  misc_feature 96: y=c or t
  misc_feature 97: w=a or t
  misc_feature 162: y=c or t
  misc_feature 187: y=c or t
  misc_feature 188: w=a or t
  misc_feature 197: s=g or c
  misc_feature 198: k=g or t
  misc_feature 231: s=g or c
  misc_feature 252: w=a or t
  misc_feature 253: k=g or t
  UNSURE 2: Xaa=Ile or Thr
  UNSURE 24: Xaa=Met or Thr
  UNSURE 33: Xaa= *  or Lys
  UNSURE 36: Xaa=Gly or Leu or Arg or Val
  UNSURE 47: Xaa=Ala or Gly
  UNSURE 54: Xaa=Asp or Glu or Val
aaacatttgcttcgctccgccccgcagcgyyggagtcaaagccggttcccggyccagtcccgtcctgcagcagtctgcctcctctttcawyatgaywgatgccgctgtgtccttcgccaaggacttcctggcaggtggagtggccgcagccatctccaagayggcggtagcgcccatcgagcgggtywagctgctgskgcaggtgcagcatgccagcaagcagatcactgsagataagcaatacaaaggcgwk

SEQ ID NO: 2667 - DNA, 346 bp, Homo sapiens
  CDS 90..344
aaaaccagcaacccgagaagcgataatgatgtgaagacagttgaggagcacatccctggcgtaagactggactgcctgtggtccaaaccatgcttcaccacgagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggcctcagcatctgcacacgggaa

SEQ ID NO: 2668 - DNA, 321 bp, Homo sapiens
  CDS 123..320
  misc_feature 58: r=a or g
aaatatttgaagaccccactgacagtgatttgcataaactaaaatctccaagccaggrcaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagca

SEQ ID NO: 2669 - DNA, 383 bp, Homo sapiens
  CDS 231..383
  misc_feature 342: w=a or t
  misc_feature 374: w=a or t
  UNSURE 38: Xaa=Ser or Thr
ctctgcatttaaggttcttccatgttaagcatagcttgatcgctcttttttttagtgctgaataatattccattttctaggtttaccacagttgatttatccattcacctactgaaggatatcttggtttcttccaagttttggcaattatgaaaaaagctggtataaacgtgtgtgtgcaggtttttgtgtggatataatttttcaactatgggtaaataccaaggtgcatgattgctggattgtatggtaaaactatgtttagttgtagaagaaactgccaaactgtcttccaatgtgattgtgttgattttgtattcctaccagcaatgaatgagagtwcttgtgactccacgtttttgccatcatttggwgttgttagt

SEQ ID NO: 2670 - DNA, 219 bp, Homo sapiens
  CDS 53..217
caaccagagcctggagcactcctaccagagggtctccagccagctgcagagcatgcacactctgctgagagagaaggaggaagagctggagcgcattaaggaagcacatgagaaggttctggagaagaaggagcaggacctcaatgaggctttggttaaaatggttgccttggggagcagcttagaggaaacagaaattaagctccaggcaaaagaaga

SEQ ID NO: 2671 - DNA, 331 bp, Homo sapiens
  CDS 11..331
agaacagagtatgcaatttgggaagctgtggtgtggctgcagtggagagttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagca

SEQ ID NO: 2672 - DNA, 226 bp, Homo sapiens
  CDS 62..226
tgcattaacaaataaaattctagccttgtggaaggcagacaaacatggcattccataccatatggactgtagttctagtgatttcactttgggttttccagtacaagatttaaacaagggaccaaagaaaagtgcccctcctcctggttttgaaataaccagaagggaaataaaatctacactttttatttttatttttttggcaagaatttattgtaatgagcgt

SEQ ID NO: 2673 - DNA, 411 bp, Homo sapiens
  CDS 228..410
  misc_feature 83: d=a or g or t
  misc_feature 323: d=a or g or t
aaataaaagttgatttaaaacaatattgtgtgtgattgtgaagctggtgtctgttgtgtgatcagtggtaaagcacgtgagtdgctaggcacaggtgttgagatttcgtgtttgatcagacttctcttttaagtttaagcctggttgaacacagtctctgtcaggtaccgtggaaatccttaatgtgaaccatttcatgaaaccctcactactgtccagtggtggcgatgctatttattaaccacatttttcaaatgagagaatgggagtttataggcctaagatcagatgccatcccccagacgcctgccttgatgccagtdtcctgttgccacccccaccccctcctgttccagtctaggccaggtgcccttcatccgtgtttctgtggccccttgtgtttattgcagt

SEQ ID NO: 2674 - DNA, 298 bp, Homo sapiens
  CDS 66..296
agtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggc

SEQ ID NO: 2675 - DNA, 268 bp, Homo sapiens
  CDS 95..268
gttgcccagggtttctaagagcagtatggacctctgaagtaactcacacagtagagaatccagataccatgcttgaaaggaaaagactttggctatgacaactgactttgattttgggggacctggacacttttggtgtcctcctcactcttggctcatggctggaagctcagttagtcaaatgaagattgacttggtgcacagccaaacctcaagagcacttgcttccatccctttccctcaagcttctcctctgcactcaacccta

SEQ ID NO: 2676 - DNA, 302 bp, Homo sapiens
  CDS 65..301
attcaccactcagcagctggtagagaagtaagcctgcttggcaaccacctgcagggctgcagagatgaattacattttcggaaacaacacacttctatactctcgcggcagtcgaggaggcaatactagctctagccatggctcagcaggcccaaagcagaaacactgggcaaaaaagggctcgtcagatgaactgcaagctgagccagaaccttcacgctggcagcagatagttgcatttttcactcgaagacacagctttattgactgcatctcggtagccaccagctccacccaggcgt

SEQ ID NO: 2677 - DNA, 334 bp, Homo sapiens
  CDS 129..332
  misc_feature 302: b=c or g or t
attaagattagaaactgactgcttcagggctcagctggaagaagaaaaaagaaaaaaaactcaaccgactggggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacbtccaaattagaacaagatcattttcaggtgcg

SEQ ID NO: 2678 - DNA, 221 bp, Homo sapiens
  CDS 52..219
cctttggcccccatatctaaatcattgtggacttgctcagtagaatcttgcatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagt

SEQ ID NO: 2679 - DNA, 329 bp, Homo sapiens
  CDS 99..329
atgtccgcaggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacatc

SEQ ID NO: 2680 - DNA, 296 bp, Homo sapiens
  CDS 102..296
  misc_feature 295: v=a or c or g
  UNSURE 65: Xaa=Pro or Gln or Arg
agaggagttcttattgccacagcctttggagtaaaacagctcagagcttgaacctggctctgttgcataatagctgtagctcctcagttttcatctataaaatgaaaataacggagatgaggattaagggaaattatatacacagcactttgcagccaaatactggatacaaggatgaaaatgggataaatagaccagtctgttcctatgttaaaccacttcgagctggacggcttcttgatactccaaggcaagcagcaagatttgttaatgtccttggttatgaacgagcccva

SEQ ID NO: 2681 - DNA, 174 bp, Homo sapiens
  CDS 18..173
gacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccc

SEQ ID NO: 2682 - DNA, 298 bp, Homo sapiens
  CDS 99..296
  misc_feature 98: k=g or t
  misc_feature 217: s=g or c
  misc_feature 226: r=a or g
  misc_feature 229: s=g or c
  misc_feature 298: r=a or g
  UNSURE 40: Xaa=Cys or Ser
  UNSURE 43: Xaa=Lys or Arg
  UNSURE 44: Xaa= *  or Ser
atctttttgttgctgccggacaaggagtggtaaaatttcagccttccctttggccttgggactcagtgaggaacaatttgagaagtgccctgacagakatgtgtgttctctatgatgttctcagtattgttagggataaaaaatttatgactcttgatcctgtctctcaggatgcacttcctccaaaacagaatcctcagacgttgcaattgatatstaaaaagargtsacttgctggagcagcacaaatcttattgaagggggcagaaagactgactaaatcagttaccgaaaaccr

SEQ ID NO: 2683 - DNA, 204 bp, Homo sapiens
  CDS 19..204
caaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgtt

SEQ ID NO: 2684 - DNA, 366 bp, Homo sapiens
  CDS 124..366
  misc_feature 40: s=g or c
ggctcctggccggagcaagatggctgagggcgagcggcascgccgccagattcttcagaggaggcccctccagccactcagaacttcatcattccaaaaaaggagatccacacagttccagacatgggcaaatggaagcgttctcaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggatc

SEQ ID NO: 2685 - DNA, 264 bp, Homo sapiens
  CDS 23..262
  misc_feature 210: n=a, g, c or t
  misc_feature 211: n=a, g, c or t
  misc_feature 227: v=a or c or g
  misc_feature 228: n=a, g, c or t
  misc_feature 229: m=a or c
  misc_feature 243: s=g or c
  misc_feature 244: s=g or c
  UNSURE 63: Xaa=His or Leu or Pro or Gln or Arg
  UNSURE 69: Xaa=Ala or Asp or Glu or Gly or His or Ile or Lys or Leu or Asn or Pro or Gln or Arg or Ser or Thr or Val
  UNSURE 74: Xaa=Arg or Ser or Thr
agttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccnngacgtggaacgctgcvnmgggcccaccggaasscatggagaccacctacccca

SEQ ID NO: 2686 - DNA, 436 bp, Homo sapiens
  CDS 60..434
agatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccact

SEQ ID NO: 2687 - DNA, 324 bp, Homo sapiens
  CDS 56..322
aggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaact

SEQ ID NO: 2688 - DNA, 230 bp, Homo sapiens
  CDS 24..230
  misc_feature 154: y=c or t
  UNSURE 44: Xaa=Phe or Ser
gagagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagtyctgcgcgcggcaagcggaggcgtggcgtgcctcggggcgccctggctattgcctgggaacccggcccctcaacacg

SEQ ID NO: 2689 - DNA, 373 bp, Homo sapiens
  CDS 215..373
  misc_feature 247: w=a or t
  misc_feature 251: s=g or c
  misc_feature 254: y=c or t
  misc_feature 283: w=a or t
  misc_feature 298: s=g or c
  misc_feature 299: s=g or c
  misc_feature 330: w=a or t
  misc_feature 342: k=g or t
  misc_feature 345: y=c or t
  misc_feature 353: r=a or g
  UNSURE 13: Xaa=Gly or Arg
  UNSURE 14: Xaa=Pro or Ser
  UNSURE 23: Xaa= *  or Cys
  UNSURE 28: Xaa=Lys or Asn
  UNSURE 29: Xaa=Ala or Pro
  UNSURE 39: Xaa=Ile or Asn
  UNSURE 43: Xaa=Leu or Trp
  UNSURE 44: Xaa=Phe or Ser
  UNSURE 47: Xaa=Gly or Ser
cagttttccccaaatcactttttacatttttggaggcagggtctcactctgtctcccagagtggagtgcagtggtatgatcatagctcactgcagcttcaaacttctgggctcaagcaatcctcccacctcagcctcccaagcacctgggactacaggtatgcaccatcacacccagctaatttaaaaaaaaaaaaaatttttttttggtagagatgagatcttgctatgtagcccaggctggcctwaaasgaycctcctgcctcagcttcccaaagtgctgwaatgacaggtgtaasscacctcgcccagccccaaatcacttattgawtaatgcatcttkgtyccactacrgtaaatttagcctggtttgt

SEQ ID NO: 2690 - DNA, 237 bp, Homo sapiens
  CDS 53..235
cttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcgt

SEQ ID NO: 2691 - DNA, 424 bp, Homo sapiens
  CDS 237..422
  misc_feature 16: m=a or c
acacacacagctaccmccaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcc

SEQ ID NO: 2692 - DNA, 404 bp, Homo sapiens
  CDS 109..402
acccttgcttgtgtacctggatatgctcgtgtgacgccgtgggggtctgggcctaagtgtgtgagcgttgcacgcgcgtggagaaagacgtgtggaccgcctgtgcagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcat

SEQ ID NO: 2693 - DNA, 390 bp, Homo sapiens
  CDS 119..388
agatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaa

SEQ ID NO: 2694 - DNA, 305 bp, Homo sapiens
  CDS 78..305
aagaatgtcacagatagtaggtcctaataataattaacaaatatattgattttctaggacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccagg

SEQ ID NO: 2695 - DNA, 314 bp, Homo sapiens
  CDS 104..313
aaaggaatcccctgaatattcattcccagacttcaggcctgtcagtcgcagtctcggtcgtacctcccctagttgcaaccttagctgttggcagggtgaagagatggcttccccgtctagacagcccccgccagggggttcaggactgcttcaagggagccgggctcgttcatatggaagcctggtgcaatcggcctgctccccagtgagggaaagacgcctggagcatcagttggagcccggagacaccctggctggactagcactcaaatatggggtgacgatggaacagattaaacgtgcaaaccgcctta

SEQ ID NO: 2696 - DNA, 338 bp, Homo sapiens
  CDS 186..338
  misc_feature 242: k=g or t
cagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgtkcatttgtttttctgcattatttggtatattgtctgtttgacaacatccattctcctccttttcctgcgcatgaatcttccttatatctaccatgcc

SEQ ID NO: 2697 - DNA, 376 bp, Homo sapiens
  CDS 12..374
  misc_feature 347: r=a or g
  misc_feature 371: n=a, g, c or t
agtgatcagaaatgattttctcggatatgaacaccgtttctggctcccctaaagtgcatcctcctaatgggacccggttttacacttttcaaattgttgccttgcgtgaacaaaatgttcatatacaaagaaaaatggcatcaagcgagggatccacagagtcagaacatcttgaagggatggaacctggacagaaagtccatgagaagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagargtggaacaggaagcagagacagcnagaaa

SEQ ID NO: 2698 - DNA, 171 bp, Homo sapiens
  CDS 6..170
aagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccacg

SEQ ID NO: 2699 - DNA, 476 bp, Homo sapiens
  CDS 264..476
attcttctggaagaagactttctcctgaaagcctcctggaggcaaagttctggcagaacgaggcaatttccctccctgcaggcggaaggaaggcaattagagcgggagctagggctgagagaggggaaatgatgcagacactgccacccagcaagtgagaggaaggactgaacatggacagaagggcttgagacattgagccttggctgctttcacccatcccttcaattgctgccctcttttctaatggcctgagtctccaaatggagccaagctgggggcaccctggccaggagatgtggcctgctgtgcccctgagaagagctgtcccaggcacacagagacaacatttggaagtggaaaatgcctctggagcagtcagagtgttgggaagtctcatcccattctccgtttcaggaaccttccctcagcaacagcagacagaagggactcagttcagcatactcggcaagtat

SEQ ID NO: 2700 - DNA, 350 bp, Homo sapiens
  CDS 99..350
  misc_feature 45: s=g or c
  misc_feature 209: v=a or c or g
agaaagggcctgggcggccgcactgagagctctacgcccggaggstcaggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtvcttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccc

SEQ ID NO: 2701 - DNA, 320 bp, Homo sapiens
  CDS 143..319
ttcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagt

SEQ ID NO: 2702 - DNA, 319 bp, Homo sapiens
  CDS 152..319
  misc_feature 7: w=a or t
  misc_feature 211: k=g or t
  misc_feature 213: k=g or t
  UNSURE 20: Xaa=His or Gln
  UNSURE 21: Xaa=Cys or Phe
ttttttwccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcaktkcatggagtcttctgatcaaaaaagctcacgtcgtatttcttcttttcctttctcttttctagaaattgggtgtttgtaccagaatggaattttgcttctcggttat

SEQ ID NO: 2703 - DNA, 403 bp, Homo sapiens
  CDS 59..403
  misc_feature 175: d=a or g or t
  misc_feature 365: w=a or t
  misc_feature 370: r=a or g
  UNSURE 39: Xaa=His or Gln
  UNSURE 103: Xaa=Asn or Tyr
agttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcadactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccawatgcrctaaattccttggtgcagtatgcttacacagga

SEQ ID NO: 2704 - DNA, 179 bp, Homo sapiens
  CDS 20..178
  misc_feature 27: w=a or t
  misc_feature 58: n=a, g, c or t
  misc_feature 126: n=a, g, c or t
  UNSURE 3: Xaa=Glu or Val
  UNSURE 36: Xaa=Cys or Phe or Ser or Tyr
gatcatgtgacaatccaagatggcggwgcccggcgaggcggaggaggaggcgacagtntacctggtagtgagcggtatcccctccgtgttgcgctcggcccatttacggagctattttagccagtnccgagaagagcgcggcggtggcttcctctgtttccactaccggcatcggcctg

SEQ ID NO: 2705 - DNA, 321 bp, Homo sapiens
  CDS 1..321
atgcggtacaacgagaaggagctgcaggctctgtcccggcagccggccgagatggcggccgagctgggcatgaggggccccaagaagggcagcgtgctgaagcggcggctggtgaagctggtggtgaatttcctcttctactttcggacagacgaggccgagcccgtcggagccctgctgctggagcgctgcagagtcgtccgggaagagcccggcaccttctccatcagcttcattgaggaccctgagaggaagtatcactttgagtgcagcagcgaggagcagtgtcaggagtggatggaggctctgcgtcggggccaa

SEQ ID NO: 2706 - DNA, 285 bp, Homo sapiens
  CDS 118..285
  misc_feature 53: w=a or t
  misc_feature 244: k=g or t
  UNSURE 43: Xaa=Leu or Val
aggaagtaagcgcgaaagtgcttcccttaagcttctgaaggttggctgcagtwccggctacctgtgtagtccgagtttccacagccaggtctgtagttactgtggaatcaataagccatggcatctaagaaatttgctgttaaatgtgggaattttgctgtcctcgtggatcttcatatcttgccacaaggttcaaacaaagatacaagctggttttctgaacagaagaaagaggaagtctgtktactgttaaaagaaaccattgattcaagagttcaggagacc

SEQ ID NO: 2707 - DNA, 281 bp, Homo sapiens
  CDS 11..280
atcagattccatggaccagcccaggaacccctgtgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcg

SEQ ID NO: 2708 - DNA, 364 bp, Homo sapiens
  CDS 35..364
  misc_feature 7: v=a or c or g
  misc_feature 8: s=g or c
aaggtcvsgccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggc

SEQ ID NO: 2709 - DNA, 317 bp, Homo sapiens
  CDS 99..317
  misc_feature 7: y=c or t
  misc_feature 32: n=a, g, c or t
  misc_feature 33: d=a or g or t
  misc_feature 35: n=a, g, c or t
ttatttyctggaaaaggctccaggcttcggcndgngaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagagcc

SEQ ID NO: 2710 - DNA, 215 bp, Homo sapiens
  CDS 24..215
  misc_feature 28: s=g or c
  misc_feature 42: r=a or g
  UNSURE 2: Xaa=Cys or Ser
  UNSURE 7: Xaa=Asp or Asn
cagagcagagcaccaaactgaagatgtstcacagagacagtraccaccagcttcagcttttggacactaaatttaaaggtacagttgaggaactcagtaaccagatattatctgcacggagttggttgcaacaggaacaagaacggatagaaaaagagcttttacagaaaattgatcagctttccttgattgttaaggaaaacagtggagccagt

SEQ ID NO: 2711 - DNA, 365 bp, Homo sapiens
  CDS 164..364
agcgctgtaagaagtacctctaggcctgggaggcattgagaaaaaggaagtgggtcctgttctggttcttgcgactatagtcacctcccgaggcaaatgaccactgtcctgagaggacgtgggtgaggggcagatttctgcccctttgtccgaagagccaaaaatgaccaagtccctggaatcagtgtcattcaaggacgtcactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgt

SEQ ID NO: 2712 - DNA, 414 bp, Homo sapiens
  CDS 115..414
aaatcatggtgccgctggggaggggagaagctgctgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcacca

SEQ ID NO: 2713 - DNA, 280 bp, Homo sapiens
  CDS 93..278
  misc_feature 271: h=a or c or t
  misc_feature 272: s=g or c
  UNSURE 60: Xaa=Ala or Asp or Glu or Val
ctttccctggcccaggatcgtccggacgtgcatccaagggccgcacccctctctgtgcgagtggcggggttctttcttggggcgacctgggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcacghsaggaccct

SEQ ID NO: 2714 - DNA, 171 bp, Homo sapiens
  CDS 5..169
  misc_feature 10: k=g or t
  misc_feature 11: k=g or t
  misc_feature 32: n=a, g, c or t
  misc_feature 33: k=g or t
  misc_feature 34: w=a or t
  UNSURE 2: Xaa=Asp or Glu
  UNSURE 3: Xaa=Asp or Tyr
  UNSURE 10: Xaa= *  or Cys or Phe or Gly or Ile or Leu or Arg or Ser or Val
gagtatggakkaccagggcaccaggcatggankwacaatgaaaaccaatacctatgagaggggaacatattacttctttgactgtcttaactggaggaaagtagctaaggagttccatctggaatatgacaaattagaagaacggcctcacctgccatccaccttcaacct

SEQ ID NO: 2715 - DNA, 268 bp, Homo sapiens
  CDS 26..268
  misc_feature 251: r=a or g
  misc_feature 252: r=a or g
  UNSURE 76: Xaa=Glu or Gly or Lys or Arg
aaaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccrrgcgtcatcacgcagac

SEQ ID NO: 2716 - DNA, 320 bp, Homo sapiens
  CDS 135..320
  misc_feature 12: y=c or t
tttaatggtttygtagttttccattatataattggaattataattcatttaataatttccttgttattgttgttgttatttttgtttttttgaggcagggtcttgctttgttgcccaggctggagtacagtggtatgatcaggactcatagcagcctcaacctccccaggctcaaacaatcctctcacctcagcctcccatggcagctgggagctacaggttcatgccaccacgcccagctaatttttgtattttttgtaaagatgaggttttgcatatcgcccaggcaggcaggactcaagctcctggactcaagtgat

SEQ ID NO: 2717 - DNA, 416 bp, Homo sapiens
  CDS 238..414
caggccacatgggcacatgctattataattattttgtgcgatggatgagttacagaactggagccctaagacctgagttctagtttcagctctgccagttgctggctgattgaaactgaacaagccacctgccttccctgagactgtctcttctcctgtgaaattagggcattagaatacatgaagacccctttatgtccttaataacctgtaagtttaagaacctagggaatctccatgctggtggctgcggttatatccccttatcctcaactcgtgaagaaagagtcaaaaatggcagcagggttgtgccaactgctctcctcagcagctatcataagggaattgcctttgtcattttccccagccatcaccacactcccacacggccaccatcacctaaaccatctggcagt

SEQ ID NO: 2718 - DNA, 288 bp, Homo sapiens
  CDS 99..287
ttttctgcaaaatcacaggttgtttgtttgcttgcttgcttattcccagttcttggttaatagaatctgctttaggaagtatagaacagaaagagggaatgaaaatggaaggtacgtccccggctccacccccagctgcaggaaaataccccagctgcagtgaacttattaaaactgcagatggaggacagatttcactggactggtttgataatgataacagtacgtgttatatggatgccagcaccagacctactatcttattgttgcctggcctcacgggaacaa

SEQ ID NO: 2719 - DNA, 309 bp, Homo sapiens
  CDS 67..309
gagagagagagaatgacgaggaggaggaggaaggatagtgagatggcggaaaggaaaactgcttaaatgatttttaaagggccgcgatgggcctcttggaacattggtgtgttcatctgcattcgatgtgctggaatccacaggaatctgggggtgcacatatccagggtaaagtcagttaacctcgaccagtggactcaagaacagattcagtgcatgcaagagatgggaaatggaaaggcaaaccgactttatgaagcctatcttcctgagacctttcggcgacctcagatagacccagctgttgaa

SEQ ID NO: 2720 - DNA, 213 bp, Homo sapiens
  CDS 47..211
agcttcctcaacttcagagccatttgctacaatctaggacagccccatgttcaatgatgctttccttttccatcaacaggggcaaatcgaagtagagagcgaaaccatcttcaagttagcagcgtttattttacaggaagccaagggagattataccagtgatgaaaatgccaggaaagatttaaagacattaccagcctttccaaccaaccg

SEQ ID NO: 2721 - DNA, 176 bp, Homo sapiens
  CDS 7..174
ggagaaatgtctattcagagcctttgcccatttaaaaagttattttttattattattgagttccttatagtttctagatataagcccccctatcatacatgctacagaagtttttacccattctgtggaatatatatatttttatttctttgcatactctttctgccccactccac

SEQ ID NO: 2722 - DNA, 337 bp, Homo sapiens
  CDS 104..337
  misc_feature 32: m=a or c
  misc_feature 274: m=a or c
  misc_feature 300: r=a or g
  UNSURE 66: Xaa=Glu or Gly
attcccctccacttcttgcctgagccgcctgmtcctcttggaaacacgttgagcctccccgctggagagggagccagaacagggaagaacggattcacacaggatggcttgcagaagacgctatttcgtcgagggcgaggcccccagcagtgagactggcacatccctggacagcccctcagcctacccccagggccccttggtgcccggttccagcctgagcccggatcactacgagcacacgtcagtggagcctatgggctgtactcggggmcgccggggcaacagcagcgcacgcgraggcccaagctgcagcactcgacctccatcctgcgca

SEQ ID NO: 2723 - DNA, 356 bp, Homo sapiens
  CDS 191..355
  misc_feature 6: w=a or t
cgcggwgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccg

SEQ ID NO: 2724 - DNA, 159 bp, Homo sapiens
  CDS 7..159
tttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgc

SEQ ID NO: 2725 - DNA, 382 bp, Homo sapiens
  CDS 22..381
ccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaa

SEQ ID NO: 2726 - DNA, 458 bp, Homo sapiens
  CDS 271..456
agctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggtatccagcaggtgtacacacggcagacatggccaagtccagatatatggagctctacactcatgtttataactactgtactagtgttcaccagtcaaaccaagcacga

SEQ ID NO: 2727 - DNA, 298 bp, Homo sapiens
  CDS 28..297
atctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacgtggcttgaaagctaaaaaaacttttctcgaac

SEQ ID NO: 2728 - DNA, 259 bp, Homo sapiens
  CDS 18..257
acagaactcatttaaggatgacaaggcatctacgattaacagcagagggtgaaagggaagagaaaactgaggaagcatctgacatcacagggagaactgagaagcaacagtggggaaggactgatcagactcccaggctgcctgcacctaaggagcagggaagggcagcagacgccctcctaaaggcagtggcagccagcagtgtcgctgagaaggccgtggaggcagctcgaatggccaaactgatagcccagaacct

SEQ ID NO: 2729 - DNA, 420 bp, Homo sapiens
  CDS 173..418
agcgttgttggcccggttgctctggagccgggtctcgggtctggtggctgccggccctgcggcatctcgccatggggagcacggagagcagcgagggccgcaggtgtccttcggagtggacgaggaggagcgggtccgggtgctgcagggtgtccggctgtctgaaaacgtgatgaaccgcatgaaggagcccagctctccaccccctgctcccacatcttctacctttggccttcaagatggcaacttgagagcccctcacaaagaatccacactgcccaggtcggggagcagtggtggccagcagccctcagggatgaaggagggtgtcaagaggtatgaacaggagcattctgctatccaggataagctcttccaggtggcaaagagggaaagagaggctgccaccaagcactccaa

SEQ ID NO: 2730 - DNA, 217 bp, Homo sapiens
  CDS 17..217
  misc_feature 111: s=g or c
  misc_feature 178: k=g or t
  misc_feature 203: n=a, g, c or t
  UNSURE 32: Xaa=Arg or Thr
  UNSURE 54: Xaa=Phe or Leu
  UNSURE 63: Xaa=Ala or Pro or Ser or Thr
actttattttagtaaaatgcccaggagtcctggaagctacgcggacttgcagaggttttattttttggccttagaatctgcagaaattaggaggcaccgagcccagcgcasagcctcggacccggattgcgtttgccttagcggatatgtttatacagatgaatataaaatgtttttktctttgggctttttgcttctttttncccccccttctcac

SEQ ID NO: 2731 - DNA, 439 bp, Homo sapiens
  CDS 64..438
gaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttacta

SEQ ID NO: 2732 - DNA, 392 bp, Homo sapiens
  CDS 200..391
  misc_feature 55: n=a, g, c or t
  misc_feature 56: h=a or c or t
  misc_feature 249: k=g or t
  misc_feature 331: r=a or g
  misc_feature 337: n=a, g, c or t
  UNSURE 17: Xaa=Ile or Ser
  UNSURE 46: Xaa= *  or Tyr
gtttgatgtatgtatatacccttgacataatcaaaatagtgaacatatctatcanhcccaaaagtttcccctgcccctttgtaatccttccccatcctctatcctgaggcaaccattgatctgcttttattatttttaaaagttagcgtattttcttatatgtattgcatatgggatttttctagaaggccacgtgcatatgcaccctccccttccattaccccagtatccgccatcaagtagtaacaktgttgtaacagaaagaatcccattaagtcctagttctggtagcccggtacaaattttagattttcccccaaaaatgaaaaaraattanttaaaaaatttagatttgaaatgcttagaaaacaatcatttatttttttatgtca

SEQ ID NO: 2733 - DNA, 212 bp, Homo sapiens
  CDS 52..210
  misc_feature 175: s=g or c
  misc_feature 176: k=g or t
  UNSURE 42: Xaa=Gly or Leu or Arg or Val
catggacgcccagacacccctcccccgactaactgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctasktgccgggcctgtcacctctttgtccctgctagaatt

SEQ ID NO: 2734 - DNA, 358 bp, Homo sapiens
  CDS 161..358
  misc_feature 6: b=c or g or t
  misc_feature 7: n=a, g, c or t
  misc_feature 8: s=g or c
  misc_feature 159: r=a or g
  misc_feature 160: r=a or g
  misc_feature 304: m=a or c
  misc_feature 305: v=a or c or g
  misc_feature 306: v=a or c or g
  misc_feature 307: w=a or t
  misc_feature 333: k=g or t
  misc_feature 334: s=g or c
  misc_feature 336: n=a, g, c or t
  UNSURE 48: Xaa=His or Gln
  UNSURE 49: Xaa=Ala or Asp or Glu or Gly or His or Lys or Asn or Pro or Gln or Arg or Ser or Thr
  UNSURE 58: Xaa=Cys or Phe or Leu or Trp
  UNSURE 59: Xaa=Lys or Met or Arg or Thr
ccggabnsaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgrratgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccamvvwtctgcaagaggcctcagcccatcctksangggtgtccacgtcagcttcacc

SEQ ID NO: 2735 - DNA, 271 bp, Homo sapiens
  CDS 85..270
  misc_feature 223: d=a or g or t
  UNSURE 47: Xaa=Cys or Gly or Ser
ttcttccatgtggtgttaggcctgttggtacacagaagacaagaattgaggttagggaacctccacctagatttcagaggatgtatgggaatgcctgaatgtccaggcaaaagtctgttgcaggggcagagccctcagggtaaacctctgctagggcagtgtggaagggaaatgtggggttggagccctcagagtccccactggagcactgcttactggagtdgtgagaaagggctaccattctccagaccccagaattatagaccgacct

SEQ ID NO: 2736 - DNA, 417 bp, Homo sapiens
  CDS 248..415
tgtactacaacttgtatctaggacctagattgccaaacccaagctgaaaaaacatcctgaagttcagttgtgcctcttctacagtcaggtagcctcttcccagtgatttttgtagtgatacaacaggaaatactaagtaaacacaaactattccttggtctgctaagaaatcaaaagaatatatgattattcatgataatcttgggttgtagtgaatttaaactagtttcttgggcttccagagcagatgatgggagtgaaattttgggccacattttctagtattattcttacttctagaatagtatcttgcacagtatgcataaggagtcatcacttctggggagctttcctgagtagcctatacctgccttattttggaagtttctggttattctcggagacacgtgatatgct

SEQ ID NO: 2737 - DNA, 332 bp, Homo sapiens
  CDS 157..330
  misc_feature 241: s=g or c
  UNSURE 29: Xaa=Glu or Gln
acacagacccgcactgacctggaaaagcttcgggagcggcgacgggaaggcagcaggaggtggtgcggggacccgaggcgcctcgtacccggccgggctgacgcggccccgctacacacaaagcgcttcagctgcacagggcgctattttccgaaaatgccgcgtctggtcggcgcccaaaatccccaccgaaaagtcccccgtgctgcgcgcggagggacacatggtgtgcgagtgagtsaagctcccagcatccctcccggacccggccctcttcagctcatcgcccgaggattttccgcctctgccctcgtcggcagatcctgctccat

SEQ ID NO: 2738 - DNA, 251 bp, Homo sapiens
  CDS 4..249
aagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagccccaca

SEQ ID NO: 2739 - DNA, 193 bp, Homo sapiens
  CDS 15..191
acttctgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctc

SEQ ID NO: 2740 - DNA, 248 bp, Homo sapiens
  CDS 31..246
  misc_feature 64: s=g or c
  UNSURE 12: Xaa=Gly or Arg
gcggggcccgggtcacggcactaaggggggatggggtgcaagcgagcaagcgaggtctgcggasgggccgtggaagggctccgggacccgctgaaaccatctgaacccagccagggggcagcgggcaagagaaaagggacagaatatctaatgaagcagaaactggaattcggtgggagaggtgaagagctcttgctgggggtacacctgcgaggagcacagaaaacgggcggcggatggcggagaga

SEQ ID NO: 2741 - DNA, 380 bp, Homo sapiens
  CDS 79..378
  misc_feature 25: s=g or c
  misc_feature 349: s=g or c
  misc_feature 350: s=g or c
  misc_feature 351: n=a, g, c or t
  UNSURE 91: Xaa=Ala or Gly or Pro or Arg
ggttcgttatggccgtcgccggagsagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagssnctcaaggaggaaaaacagaaacggaagag

SEQ ID NO: 2742 - DNA, 362 bp, Homo sapiens
  CDS 146..361
ccttttagttctagtcccaactggtttcgcaggcaaaggaggagtggttaatttagggaaggggttgttcctcaaagtcattcaagctgtactcgccgaagagcccccgaacggcaacgcctttccccccttccatcccggcaccatgctggatagggatgtgggcccaactcccatatatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttct

SEQ ID NO: 2743 - DNA, 372 bp, Homo sapiens
  CDS 48..371
  misc_feature 119: d=a or g or t
  UNSURE 24: Xaa=Arg or Ser
tattgaacacctctatgtgccaggctctgtgttgggtactttgatcaatgcccctgtttcagtctcatctgtactcacggcagccctgtggagtacggtgtactggcccagcttacagdtgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtct

SEQ ID NO: 2744 - DNA, 353 bp, Homo sapiens
  CDS 88..351
  misc_feature 49: s=g or c
  misc_feature 314: r=a or g
  UNSURE 76: Xaa=Cys or Tyr
aaagcttctgccagacagatggaactctccagcatgaaaatctgcgcascattccaacaagcagggctctgctgaggttgtccgaagatgccgaggaaaaggatatcaggactggaatggctcttacagcaagatccaggtttttcattagtcaatacagtgaaggctggcatgatcatcagcttcccatccaataatatctactcatcagtgtgctgttgtcaatcagagattttcaagtatgagttctccaactcaaagaaaagtagctggatccaggaagaaaggcatttggggaagaacaacgttctttrcagtgctcatgatgtgtctccagagaaagttacttcagc

SEQ ID NO: 2745 - DNA, 335 bp, Homo sapiens
  CDS 178..333
  misc_feature 32: k=g or t
  misc_feature 33: n=a, g, c or t
  misc_feature 34: w=a or t
  misc_feature 67: r=a or g
  misc_feature 68: r=a or g
  misc_feature 69: r=a or g
  misc_feature 72: r=a or g
  misc_feature 315: r=a or g
aaataaaaccagggaaagcagctcagagaatknwatttgcctctaacccaactcttctacttattarrraaratatacaattattcattccgtagcactccagattgcttcactgaaagaaagaaagaaagggatccactccagggagaaagaggctcttgagctttttgttccttgatgatcctgtctttacgtaatttggtggagcctactggggaatcatcattttgggagactatggatgtgcctcattgcagaagaataagtagagagcagtgtctggaacaaatgcttgtcttaaaaaaagtttatgaratgccagcagatgtcagtgt

SEQ ID NO: 2746 - DNA, 393 bp, Homo sapiens
  CDS 165..392
  misc_feature 120: r=a or g
  misc_feature 121: n=a, g, c or t
  misc_feature 280: w=a or t
  UNSURE 39: Xaa=Glu or Val
aggaaacggatggcacagaagggactgtggagattgagacagtgaaattggcccgttctgtcttcagcaaactacacgagatttgctgcagctgggtgaaagacttccccctccgcaggrnaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagwagatgctgctatttatgcctccattcacctccacgttaacttagtccgccaggagatgttcccccatgatcctgctgaggccctgtgcagggccttccgggtcactgatgagc

SEQ ID NO: 2747 - DNA, 364 bp, Homo sapiens
  CDS 27..362
  misc_feature 18: w=a or t
aacgactcgccgcgcgtwggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgtactcggtggtgcagtggaacgtgggatcccaccaggacatcaccgaagacagcttttccctcttctggttgctggagccccggataga

SEQ ID NO: 2748 - DNA, 268 bp, Homo sapiens
  CDS 100..267
  misc_feature 40: n=a, g, c or t
tgagtatccttaaattgggtcaatcaaagaaatatttgcnaagcacctctcctctaggccatccatgaactgactaggagtgggggacaggaggggacaatgccttcagggagctcagatctgatggaagactcaaaggtaagtaatagactcaaaggtgacaagggctcttcctcaaggtatgtgccaagtgtcaccaagctacaggtggagaccatcacccgtaattttgtaccatatgtgtctttccatcaaatgaccaacagcg

SEQ ID NO: 2749 - DNA, 498 bp, Homo sapiens
  CDS 35..496
agccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacggtgaggaccctggccccgccctaacctctaagaatcattttcttggccacgcacctctgcgtgcctcgctcctcctgca

SEQ ID NO: 2750 - DNA, 409 bp, Homo sapiens
  CDS 235..408
aggcgccgtggggttcggcgcggctacgtgcagaatccgtctagctaaaatgtaatttcagattggacaagtactaacttgagagagatttgctgggataaggcgggacatttctttgatctcccggacttcttatcgtggaaggcaacaggtgtcacagcacggtctctctgctccctggtgtgtaagtggacatattcagcagagaaaggctgggacgacagtttctggaaaatgattggtttggaagactttgttgcagataattacagcaaaataggaaaccaagtgctacctcctggagcttctcttggaaatgggctcacaccagaggcagcaagagaccttggccttctccctgggattgcggtcgcagcttcactcattgatgcccatgcaggaggactaa

SEQ ID NO: 2751 - DNA, 303 bp, Homo sapiens
  CDS 123..302
  misc_feature 9: k=g or t
  misc_feature 10: b=c or g or t
caccaggakbgcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgcc

SEQ ID NO: 2752 - DNA, 393 bp, Homo sapiens
  CDS 19..393
gatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgaggtcctgtcctgggaaaggagtacaccgagaagacccccatttctgagcatgca

SEQ ID NO: 2753 - DNA, 358 bp, Homo sapiens
  CDS 53..358
actaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaacc

SEQ ID NO: 2754 - DNA, 410 bp, Homo sapiens
  CDS 118..408
  misc_feature 9: r=a or g
  misc_feature 10: d=a or g or t
  misc_feature 11: k=g or t
  misc_feature 32: w=a or t
gcattgcardkaaattgcttggatgaagatgwttccactgagagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgca

SEQ ID NO: 2755 - DNA, 249 bp, Homo sapiens
  CDS 70..249
  misc_feature 44: k=g or t
  misc_feature 45: k=g or t
ctgttttggtaccagtaccaggctgttttggttactgtagcctkktagtatagtttgaagtcaggtagcatgatgcctccagctttgttcattgggcttaggattgtcttggcaatgcgggctcttttttggttccatatgaacattaaagtagtcttttgcaactctcatcagcccagtttaatattacctatttattataatgtaatgctgctcgcacaactgagaaaatactgttgctataccccg

SEQ ID NO: 2756 - DNA, 344 bp, Homo sapiens
  CDS 25..342
  misc_feature 9: s=g or c
  misc_feature 10: k=g or t
  misc_feature 11: r=a or g
  misc_feature 12: b=c or g or t
  misc_feature 264: m=a or c
  misc_feature 283: b=c or g or t
  misc_feature 284: m=a or c
  misc_feature 286: w=a or t
  misc_feature 311: r=a or g
  misc_feature 313: m=a or c
  UNSURE 80: Xaa=Asp or Glu
  UNSURE 87: Xaa=Ala or Asp or His or Pro or Ser or Tyr
  UNSURE 88: Xaa=Phe or Ile
  UNSURE 96: Xaa=Asn or Ser
  UNSURE 97: Xaa=His or Asn
ttccattaskrbgtatatacccaaatgactaaaaatcatgctgctataaagacacatgcacacgtatgtttattgtggcattattcacagatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagamcaaaaaaaccaaacaccgbmtwttctcactcataggtgggaattgarcmatgagatcacatggacacaggaaggggactg

SEQ ID NO: 2757 - DNA, 343 bp, Homo sapiens
  CDS 66..341
  misc_feature 70: w=a or t
  UNSURE 2: Xaa=Phe or Tyr
ttccattactgggtatatacccaaatgactataaatcatgctgctataaagacacatgcacacgtatgtwtattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaaccaaacaccgcatattctcactcataggtgggaattgaacaatgagatcacatggacacaggaaggggactg

SEQ ID NO: 2758 - DNA, 322 bp, Homo sapiens
  CDS 169..321
tttttttttggagacggggtcgcgctcttgtcacccaggctggcgtgcagtgtggggatctcagctcactgcaacctccacatcctgggtcaagcaattctccattacaggcgcccactaccacgctcagctaatttttgtattttttagtagagatggggtttcaccatgttgaccagactggacctcaggcgatctgcccacctcggcctcctaaagtgctgggattacaggcgggaggatagcttgagcccaggagttcgagacctgcctgggcaatatagcgagaccccgttctccagaaaaaggaaaaaaaaaaaaa

SEQ ID NO: 2759 - DNA, 330 bp, Homo sapiens
  CDS 169..330
tttttttttggagacggggtcgcgctcttgtcacccaggctggcgtgcagtgtggggatctcagctcactgcaacctccacatcctgggtcaagcaattctccattacaggcgcccactaccacgctcagctaatttttgtattttttagtagagatggggtttcaccatgttgaccagactggacctcaggcgatctgcccacctcggcctcctaaagtgctgggattacaggcgggaggatagcttgagcccaggagttcgagacctgcctgggcaatatagcgagaccccgttctccagaaaaaggaaaaaaaaaaaaaaaaaacca

SEQ ID NO: 2760 - DNA, 331 bp, Homo sapiens
  CDS 169..330
  misc_feature 327: m=a or c
  UNSURE 53: Xaa=Lys or Asn
tttttttttggagacggggtcgcgctcttgtcacccaggctggcgtgcagtgtggggatctcagctcactgcaacctccacatcctgggtcaagcaattctccattacaggcgcccactaccacgctcagctaatttttgtattttttagtagagatggggtttcaccatgttgaccagactggacctcaggcgatctgcccacctcggcctcctaaagtgctgggattacaggcgggaggatagcttgagcccaggagttcgagacctgcctgggcaatatagcgagaccccgttctccagaaaaaggaaaaaaaaaaaaaaaaamccaa

SEQ ID NO: 2761 - DNA, 199 bp, Homo sapiens
  CDS 34..198
cttctttctataactgttttatttttgtagtacatgaaaattattttttcctttctttcagatttggagtccaggaatgagactaagcatttatctgtaggaaaagatattattcaaaacactggttctcagtgggaggtaatggaaagtagcaagttatgtggccttgaaggttccattttcagaaatgactggccaa

SEQ ID NO: 2762 - DNA, 323 bp, Homo sapiens
  CDS 100..321
  misc_feature 95: n=a, g, c or t
  misc_feature 110: w=a or t
  misc_feature 157: k=g or t
  UNSURE 4: Xaa= *  or Leu
  UNSURE 20: Xaa= *  or Glu
gaactattgttatgcttccagctgcagctgcacagtctcagagacagtggtgaaaaattaaaaacaacactggagaacgttttttaaaagcagtnagagatgacaaattwaagtacatcaggaaagaaggcctcccaggtcattgtgcaagtaaatkaaagagcatctgtgactaccattgcagaagggattcagccagaggagcaggatgtcagcagtggaacacacatcttcaagagcaagcatataaaattgcaaagaccttgtgaagctgctgtcatctccagtatgagaagtcagcagcaggcactgccagagcaatc

SEQ ID NO: 2763 - DNA, 359 bp, Homo sapiens
  CDS 130..357
  misc_feature 50: k=g or t
  misc_feature 51: k=g or t
  misc_feature 104: k=g or t
  misc_feature 105: w=a or t
  misc_feature 288: r=a or g
tgtgcggccgggttccttccgcgggacgggtgagggcgctggggccctgkkcagcgcgggctcgatgtgtgtcagccaagtagctggtcccactggagcgggakwaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggartctgttccagaccctgagctgattgatctgatctactgtggtcggaagctaaaagatgaccagacacttga

SEQ ID NO: 2764 - DNA, 381 bp, Homo sapiens
  CDS 176..379
  misc_feature 172: m=a or c
  misc_feature 173: m=a or c
  misc_feature 294: s=g or c
  misc_feature 302: w=a or t
  misc_feature 367: k=g or t
  misc_feature 381: r=a or g
  UNSURE 40: Xaa=Ser or Thr
  UNSURE 43: Xaa=Asn or Tyr
  UNSURE 64: Xaa=His or Gln
actctcagaagactggagggaaccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggammtgatgcagaactccccagaccctgaggaagaagaggaggttctggaagaagaggatggaggagaaacttcctcccaggcagactcggtcctcctgcaggagatgcaggcattgacacagascttcaacwacaactggtcctatgaagggctgaggcacatgtctgggtctgagctgaccgagctgctggaccakgtggagggtgcctr

SEQ ID NO: 2765 - DNA, 236 bp, Homo sapiens
  CDS 71..235
acaaaatctttgcaaggaggagcagcggcgtcctaggagcaagcacctggcgcccgtctccgttttaaggatggagaaacaggggcacacgaaggttaagcaacctgctcaaggtcacccagctgtgagtagtggagtggagtttgaacccagacagtccagctgtgtgtgggttctttccagcacaccacctctccccaccaccatttctgcagctcctgctctgaaccacttac

SEQ ID NO: 2766 - DNA, 280 bp, Homo sapiens
  CDS 110..280
  misc_feature 28: k=g or t
  misc_feature 36: r=a or g
aatcatccacgcacctgcagctctgctkagagagtrcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggactcctacaac

SEQ ID NO: 2767 - DNA, 427 bp, Homo sapiens
  CDS 170..427
  misc_feature 2: y=c or t
  misc_feature 123: s=g or c
  misc_feature 124: n=a, g, c or t
  misc_feature 136: n=a, g, c or t
  misc_feature 151: n=a, g, c or t
  misc_feature 271: n=a, g, c or t
  misc_feature 272: m=a or c
  misc_feature 273: v=a or c or g
  misc_feature 310: b=c or g or t
  misc_feature 311: v=a or c or g
  misc_feature 353: y=c or t
  misc_feature 355: r=a or g
  misc_feature 356: w=a or t
  misc_feature 360: b=c or g or t
  misc_feature 385: m=a or c
  UNSURE 34: Xaa=Lys or Asn
  UNSURE 35: Xaa=Lys or Pro or Gln or Arg or Thr
  UNSURE 47: Xaa=Asp or Glu
  UNSURE 48: Xaa=Ile or Leu or Val
  UNSURE 62: Xaa=Pro or Ser
  UNSURE 63: Xaa= *  or Lys
  UNSURE 64: Xaa=Met or Arg or Thr
  UNSURE 72: Xaa=Arg or Ser
cygcctacttaacagtacaacatactcaggggagattggcaccaagaaaaaggtgaaaagactattaagctttcaaagatacttccatgcatcaaggctgcttcgtggaattataccacaagsncctctgcacctnctggatgaagactancttggacaagcaaggcatatgctctccaaagtgggaatgtgggattttgacattttcttgtttgatcgcttgacaaatggaaacagcctggtaacactgttgtgccacctcttcaataanmvatggactcattcaccatttcaagttagatatggtgabvttacaccgatttttagtcatggttcaagaagattaccacagycrwaaabggtatcacaatgctgttcacgcagmcgacgtcacccaggccatgcactgctacctgaaagagccggt

SEQ ID NO: 2768 - DNA, 222 bp, Homo sapiens
  CDS 66..221
actcgtcgccgcggcggcgtccggggctggcgttcccctggaggctgggacagagggtctcacggatggccccgctgccaggagcagaactggttcggaggccactgcagctctaccgatacttgctgcgctgttgccagcagctgccgaccaagggcatccagcagcattacaagcatgctgtcaggcagagttttcgggttcattcagatgaagacaacc

SEQ ID NO: 2769 - DNA, 449 bp, Homo sapiens
  CDS 243..449
  misc_feature 264: k=g or t
  misc_feature 265: b=c or g or t
  misc_feature 269: w=a or t
  misc_feature 281: k=g or t
  misc_feature 286: k=g or t
  misc_feature 290: y=c or t
  misc_feature 291: w=a or t
  misc_feature 299: y=c or t
  misc_feature 300: w=a or t
  misc_feature 301: d=a or g or t
  misc_feature 334: r=a or g
  misc_feature 365: r=a or g
  misc_feature 391: r=a or g
  UNSURE 8: Xaa=Ala or Cys or Phe or Gly or Ser or Val
  UNSURE 15: Xaa=Met or Arg
  UNSURE 17: Xaa= *  or Lys
  UNSURE 20: Xaa= *  or Ile or Lys or Leu or Arg
  UNSURE 31: Xaa=Asp or Gly
  UNSURE 50: Xaa=Lys or Arg
agtcttcaagtaccaacagcatcagatgcacagatgacagctttacagaaactgcttagccagctcctacaattgtgtaaggtgtcaggcccatattgtgtctggagttggttcctgctggtgggttcgtggtctcgctgacttcaagaatggagctgcagaccttccaagagcaatgaagtggtgtgatgcattgcaagctatgaacaaaaggcttctcatggtgaaaccaactctaccaaatggtaaacgacagcagtaggkbtggwgaacactttcckggtakgatywagaaagaywdaggagaaaatgtgaatgcaaactgccatttagrtaatgtctgtatagctgcaaatattaataaractttaacaaaaatcagatccataaragaacctgtggctttgctacaagaagtctatagaaattctgtgacagatctttcacca

SEQ ID NO: 2770 - DNA, 282 bp, Homo sapiens
  CDS 24..281
ttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgct

SEQ ID NO: 2771 - DNA, 314 bp, Homo sapiens
  CDS 24..314
tagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgtcatt

SEQ ID NO: 2772 - DNA, 417 bp, Homo sapiens
  CDS 199..417
  misc_feature 113: s=g or c
  misc_feature 117: s=g or c
  misc_feature 122: m=a or c
  misc_feature 265: s=g or c
  misc_feature 266: r=a or g
  misc_feature 371: k=g or t
  misc_feature 372: s=g or c
  misc_feature 385: v=a or c or g
  misc_feature 392: n=a, g, c or t
  UNSURE 23: Xaa=Glu or Gly or Gln or Arg
  UNSURE 58: Xaa=Cys or Phe or Leu or Trp
  UNSURE 63: Xaa=Asp or His or Asn
  UNSURE 65: Xaa=Cys or Phe or Ser or Tyr
ctacgcgaggaagatggctgcatcccagcagcaagcttcagcggcttcctcagctgctggtgtatcgggtcctagttcggctggcggcccgggtccccagcagcagccggaasccgscaagmacaactggtgggccctgcccagagcggcctcctgcagcaacagcaacaggacttcgatcctgtgcagcgttataagatgctcatcccgcagctgaaggagagtctacagaccttgatgaaggttgcggcccaaaacttgattsrgaacactaacatcgacaatggacaaaagagcagtgatggacccatacagcgctttgacaagtgcctggaagagttctatgcactctgtgaccagctggagctgtksctgcgcctggcgvatgagtncctgtcacagagttgtgacagtgcc

SEQ ID NO: 2773 - DNA, 367 bp, Homo sapiens
  CDS 111..365
  misc_feature 277: r=a or g
  UNSURE 56: Xaa=Asn or Ser
acatttcctcccagaggtttctgacatttcttctacacggataacagattctcctaagaaggtgttggtcacaaggaagaaagatctttgtttaatccctctgaaaagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagartcatagtgaaatcgaaaggcgcagacggaacaagatgactcagtacatcacggagctctccgacatggtccccacatgcagcgactggct

SEQ ID NO: 2774 - DNA, 285 bp, Homo sapiens
  CDS 120..284
  misc_feature 16: m=a or c
  misc_feature 91: n=a, g, c or t
  misc_feature 92: h=a or c or t
  misc_feature 196: m=a or c
  misc_feature 216: d=a or g or t
  misc_feature 227: k=g or t
  misc_feature 228: s=g or c
  misc_feature 243: y=c or t
  misc_feature 268: y=c or t
  UNSURE 26: Xaa=Pro or Gln
  UNSURE 33: Xaa= *  or Glu or Lys
  UNSURE 37: Xaa=Leu or Val
  UNSURE 42: Xaa=Pro or Ser
  UNSURE 50: Xaa=Phe or Ser
attccgtgcgggacgmgctgtctcccaagggtcgggataaactagggggcggttgatctgaaagtcttagccacgactaatagtcaaccgnhcaggtgcgacccgcagcagccttggcgatgcagctcgttctccagacgcgggtccacaccggcgcgtcctcgcctccagggaccgatcgctgttctccgtggcmggtgacttggggcgccagtdagaagcaagtkstcaaagaaaacatcycgggcaaaccggctgaccgaaaatycactgtcggggtaggga

SEQ ID NO: 2775 - DNA, 352 bp, Homo sapiens
  CDS 177..350
  misc_feature 7: s=g or c
  misc_feature 8: n=a, g, c or t
  misc_feature 9: s=g or c
  misc_feature 24: s=g or c
  misc_feature 26: s=g or c
  misc_feature 152: s=g or c
  misc_feature 305: m=a or c
  misc_feature 306: s=g or c
  misc_feature 308: s=g or c
  UNSURE 44: Xaa=Asp or Glu or His or Gln
aacagasnsaggcagcagcggtasascagcagaagcagtagcaagcccggcagctgagagcaccgcagcgtcgagatgtaccatcctgcctactgggtcgtcttctcggcgacaactgccctgctcttcatcccaggagtgcccgtgcgcasggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatmsascctcgtgtgatcatcctggtcaatacaccaacccagtacagcct

SEQ ID NO: 2776 - DNA, 291 bp, Homo sapiens
  CDS 41..289
ggagcgccgaccgcaggcctctacggaccttactagaaaaatgaaacctgatgaaactcctatgtttgacccaagtctactcaaagaagtggactggagtcagaatacagctacattttctccagccatttccccaacacatcctggagaaggcttggttttgaggcctctttgtactgctgacttaaatagaggtttttttaaggtattgggtcagctaacagagactggagttgtcagccctgaacaatttatgaaatcttttgagcatatgaagaaatctggggacaa

SEQ ID NO: 2777 - DNA, 204 bp, Homo sapiens
  CDS 29..202
  misc_feature 15: k=g or t
  misc_feature 192: r=a or g
  misc_feature 193: r=a or g
  UNSURE 55: Xaa=Gln or Arg
ttcccttcccgcgtkccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcrrctggccaagat

SEQ ID NO: 2778 - DNA, 433 bp, Homo sapiens
  CDS 278..433
  misc_feature 345: w=a or t
  misc_feature 354: w=a or t
  misc_feature 407: k=g or t
  UNSURE 23: Xaa=Phe or Tyr
  UNSURE 26: Xaa= *  or Leu
  UNSURE 44: Xaa= *  or Glu
tattataaacaatatggagataattcttgtgtagatctctttgcacatgtggatgttttcagtagtgtaaaattttaaaactgtgtgctgagtcatactgaataaacacttccaattttaaaagatattgtcaaattaacctaccagcgtatattactaccagcagaatctaagagctataccctcaccaccgttagatattatcagtgtttaaaaaaaaaatctttgctagtctcatagtaaaaacatactataaaactcattgttttattttgtcatgtgtggtatttactatatctgttggccattttatttattttttctgtgtatttaccaatgtgagtwctttgcctwatttccttggaggtatttgttggttattgaagctcatgtttttatcataaatkaatttttttgtaataattgtagtagc

SEQ ID NO: 2779 - DNA, 398 bp, Homo sapiens
  CDS 206..397
  misc_feature 18: n=a, g, c or t
  misc_feature 151: s=g or c
gagcagcccgcgaggggnaagtgggagctgcgaccgcgctccctgtgaggtgggcaagcggcgaaatggcgccctccgggagtcttgcagttcccctggcagtcctggtgctgttgctttggggtgctccctggacgcacgggcggcggasaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaattta

SEQ ID NO: 2780 - DNA, 417 bp, Homo sapiens
  CDS 191..415
  misc_feature 114: y=c or t
acattcaccttgatgaggaagagacctgatggcctggctttctaatcctccagtcagtctgttgaaataaggatcacactcatctgtataatatagacatggttttagcaattycgcagttatttttctacattcactttaaatttacagaaagattgtggaagaaaaatatgaagaaaatagcaaacgaatgcaagaattgagatctcggaactttcagcagctgagtgttgatgtactccatgaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattccta

SEQ ID NO: 2781 - DNA, 440 bp, Homo sapiens
  CDS 137..439
  misc_feature 345: k=g or t
  UNSURE 70: Xaa=Gly or Val
atgctagcctctggctcctcaggggacacagccgagtggtcggaccaaacgcaacgagtcttcgccagcccaaaggcgactcgacaccgtcccagctgaagagaggcacgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggkgatcctggactactcctgggagaagctcaacacgggcacatggcaggacgtagacaaagactggcgccgggtctacgccatcggctgcctcctga

SEQ ID NO: 2782 - DNA, 437 bp, Homo sapiens
  CDS 189..437
ggttctggaaatcagggtactgggccagtcatttagccgggcgaaagtatcatatcagtgcactatatgttgtggatctgaagaagtttaggaaaatagctgctggtgacagactcaggggacagtaccaaggtctgagtcaggaccctaacagcctttcaaatcttgatcaagatctgcccaataacatgattcatcaggtgccaattaaatccctccctcaagaatggctttggtgtgaaacgtggtgtgatgacgcctctaagaaaagggcaaaaaccattgatttgtgtaataatccgatgaccaaagagccgaaactggaagcagctgtgcggattgtcccggagtggcaggactacgaccaagagatcaaacagctacagatccgctttcagaaggagaaagaaacgggagcactgtacaaagagaagaca

SEQ ID NO: 2783 - DNA, 420 bp, Homo sapiens
  CDS 184..420
  misc_feature 7: r=a or g
  misc_feature 374: m=a or c
  misc_feature 417: r=a or g
  UNSURE 64: Xaa=Ala or Glu
gaaaaaratgagagcctgttattggaatgagctgcctgactcctggatttgagggaaatgtctgattagtagacaggccccagaagctgtgaggggcactcgcacgcgaccaaggcacctgtttccaagcagcttgctcaggatctggcataccccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggmacgcccccggctgctcctccctgtgcaaagcctcgtgtgcctrgca

SEQ ID NO: 2784 - DNA, 374 bp, Homo sapiens
  CDS 33..374
  misc_feature 8: s=g or c
  misc_feature 199: k=g or t
  misc_feature 200: r=a or g
  UNSURE 56: Xaa=Gly or Val
atattctstacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccggkrccctcgcggctgcctggcccgcggctcctacaaaggcgggctagccgcccgccctctcccttgccttcctccccttcttttctgactttccctctttcccttaatcgcctgcttcttcctccgggtggacttacggccacttgctcctccgcgcttcacctcatcgcccccgga

SEQ ID NO: 2785 - DNA, 206 bp, Homo sapiens
  CDS 18..206
  misc_feature 91: d=a or g or t
  UNSURE 25: Xaa=Asp or Gly or Val
tgaaattgaagaatattatgatggaaacacatcttctaattccagacagaggagtggctggtcaagtggtcgatcaggccggtcaggccgdtcaggtggtcgatctggcggccggtcaggtagacagagtcgacaaggaagtcgctcaggaagtcgacaagatggtagaagacgaagtgggaatagaaatcgatcaagaagtgggg

SEQ ID NO: 2786 - DNA, 305 bp, Homo sapiens
  CDS 10..303
  misc_feature 26: m=a or c
  misc_feature 49: r=a or g
  UNSURE 6: Xaa=Ala or Asp
  UNSURE 14: Xaa=Gly or Arg
aagaacaagatggccgacgcggcggmcacagctggggccggtggctccrgaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacactgaatttggggtcaatctatttcccccaccctctctcctccccacccc

SEQ ID NO: 2787 - DNA, 226 bp, Homo sapiens
  CDS 45..224
aatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgaccggca

SEQ ID NO: 2788 - DNA, 348 bp, Homo sapiens
  CDS 114..347
atttttttcatcttaacagatactcatgatctcaacacatctaaaattgaacattcattatttacagctaagtcccacccattcaagtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgca

SEQ ID NO: 2789 - DNA, 382 bp, Homo sapiens
  CDS 67..381
cataatagtagtagtaatataattgtataggagagatggtccaccccataatttgaatttggtttaatgcaggttgaaggcagccataactccctgtttactagttcagtctacatagagttatgtgaggttggttcatcacctgcatggagaacacctatgtttaaagtgacatcatactttgttattattcaggccaaggtgacagaggagttagcagcggccactgcgcaggtctctcatctgcagctgaaaatgactgctcaccaaaaaaaggaaacagagctgcagatgcagctgacagaaagcctgaaggagacagatcttctcaggggccagctcaccaagtgcaggcaaagctctcagagctccaagaaaccat

SEQ ID NO: 2790 - DNA, 462 bp, Homo sapiens
  CDS 42..461
  misc_feature 7: n=a, g, c or t
  misc_feature 262: n=a, g, c or t
  misc_feature 263: n=a, g, c or t
  misc_feature 442: r=a or g
  UNSURE 74: Xaa=Ala or Asp or Glu or Gly or Val
  UNSURE 134: Xaa=Lys or Arg
agttganagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggnngagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggarggagatggcgctgctggcta

SEQ ID NO: 2791 - DNA, 337 bp, Homo sapiens
  CDS 13..336
  misc_feature 19: n=a, g, c or t
  misc_feature 175: w=a or t
  UNSURE 3: Xaa= *  or Glu or Lys or Gln
  UNSURE 55: Xaa= *  or Lys
agcgccgccgcgatggcgnaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagawaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagcca

SEQ ID NO: 2792 - DNA, 323 bp, Homo sapiens
  CDS 156..323
  misc_feature 16: v=a or c or g
  misc_feature 234: n=a, g, c or t
  misc_feature 235: n=a, g, c or t
  misc_feature 236: n=a, g, c or t
  misc_feature 237: y=c or t
  UNSURE 27: Xaa=any one of the twenty amino acids
atcttgctggtttgcvgccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgnnnytgtggctcattcaccaccgtaaacactcgcgtcccatcgtcaccgtgtgggagcgggactgcggaaagccaaaccaaacaggaagc

SEQ ID NO: 2793 - DNA, 321 bp, Homo sapiens
  CDS 156..320
catcagagactgtaagcattaacctggtttagtaaagtctttgtaatttttttcaatggctgaatacgctaaggaaaaaagaattgtttgaataggattgtgttaagagtcacactgagttattcaccattattccatgactggttaaacctacaatgtttgttctatttttcaaaaagagcaattataaacaagtttttaaagggggactcactattcacctaatgaggattcttctttttgagataaatcatttgtatactgagaaaaatgagttattttccatgagaaattctgagcaaactatagaacacaccccat

SEQ ID NO: 2794 - DNA, 315 bp, Homo sapiens
  CDS 44..313
  misc_feature 144: w=a or t
  misc_feature 192: m=a or c
  misc_feature 193: m=a or c
  misc_feature 194: s=g or c
  misc_feature 250: s=g or c
  misc_feature 263: s=g or c
  UNSURE 34: Xaa=Ile or Lys
  UNSURE 50: Xaa=Lys or Asn or Thr
  UNSURE 51: Xaa=Glu or Gln
  UNSURE 69: Xaa=Asp or Glu
  UNSURE 74: Xaa=Asp or His
tgtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagawacccaagaagctcaaggaaaacaagtgtaaagggaagcggaagaagammsaggggagcaatgatgagctatcagagaatgaagaggatctggaagagaagtcggasagtgaaggcagtsactactccccgaataaaaagaagaagaagaaactcaaggacaagaaggagga

SEQ ID NO: 2795 - DNA, 344 bp, Homo sapiens
  CDS 127..342
  misc_feature 281: k=g or t
  misc_feature 299: k=g or t
  UNSURE 52: Xaa=Gly or Val
  UNSURE 58: Xaa=Gly or Val
gggacgaattattacctcgagtcagttatatgctcttgtaagcctttagtcatatattctttgaagcagcaccttactaattaatgttttctgctttcacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgkagtccctattgtcatggktaaattattctctaagtgtattctgggtgcagagatgcatgggcc

SEQ ID NO: 2796 - DNA, 409 bp, Homo sapiens
  CDS 216..407
  misc_feature 2: k=g or t
  misc_feature 196: m=a or c
  misc_feature 197: w=a or t
  misc_feature 337: v=a or c or g
  UNSURE 41: Xaa=Asn or Ser or Thr
akgcgcggtgcactgcgcgccggcacgagggtgttttcgacgttggctgtggggaaacagcaagcggcgtggacgaccgttgctgagctggtgtggaacgtctgtgatcagattcgttgggcttttgccagctctttttagattgtcctcttgagacctgtttacagaggaatggccagaggccacaggcactgcmwcctgagaccatccacctgatgggaagaaagctagaaaagcccaaccctgagaaaaatgcttgggaacacaacagcctcacaattccgagtccagcatgtgcttcggaggccagcctggaagtgactgatttattgctcavtgctttggaaaatccagtaaaatatgctgaggacaatatggaacaaaaggacacagacagaattatttgttc

SEQ ID NO: 2797 - DNA, 466 bp, Homo sapiens
  CDS 313..465
  misc_feature 449: m=a or c
  UNSURE 46: Xaa=Asn or Thr
atagcaacgggcagccggaagatgcggccattcctctcccttttgtccattgcatttcagcagcgcccgcgcacatggacgctccaattacagctctagaggctagaaattggcagtcaggatgtgtgtaaggccacgctccctctgaagactccaggggaggatctttccttgcctcctccagcttctggtggctgccagcatccttggcattccttggcctgtggacacatcactctcatctctgcccatggtcacaaccccaagctccagaatacagaccagcaggcgaggagacaaggaggcaagcagatggatggcggaacaaagtggcagagaaagagagaagaggagagatgtctggacgccaagaggagtctggctggggccagtcagagaagagtccagcggctgggcagcccgactccaggggaagatcaccttcccamtccatcccccttcacga

SEQ ID NO: 2798 - DNA, 367 bp, Homo sapiens
  CDS 43..366
  misc_feature 4: s=g or c
  misc_feature 15: w=a or t
  misc_feature 94: w=a or t
  misc_feature 106: k=g or t
  misc_feature 294: m=a or c
  misc_feature 343: m=a or c
  misc_feature 348: r=a or g
  UNSURE 18: Xaa= *  or Arg
  UNSURE 22: Xaa=Gly or Trp
  UNSURE 84: Xaa=His or Gln
  UNSURE 101: Xaa=Ile or Leu
atcsctgcgccgggwctggagaggcttactctctcctgcgtgatgctgcagctgctgggatgccaggaggggaaccgcctgaggaaagtgctgwgagaaaagagakggagggatacagaaccgggcccagatgagtttgcgctgaatctgaagtcggtaggtccctggacatttctattatggaagccaagaagaacctcccctccaccctctgaagccagtgtggatcgggtttctggcacttgcagtgtctgcacggtctcctctccttccttctccattgccctttctcamccgcctgggcccgccaccctgaactaccgggacacatgctgttcctgcmtccargcgtgcacttcttcctgca

SEQ ID NO: 2799 - DNA, 253 bp, Homo sapiens
  CDS 36..251
cttttggggttcgctgtttcttccctctctgctggatgctgtcttgcccctggtttcccctatcctgttctccctccttgcctctgagcatcccagactgcctgcctgccttcctctggccgctggggataccctggcctgatggagagggtctaagaccttcccgtcttctccggacacgggaaaacattacccctctctctttattcgctatgctgagtggcagggagggtgccccgctcctggtccccct

SEQ ID NO: 2800 - DNA, 390 bp, Homo sapiens
  CDS 235..390
  misc_feature 272: n=a, g, c or t
  misc_feature 273: n=a, g, c or t
  UNSURE 13: Xaa=Ile or Lys or Met or Asn or Arg or Ser or Thr
agtgtggggatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggcatgaacgctgctgtccgggctgtgacgcgcatgggcanntatgtgggtgccaaagtcttcctcatctacgagggctatgagggcctcgtggagggaggtgagaacatcaagcaggccaactggctgagcgtctccaacatcatccagctgggcgta

SEQ ID NO: 2801 - DNA, 269 bp, Homo sapiens
  CDS 39..269
atatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagca

SEQ ID NO: 2802 - DNA, 397 bp, Homo sapiens
  CDS 63..395
  misc_feature 115: r=a or g
  UNSURE 18: Xaa=Glu or Gly
acaagaatcacagtgcattgataacaagtgtagtccctggggattatgatggagattctcaaatggatgtccttctgacatatcttcccaaaaattatgccaagagtgaattagragctgttatcttctggagacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgaaagc

SEQ ID NO: 2803 - DNA, 244 bp, Homo sapiens
  CDS 72..242
  misc_feature 196: y=c or t
  misc_feature 198: w=a or t
  misc_feature 203: k=g or t
  misc_feature 209: k=g or t
  misc_feature 226: m=a or c
  misc_feature 227: r=a or g
  misc_feature 243: m=a or c
  UNSURE 42: Xaa=Leu or Pro
  UNSURE 43: Xaa= *  or Lys
  UNSURE 46: Xaa=Phe or Leu
  UNSURE 52: Xaa=Ala or Glu
taagtattatactaattcccacatatgacgatttgatttcctctgttctctactattggtctgtttatcatatgatcaattttacaccatctttactgccattctttatgtcttatagggaaaatcctcttggatccccattgtgtatgtctgtaaagttttatttactttcacagcactctcatacttttgtacycwaactkgttttkggatcacacacacctgmrgacacagagacacacmc

SEQ ID NO: 2804 - DNA, 295 bp, Homo sapiens
  CDS 41..295
agtttgctctctgtgtctttttcctgccactgagtaagggatgatcttcacacacatgccccactccgcccccatctcggcgcaccgtttctccaggaaggtaagggggctgcccacgctgatccccttcgtgactacaggtgcccagagcctacggaatagtccggttgttgtaatgacagcggggtcagagggaggcgagggatcacagcctcgagtctcgggacgcaaagcccagcagggctctctgcggctcagggccagctggagagtagagaaaaaggctgccgaagac

SEQ ID NO: 2805 - DNA, 410 bp, Homo sapiens
  CDS 135..410
  misc_feature 263: w=a or t
agctgatcccgcggacccactgggttgccaagctcgcgccggatgcggaggcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgtwttgcaggcagccctcggagtgaaacatggagttcttctgactgaagatggtgaggtctacagctttgggactcttccctggagaagtggaccagtggagatttgtccaagtagccccattctagaaaatgccctggttgggcaatat

SEQ ID NO: 2806 - DNA, 361 bp, Homo sapiens
  CDS 77..361
tgagatgcgatgctgacggaggagctacagcagactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccagacccaa

SEQ ID NO: 2807 - DNA, 335 bp, Homo sapiens
  CDS 23..334
agcgcttgtgcaaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttc

SEQ ID NO: 2808 - DNA, 209 bp, Homo sapiens
  CDS 42..209
atcaccatggccagctatccttaccggcagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacggt

SEQ ID NO: 2809 - DNA, 315 bp, Homo sapiens
  CDS 79..315
  misc_feature 31: r=a or g
  misc_feature 32: r=a or g
  misc_feature 112: k=g or t
  misc_feature 204: r=a or g
  misc_feature 205: r=a or g
  misc_feature 206: k=g or t
  misc_feature 207: k=g or t
  misc_feature 267: k=g or t
  misc_feature 268: k=g or t
  UNSURE 12: Xaa=Leu or Val
  UNSURE 43: Xaa=Gly or Ile or Met or Arg or Ser or Val
  UNSURE 64: Xaa=Cys or Gly
atcaagaattgttttagaaagacaatatttrraacaccgcactgccaatatattgatcctttatagttatttcctaaaatgctgttttcgaaacattcctttttcaccctgktgtgtggcttagacccatctcgtaatctgttaattggaaagaggctacagacaccagcagtgtgcgttctgcaggtacacgctgccaaagtrrkkcctgctcatccatgccctgtctctgtctcttttagagtcataccttatttgagtataggkkgcttaattttgctagacttcctgaaaacactaaggtggagtatcaga

SEQ ID NO: 2810 - DNA, 272 bp, Homo sapiens
  CDS 61..270
  misc_feature 114: s=g or c
  misc_feature 116: r=a or g
  UNSURE 18: Xaa=His or Gln
  UNSURE 19: Xaa=Gln or Arg
aagcagagcccacccatcgtgaagatcctgaagtttggctggttcccaatcatcctggccatggtcatcagcagtttcggaggactcatcttgagcaaaaccgtttctaaacascrgtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttc

SEQ ID NO: 2811 - DNA, 237 bp, Homo sapiens
  CDS 73..237
  misc_feature 116: r=a or g
  misc_feature 123: r=a or g
  UNSURE 15: Xaa=Lys or Arg
gtcttctcccatcacatcagtgctccctgtcttgacatcctgctttattttttcaacagagcacatatcaccatgagaaatcagcatgagaagatgatcaaaattcatatattgaracatgaraaggctctgaatgggttggatgatgccctcccatattgcggtggccaatatgctttactcagtctacagattcaaatgctaatctcttctggaaacaaactcacagacacacct

SEQ ID NO: 2812 - DNA, 478 bp, Homo sapiens
  CDS 154..477
  misc_feature 12: s=g or c
  misc_feature 13: y=c or t
  misc_feature 244: h=a or c or t
  misc_feature 245: n=a, g, c or t
  misc_feature 262: v=a or c or g
  misc_feature 263: v=a or c or g
  misc_feature 280: v=a or c or g
  misc_feature 281: w=a or t
  misc_feature 351: r=a or g
  misc_feature 362: m=a or c
  misc_feature 408: s=g or c
  UNSURE 31: Xaa= *  or Lys or Leu or Met or Pro or Gln or Arg or Ser or Thr or Trp
  UNSURE 37: Xaa=Ala or Asp or Gly or His or Asn or Pro or Arg or Ser or Thr
  UNSURE 43: Xaa=Asp or His or Ile or Leu or Asn or Val
  UNSURE 70: Xaa=Ala or Asp
  UNSURE 85: Xaa=Asp or Glu
attcgcattgcsyttctgtgattattctccctggcttgcgttctgaagcacgaatctttccggatgtagtaactggcttcctaaagctttggggggactgtggtccccgaagctgccggctgcctgacctaagatttacgagtggttccaaggatgagacaaggtcccagtgtctcggtgacaacagggtctttgacgaacggctgccgagttgcagctggggagggggaagaggactgtggchngggcggggagcccctgvvtttcttccttgtaggavwtgggcgccggggcacgggcaggcagccccgcaggccatcagcatgcaggagcggcgcgccgtccttgaarggctgcccggmtgaccttgctccgctttctcgggagaaatcgctaggagagcgcgasgacgcggccacgatggtgactcagtgccctgcgcgccgcacgcaaatgctcccttccatcaagtccagct

SEQ ID NO: 2813 - DNA, 293 bp, Homo sapiens
  CDS 25..291
aaatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttt

SEQ ID NO: 2814 - DNA, 264 bp, Homo sapiens
  CDS 23..262
atcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaaagtcaagtatttgacatttcgatttatatttgctcttaggctttctaaaaaacagaagaaaaagaaacagaaaccagcacagaa

SEQ ID NO: 2815 - DNA, 295 bp, Homo sapiens
  CDS 19..294
gttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggccaaa

SEQ ID NO: 2816 - DNA, 375 bp, Homo sapiens
  CDS 185..373
  misc_feature 321: n=a, g, c or t
  UNSURE 46: Xaa=Lys or Met or Arg or Thr
agcatttttcctttctctttctcttaaataaaccattagcaacttttcaaaacaagaaaggaaaaaaataaggacagggtcaggttgccacaaagacctttggcccccatcctcatcaccctgtggcctccccaggcctggtggacaacagggatactggagctgcaggccaggctgccgcctgatgccaggggccccgtgctctcaggctggccaggaaggcaggtgccctgcacaaggcctgtggtatgttttcaccggggccaccagcggcaggggcagggacaggctggccaactcaaaagaagccaggagtgaganggtttgcttctcctttccttccaagagcactggaaaactggaaggaagtccaaa

SEQ ID NO: 2817 - DNA, 336 bp, Homo sapiens
  CDS 173..334
accagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgccccagcaccagtgca

SEQ ID NO: 2818 - DNA, 351 bp, Homo sapiens
  CDS 188..349
  misc_feature 20: s=g or c
  misc_feature 250: k=g or t
  misc_feature 251: r=a or g
  misc_feature 322: r=a or g
  misc_feature 323: r=a or g
  misc_feature 337: m=a or c
  UNSURE 21: Xaa= *  or Tyr
  UNSURE 22: Xaa=Ile or Val
  UNSURE 46: Xaa=Asp or Asn
  UNSURE 50: Xaa=Asp or Glu
gccgagtcctggaagcggastccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactakrttggaggaagtcattatgttatacagcctcatgatgatactgaggacagcatgaatgatcatgaagacacrratggttcaaaagamagtttcagagaatt

SEQ ID NO: 2819 - DNA, 353 bp, Homo sapiens
  CDS 89..352
  misc_feature 232: s=g or c
  misc_feature 236: n=a, g, c or t
  UNSURE 48: Xaa=His or Gln
  UNSURE 50: Xaa=Ala or Pro or Ser or Thr
gaaaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcastgcncccgctacctcatgggggagacgcagctgtgcaccacaaggaaactggatataggatttcgttgcaacgctattaaagttccaaaccaggagtgtgcagcactggaaaaggagatca

SEQ ID NO: 2820 - DNA, 415 bp, Homo sapiens
  CDS 69..413
ataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacct

SEQ ID NO: 2821 - DNA, 331 bp, Homo sapiens
  CDS 38..331
  misc_feature 230: m=a or c
  misc_feature 303: s=g or c
  misc_feature 314: m=a or c
  UNSURE 65: Xaa=Lys or Gln
  UNSURE 89: Xaa= *  or Ser
  UNSURE 93: Xaa=Ile or Leu
caacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcgmagttgacccgtccatcgctgtggggtttttctgtaagactgaagatgacttcaatgattggtgccagcaagtsaaaaagctgtmtctgcttggaggtcccc

SEQ ID NO: 2822 - DNA, 327 bp, Homo sapiens
  CDS 137..325
  misc_feature 271: s=g or c
acactctgtctgcacttccctgaggaagaggcacctggcgcgtgccgctctcctcccaggcttgtggtggacattctcaagcaagtcattctggctccgcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggsaaagtcttcctcccagtcttctatagcctgatttttgtgttgggcctcagcgggat

SEQ ID NO: 2823 - DNA, 212 bp, Homo sapiens
  CDS 8..211
agaagccatgaaggggagggagaggtcacatgtgtcggtgccacagactgagtcacgtggcagtaggagactgctaggcgccaggaaccaaggctcaagcttaggtctaagcatgaactggagcaggaacgcttcgccctttggaatgtgtgtggacaagaatgtgagcagaaagtttgccgacccctgctccaggttagagaagagcaaca

SEQ ID NO: 2824 - DNA, 371 bp, Homo sapiens
  CDS 183..371
atagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagtgagttctccaagaacatcagattccctcagtagatcaaaaaatagcccc

SEQ ID NO: 2825 - DNA, 386 bp, Homo sapiens
  CDS 113..385
  misc_feature 8: v=a or c or g
  misc_feature 173: r=a or g
  misc_feature 177: r=a or g
  misc_feature 366: r=a or g
  UNSURE 21: Xaa=Glu or Lys
  UNSURE 22: Xaa=Lys or Arg
  UNSURE 85: Xaa=Lys or Arg
ctattttvaggacaattatcagtcaacacttggaatttcttagcttttaaacttttcagcctcctttcacttagaaatgttggcacaccagttaacttccgagtagtgcagtatgttatatgtcacactactgactttatttaatttccagctcctataccatttagaaagaragaraaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagagatgcaaaaragaaactgaggcttgctctt

SEQ ID NO: 2826 - DNA, 292 bp, Homo sapiens
  CDS 53..292
  misc_feature 7: s=g or c
  misc_feature 134: n=a, g, c or t
  UNSURE 28: Xaa=Ala or Pro or Ser or Thr
agaaccscgcgtgatcctgaaccggagcccgagcctgctgcagagtgtcagcatgctgcgcttcctggcaccccggctgcttagcctccagggcaggaccgcccgctactcctcggcagcagccctcccaagcnccattctgaacccagacatcccctacaaccagctgttcatcaacaatgaatggcaagatgcagtcagcaagaagaccttcccgacggtcaaccctaccaccggggaggtcatcgggcacgtggctgaaggtgaccgggctgatgtggatcggggcgct

SEQ ID NO: 2827 - DNA, 170 bp, Homo sapiens
  CDS 18..170
cccctggagccctgaccatggaactcgcacttttcgatctggacaacaccctgctttccggcgattcggacttcgaatgggctcaattcctcatcggcaagggggtactcgaccgggagatccaggaagccaagaacatcgagttctacgagcagtacaaggccggcccc

SEQ ID NO: 2828 - DNA, 229 bp, Homo sapiens
  CDS 41..229
  misc_feature 3: n=a, g, c or t
  misc_feature 36: r=a or g
  misc_feature 54: r=a or g
  misc_feature 186: m=a or c
  misc_feature 227: k=g or t
  UNSURE 5: Xaa=Asp or Gly
  UNSURE 49: Xaa=Asn or Thr
  UNSURE 63: Xaa=Phe or Val
gantgaatctgtgaaatctgtcagagcctccaccartaccatggagctcccagrtaccaatggtgctggggtaaaaagccaaaggccctttagccccagagaggcgttgcggtctagagccatcatcaaacctgttattgttgataaggatgtgaaaaaaatcatgggaggatctggaacagagamtacgttggagaaacagaaacccgtctccaaaccagggccaktt

SEQ ID NO: 2829 - DNA, 375 bp, Homo sapiens
  CDS 81..374
  misc_feature 254: r=a or g
  misc_feature 255: s=g or c
  UNSURE 59: Xaa=Asp or His
gttactgtgtctatgcagaaagaagaagacataagaaactccattttgttctgtagtaagaaaaattcttctgccttgagatgctattaatgtgtaacgctagccccaaccctgtggtcacagaaatatttgctgtgttgactcaaggtttaatggatatagggctgtgcaggatgtgctttgttaaaaatgtgtttgcacgcagtatgcttggtaaaagtcatcacccttctctggtctcaagtacccagggrsacaatgcactgtcgaaggccacagggacctctgcccaagaacgcctgggtattgtccaaggtttctccccactgagacagcctgagacatggcctcgtgggaagggaaagaccttaccgt

SEQ ID NO: 2830 - DNA, 346 bp, Homo sapiens
  CDS 161..346
  misc_feature 3: r=a or g
  misc_feature 4: m=a or c
  misc_feature 70: m=a or c
  misc_feature 172: r=a or g
  misc_feature 302: k=g or t
  misc_feature 303: r=a or g
  misc_feature 304: w=a or t
  misc_feature 305: r=a or g
  misc_feature 314: w=a or t
  misc_feature 315: r=a or g
  misc_feature 335: n=a, g, c or t
  misc_feature 336: w=a or t
  UNSURE 4: Xaa=Ile or Met
  UNSURE 48: Xaa= *  or Cys or Asp or Glu or Gly or Tyr
  UNSURE 49: Xaa=Glu or Lys
  UNSURE 52: Xaa= *  or Lys or Arg
  UNSURE 59: Xaa=Asp or Phe or His or Ile or Leu or Asn or Val or Tyr
ttrmctattttcatttttaagaagaaaaacaccactcattttataaaatatagtacagctactataaggmttgtttgatcccaaatggtgcttatcttgattgaacattcagaacaaggatattattttcagtgattttgtgagatcagctgaaccacttatgataataatrataaaaaagactgctttgccctcacgtcagttgtacatggcatggaactttaaaaattttaatataaactttcatccagttagcttcataacttttacgttccagaattttgtttattttcctgtcaatkrwragcattttwraagataccagtgggacaggnwtggtttttta

SEQ ID NO: 2831 - DNA, 277 bp, Homo sapiens
  CDS 106..276
caattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgta

SEQ ID NO: 2832 - DNA, 230 bp, Homo sapiens
  CDS 56..229
cttttctttttttgagacggagtcttgttctgtctccaggctggagtgcagtggcatgatctcagctcactgcaacttctgccttccaggttcaggcgaatctcctgccacagccacccaagtagctgggactacaggcgcgtgccaccacgcccagctaatttttgtatttttagtaaagacggggtttcaccatgttggccaggatggtctcaatctcttgaccacat

SEQ ID NO: 2833 - DNA, 256 bp, Homo sapiens
  CDS 83..256
  misc_feature 4: m=a or c
  misc_feature 87: v=a or c or g
  misc_feature 215: m=a or c
  UNSURE 2: Xaa=Lys or Arg or Thr
  UNSURE 45: Xaa=His or Asn
tcamgaaattaaggacatttatggactaaatggacaaatagagcacaaactagctttcctgagaactcatgtgccaaaggacatgavacttgtgctcattggccattcaataggcagctatttcacacttcagatgctgaagcgagtccctgagctcccggtaattcgtgcctttctgctctttccaacaattgaacgaatgtctgagtcacccmatggcagaattgccactccacttttgtgctggtttcgatat

SEQ ID NO: 2834 - DNA, 239 bp, Homo sapiens
  CDS 75..239
  misc_feature 65: m=a or c
  misc_feature 90: m=a or c
  misc_feature 96: r=a or g
  misc_feature 150: m=a or c
  misc_feature 157: m=a or c
  misc_feature 194: m=a or c
  UNSURE 6: Xaa=Lys or Gln
  UNSURE 8: Xaa=Gly or Ser
  UNSURE 26: Xaa=Lys or Gln
  UNSURE 28: Xaa=Lys or Thr
  UNSURE 40: Xaa= *  or Tyr
tatcaaaaagacacacacatttgcatgttcatgggagtgctactcacaggaataaagacgtggamctgacctagatgcccaccaacagamaatcargtgtttttaaatgtgatacctatacaccacagaatactaagaagccaccaaggmaaatcamacacagaaacaaaatcatgccctcagcagcaacatamgatagaactgcaggccactctgctaagcgaactcaggcaagaaca

SEQ ID NO: 2835 - DNA, 252 bp, Homo sapiens
  CDS 61..252
  misc_feature 7: s=g or c
  misc_feature 8: y=c or t
  misc_feature 147: r=a or g
gcacagsyattgaagatcttcctgaagaagacaggaagagatgctcaggtcagggagggaatgagacccctggggaagggactcctcccagctgaggagttgattagaagcaatcttggagttggcaggagccttagagactgcctragccagtccgggaagctggctgaggagcttgggagcaagagactaaaaccagccaagtttgggacagaagggaaggaaagggttgagcagcgaacagagagaccg

SEQ ID NO: 2836 - DNA, 283 bp, Homo sapiens
  CDS 78..281
ctcatttagacattcatacacatatggaatatttgtttctttacaaactaaaatggagtaatatggtctttgtttaaatgccacctcctcagagaaattcattcttttttattatttatttatttaataatagagatgaggtttcaccatgttgcccaggctggtgtcaatctcctggactcaagcaatccatctgccctggttccccaaagtgctgggattactgccgtaagccaccatacctggccaagaaattcattcattttttttttttttttttttt

SEQ ID NO: 2837 - DNA, 266 bp, Homo sapiens
  CDS 86..265
ttaaaatcccctctgtactactcagaaatataagcaagttattatggtgcccagaaagggggaaaaggttccagagtcctaggagatgacaaggatttatcctcttcatctttctccgatcccagttagcaggaatactttagcctggaaggtgagtgtgcccctaaccaacctttacagatgggtgactgtttgggagcttatggctcactccttctctttaaagcagatgcattctggcaagctgcagcagcaaacctaccccg

SEQ ID NO: 2838 - DNA, 277 bp, Homo sapiens
  CDS 42..275
  misc_feature 7: m=a or c
  misc_feature 8: n=a, g, c or t
  misc_feature 9: n=a, g, c or t
  misc_feature 15: s=g or c
  misc_feature 25: s=g or c
  misc_feature 133: k=g or t
  misc_feature 139: s=g or c
  UNSURE 31: Xaa=Ile or Ser
  UNSURE 33: Xaa=Pro or Arg
gaacctmnnggtgtsatccgcgggsaaagaacttggtcctgatgtctgaccatggagatgtgagcctcccgcccgaagaccgggtgagggctctctcccagctgggtagtgcggtagaggtgaatgaagacaktccacsccgtcggtacttccgctctggagttgagattatccgaatggcatccatttactctgaggaaggcaacattgaacatgccttcatcctctataacaagtatatcacgctctttattgagaaactaccaaaacatcgaga

SEQ ID NO: 2839 - DNA, 290 bp, Homo sapiens
  CDS 82..288
  misc_feature 7: m=a or c
  misc_feature 101: k=g or t
  misc_feature 102: v=a or c or g
  misc_feature 103: r=a or g
  misc_feature 126: r=a or g
  UNSURE 7: Xaa=Leu or Arg
  UNSURE 8: Xaa=Ala or Thr
agttgamgcgctgggggcagctgtagtgggagtgttccaggattcgccttgtatatttaaagttggagttcgttgctaaagatggcagacccagatgtcckvrctgaagttccagcagcattgaarcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaa

SEQ ID NO: 2840 - DNA, 241 bp, Homo sapiens
  CDS 39..239
  misc_feature 7: h=a or c or t
  misc_feature 8: v=a or c or g
  misc_feature 9: m=a or c
  misc_feature 120: m=a or c
  misc_feature 123: s=g or c
  misc_feature 128: m=a or c
  UNSURE 28: Xaa=Leu or Met
  UNSURE 29: Xaa=Leu or Val
  UNSURE 30: Xaa= *  or Cys
ttcccthvmgtcctttagtatgtgcagtactggacctgatggtagagtttattgtaacacacatgatgaaggagtttcctatggatctctatatacgctgcatccaggtagtacacaaamtgstctgmtaccagaagaagtgtcgggtacgcctgcattacacctggcgggagctctggtcagccttgataaatttgctgaagttccttatgtcaaatgagactgtacttttggccaaacc

SEQ ID NO: 2841 - DNA, 418 bp, Homo sapiens
  CDS 253..417
  misc_feature 294: n=a, g, c or t
  misc_feature 295: n=a, g, c or t
  misc_feature 346: m=a or c
  UNSURE 14: Xaa= *  or Cys or Trp
  UNSURE 15: Xaa=Cys or Gly or Arg or Ser
  UNSURE 32: Xaa=Pro or Thr
taaaataggaatggctgtggtgcctacctcacaggtacctgactgcaagagtgaagtgagatgaagcttgtaacatgccagcactgtgtctggcccacagtagccacttgtcagtgtgtgatggtgtagctggcaggaacgtgtggacagtggtatggtgcggtcagactgagcgtacagagcaatgggagagataagctaactgagttagccaggtgtgtgggtatccagcagtgtgtgttgaacacctgtatgcaaagtcctgcctggaagctctgttcagggaacttctgnngccgtcctggctacagttgcagagccaggacggcctcagaagttcctggamcagagacaaaggcacgcagacttagtgttcatgtgtgcatatgtgtgcttgtatgtgtgtgtgtgtgtgaat

SEQ ID NO: 2842 - DNA, 328 bp, Homo sapiens
  CDS 71..328
  misc_feature 68: r=a or g
  misc_feature 139: m=a or c
  misc_feature 245: m=a or c
  misc_feature 246: r=a or g
  UNSURE 59: Xaa=His or Asn or Arg or Ser
tagtcctgcttctcttccctctctcctccagcctctcacactctcctcagctctctcatctcctggarccatggccagcacatccaccaccatcaggagccacagcagcagccgccggggtttcagtgccagctcagcmaggctccctggggtcagccgctctggcttcagcagcgtctccgtgtcccgctccaggggcagtggtggcctgggtggtgcatgtggaggagctggctttggcagcmrcagtctgtatggcctggggggctccaagaggatctccattggagggggcagctgtgccatcagtggcggctatggcagcaga

SEQ ID NO: 2843 - DNA, 262 bp, Homo sapiens
  CDS 52..261
  misc_feature 243: y=c or t
  misc_feature 244: w=a or t
  UNSURE 65: Xaa=Ser or Thr
ttccctgccctccaacccccggctctgtgaggctgagttattaggtctaggatggggccctggaaactgcattttaagaaaccctctgggggattcagaatattctttgggcttggccatctggtaagaatctctgggggagataacatctcagctgaactctgcaatccaagctggttccctcactgtctctggaacttttcttgctctttcccacctccacagctttgccctggcagtgcywccccctctaacgcccaac

SEQ ID NO: 2844 - DNA, 259 bp, Homo sapiens
  CDS 28..258
taccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaaag

SEQ ID NO: 2845 - DNA, 258 bp, Homo sapiens
  CDS 67..258
  misc_feature 39: r=a or g
  misc_feature 43: s=g or c
  misc_feature 44: k=g or t
  misc_feature 150: w=a or t
  misc_feature 151: r=a or g
  misc_feature 170: w=a or t
  misc_feature 171: k=g or t
  UNSURE 29: Xaa=Glu or Lys
  UNSURE 35: Xaa=Asp or Glu or Val
gctcggcgctccgccggccgccctgcgtacgctcgcaargcgskcgcagactccggagtcgccaacatgtcgaccgccatgaatttcgggaccaagagcttccagccgcggcccccggacaagggcagcttcccgctggatcacttaggwraatgtaaaagctttaaagwkaaattcatgaagtgtcttcataacaataattttgaaaatgctttgtgcagaaaggaatcaaaagaatatttagaatgctggatagag

SEQ ID NO: 2846 - DNA, 269 bp, Homo sapiens
  CDS 34..267
  misc_feature 19: b=c or g or t
  misc_feature 20: k=g or t
actcttccatctcccaatbkcaagctgtggccgatgatcactctcttgcctctattcacggattgttctattaaaactacttattatcagcattctgggccctcctctttttgctctccagcccactgtcccctgaggctgacaaggcacgctggtcccctctgcctcttcaccttctcatcaaatgaagctcctcgggggctcctgtggcacccgcctgtcccccagctcctctgcccaccctcttgccggcttcccgctccccccgt

SEQ ID NO: 2847 - DNA, 361 bp, Homo sapiens
  CDS 208..360
  misc_feature 21: b=c or g or t
  misc_feature 121: r=a or g
  misc_feature 191: r=a or g
  misc_feature 251: k=g or t
  misc_feature 311: s=g or c
  UNSURE 15: Xaa=Cys or Phe
  UNSURE 35: Xaa= *  or Ser
ctacaataactcagtttgctbcttaaattccaaactctgggaagttgataaataacttccatgatcacttgtaaaagttacatgcacatctgaaaaaaaatcacaaatctctatgacagtrggttatgttttgagcttgttaccttgcagtattcttctctgttccataggtgaaaacaaagggtgacagrggttatcaggcaggaaatgcctaaatacatacatctctgcatggtacaatttctcatatkcatgtattccataaacagtgttttttctctgtttaagcagactgttgtttcttctgagtsagtgatatgtgatcttcgttggtttcattttgtgaagctcagtctgtcag

SEQ ID NO: 2848 - DNA, 448 bp, Homo sapiens
  CDS 8..448
aaccgatatggcggcgactctgggcagcggggagcgctggacggaagcttacattgacgcagttagaagaaacaaatacccagaagacacacctcctgagagtcatgacccctgtggctgctgtaactgcatgaaggcacaaaaggaaaagaagtctgagaatgagtggactcagacccggcagggtgaggggaactccacgtacagtgaggaacagctgcttggggtacaaaggatcaagaaatgcagaaattactatgaaattctgggagtttctcgagatgctagtgacgaagagcttaagaaagcttacagaaaactcgccctgaaatttcaccctgacaagaactgtgctcctggagcaacagatgctttcaaagcaataggaaatgcatttgcagtcctgagcaatcctgataagagacttcgctatgatgaatacggagat

SEQ ID NO: 2849 - DNA, 348 bp, Homo sapiens
  CDS 192..347
  misc_feature 20: s=g or c
tataaaatatgtgctacttsacttacattattaaatatgtattaacgcctctcaccagggcttccagtgaagttacaatgccctagtctgtgaattagtctggaaacgtgtttttccttttcggatgttagagtaccctttgataaactaaattttactaagctgaacaactctgacagtctaaagagctaatgtgggttaccaaaaggcctgtacctgtaaaacaaaatgcaggtgtaatgattatacatgtctatggattacctggacatactctcatttgggttgttcttcaaagaagcaagcagccgatccctgttttcataaagctaatacttcagttggaaa

SEQ ID NO: 2850 - DNA, 398 bp, Homo sapiens
  CDS 124..396
  misc_feature 89: k=g or t
  misc_feature 352: v=a or c or g
  UNSURE 77: Xaa=Asp or His or Asn
attgttggaaggacagaaagtgatagcggtcaaagctgctgctgggctactgcagacaaaggttgtccgggtgccaaaaagcatgagtktctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaatvatgacaaatccatctccgtacaagaactgatgggctgcctgggcgt

SEQ ID NO: 2851 - DNA, 316 bp, Homo sapiens
  CDS 23..316
  misc_feature 242: s=g or c
  UNSURE 74: Xaa=Leu or Val
agaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcstcaaacgaaaagagaattgtacactgcaggcagtctgggctcttggcaacattgctggagatagtaccatgtgc

SEQ ID NO: 2852 - DNA, 199 bp, Homo sapiens
  CDS 35..199
atttggttaagattgtttataatgtttatttctcatgcttcttatgcattatcttttgcctaaagattttccttctaggaaagtttattttgatcggctcgtatgtggattctgtgggatcctaaatcacttttctgtaacatactccccatcactcccaactggacccacctcaaaaaagaacctaaaactcagtcac

SEQ ID NO: 2853 - DNA, 404 bp, Homo sapiens
  CDS 219..404
  misc_feature 47: y=c or t
  misc_feature 48: k=g or t
  misc_feature 80: y=c or t
  misc_feature 81: w=a or t
aagcggaacttctctctccagctgtgtctcttagcaactaagccccykgctcctccagaagcccctcttcgcacatgcgywaactgcggacggggaactgggctccctagccctggcgtttttggtgttgctgtcccagccagaatcgcgtctggccggtgggaagccgggaactccagccccctgtaggagaggagaaaggagcgagatcatgatacatggtgatggcttgcagagtcgtaaacaaaagaagacacatgggacttcaacaactttcatcattcgcggaaacaggaagaactttcctagacccactaaaatcatccaaatttattatagatgaagaatgtcatgaaagtgtattaatcagttcaacagtaaggcttcttgaaagtttggattta

SEQ ID NO: 2854 - DNA, 509 bp, Homo sapiens
  CDS 61..507
  misc_feature 89: k=g or t
  misc_feature 90: s=g or c
  misc_feature 93: n=a, g, c or t
  misc_feature 411: r=a or g
  misc_feature 413: h=a or c or t
  misc_feature 417: y=c or t
  misc_feature 453: k=g or t
  misc_feature 480: k=g or t
  UNSURE 10: Xaa=Leu or Arg
  UNSURE 118: Xaa=Ala or Glu or Val
  UNSURE 131: Xaa=Lys or Asn
aggcagtcccggcgcggggcaaccacagcgctcaggaggccctgagtccggcacctggccatgtgcaaccctgaggaggcagctctgcksggnctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaarghagcyaagaggagaagcgagttctggcggggccagcggaakgcgctgcggcagctgctttcaggtgtkagctcagagggctcggtgggcgcatcgct

SEQ ID NO: 2855 - DNA, 185 bp, Homo sapiens
  CDS 28..183
cttgaggtagaaaattgatgcccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgccg

SEQ ID NO: 2856 - DNA, 224 bp, Homo sapiens
  CDS 65..223
  misc_feature 43: w=a or t
  misc_feature 44: w=a or t
taaatgtgattgcaacgcgacacttattctccttgcacaacawwtgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagaccag

SEQ ID NO: 2857 - DNA, 435 bp, Homo sapiens
  CDS 266..433
  misc_feature 47: k=g or t
  misc_feature 48: r=a or g
  misc_feature 103: k=g or t
  misc_feature 104: w=a or t
  misc_feature 105: w=a or t
  misc_feature 331: r=a or g
  misc_feature 358: r=a or g
  misc_feature 363: r=a or g
  misc_feature 379: k=g or t
  misc_feature 391: h=a or c or t
  misc_feature 396: k=g or t
  misc_feature 401: r=a or g
  UNSURE 33: Xaa=Lys or Arg
  UNSURE 38: Xaa=Asp or Glu
  UNSURE 42: Xaa= *  or Cys
  UNSURE 44: Xaa=Ile or Ser
  UNSURE 46: Xaa=Asp or Asn
aatatttccatgttattattttcaagttccactttcacaataattgkrgtattatatatgtagcatttgacacttgaaaaaatggtgatgctgatagaaaagkwwattttttttatctgcacatgtggaatttctcatgggacagggtttttattaggtttcccacactgtaatattttggtttctttctttggaatatttctctgaacactgaagtacatagttgattctcagtttaatcagcacgtctttattaaacacttccatgtttcagggccctgtaatcagatttgaggtttataaatgcttctggtaccaggacctatctgcratagccagggcttgttggtgtcctggrataarattacagacgacagakcactgtgtatghagtaktaggractactgtgaaattcatggtatctggctggactt

SEQ ID NO: 2858 - DNA, 435 bp, Homo sapiens
  CDS 121..435
ctttcacttcctgttccttcagaaagcgctgtgccttggaccaaccttacttcttactattgacagctcagctaactcctattcatccttcaaaacccatctctggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccagagcaggggcacagcccacaaagcatggcttctgtgaagacccagggggctatcgccttccattggctcagcttgggagaagcgatcggggatcttgccccagccagaggctacagtggcccgggaaggagcctcagtca

SEQ ID NO: 2859 - DNA, 330 bp, Homo sapiens
  CDS 128..328
  misc_feature 300: w=a or t
  misc_feature 301: h=a or c or t
  UNSURE 58: Xaa=Asp or Glu or Val
gatttttgtaccagaaatctcagtgtaatgaaaaagtatctgtgtacctgaaaatattattgctagaaaactgtctgaaaacaatttgtgactcatcttcctcttgtttctgaaggattgcttatggatgcccaaatgcgttaagttcggatggtttctgccctatactccaacagataatgagtatggtgcttggaagcgccattacattgcttgtgtgtcccacttagactggctgacacctagggaggctgctgctacttatgggacgctgaatgaacccaaaacagaagatgaggwhctactggagagacaaagagaaaagtgcct

SEQ ID NO: 2860 - DNA, 195 bp, Homo sapiens
  CDS 43..195
gataagtgattgagactgtctgtgaatcatggatacttggacatgctgagcctggggaagaatcaccctggactgatgcccgaaccgaataggcctgatccagctggcctttccaggtctcaagtacaaaccgatggcacggatctctctggacaccacagggatgtggaggcgagagtgaagtcttggagcact

SEQ ID NO: 2861 - DNA, 275 bp, Homo sapiens
  CDS 44..274
  misc_feature 65: v=a or c or g
  misc_feature 66: m=a or c
  UNSURE 8: Xaa=Ala or Asp or His or Asn or Pro or Thr
aaaacatggcggtaggctgggaccataacacaagcatgactatatgaaggaagaggaaggttttvmtgaagatgaggcgactgaatcggaaaaaaactttaagtttggtaaaagagttggatgcctttccgaagttcctgagagctatgtagagacttcagccagtggaggtacagtttctctaatagcatttacaactatggctttattaaccataatggaattctcagtatatcaagatacatggatgaagtatgaatacgaagtagacagtg

SEQ ID NO: 2862 - DNA, 278 bp, Homo sapiens
  CDS 53..277
  misc_feature 72: r=a or g
  misc_feature 76: k=g or t
  misc_feature 78: m=a or c
  misc_feature 88: m=a or c
  misc_feature 103: w=a or t
  misc_feature 121: w=a or t
  misc_feature 122: w=a or t
  misc_feature 129: w=a or t
  misc_feature 158: w=a or t
  misc_feature 177: w=a or t
  misc_feature 178: y=c or t
  misc_feature 185: w=a or t
  misc_feature 217: m=a or c
  misc_feature 229: w=a or t
  UNSURE 7: Xaa=Gln or Arg
  UNSURE 8: Xaa=Arg or Ser
  UNSURE 9: Xaa=Ala or Glu
  UNSURE 12: Xaa=His or Gln
  UNSURE 23: Xaa= *  or Cys
  UNSURE 24: Xaa= *  or Lys
  UNSURE 26: Xaa=Glu or Val
  UNSURE 36: Xaa= *  or Lys
  UNSURE 42: Xaa=Phe or Tyr
  UNSURE 45: Xaa=Phe or Ile
  UNSURE 55: Xaa= *  or Tyr
ggattttttttttcaacgaagggggaggttgagttgagggtttgtaattgtaatgtacaccggagaaagccraagkgmattatttcamaatctaaagcttgtwtatataatggtagtttgwwaaagtgwaccttccccacaggacgctgtgggatgtwaatttgtaggtcgagtttwyagctggwttttcttgactgaagctcattcaactggttamttctttgtgggwgtctttaatgaagcttataaatggcaaaagcaaaaggcttccaagactc

SEQ ID NO: 2863 - DNA, 388 bp, Homo sapiens
  CDS 209..388
  misc_feature 6: n=a, g, c or t
  misc_feature 7: n=a, g, c or t
  misc_feature 8: n=a, g, c or t
  misc_feature 152: n=a, g, c or t
  misc_feature 350: h=a or c or t
  UNSURE 48: Xaa= *  or Lys or Gln
gtcaannngtctttcattatgaaatccactctagtggatttgagaatcacaacgtggaatttctaggtttttattttagtttggaaagtttgtacaattttttgcagatagattctggttagggttaaatcatgcaaccacagtgagggttncagaccagggttctgaaccactggataaaagtgagacttcacaatgtatggcctgaatgtctgcagtgaattgttcctttcacaaacactttattcatgacttaaagtactgtgctattataggcactacagagcttcaaaattattttaaaattgtcccttaccttcttgatataccattttctgctgtgttcaaghagactccaggggtaggctggggacgagaaacccaatta

SEQ ID NO: 2864 - DNA, 284 bp, Homo sapiens
  CDS 70..282
  misc_feature 277: r=a or g
  misc_feature 278: r=a or g
  UNSURE 70: Xaa=Glu or Gly or Lys or Arg
gaacgcagaagaatcctggcccaccagctgggtgactttatcattgtatacaacaaggaaacagaacaaatggctgaaaagaaatcaaagaagaaagttgaggaagaagaggaagatggggtgaatatggaaaactttcaggagttcatcagacaagcaagtgaggctgaactggaggaggtgttgactttttatacccaaaagaacaagtctgctagtgtcttcctggggactcactctaaaatttctaagaacaacaacaattattctgatagtrrggcacg

SEQ ID NO: 2865 - DNA, 411 bp, Homo sapiens
  CDS 210..410
  misc_feature 344: n=a, g, c or t
  misc_feature 345: k=g or t
  misc_feature 346: r=a or g
  UNSURE 45: Xaa=Asp or Glu
  UNSURE 46: Xaa= *  or Glu or Gly
tctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgankracttaactcttccctctttagtcctcatcatttgaggttatcttttgtcattgttaccagcgagg

SEQ ID NO: 2866 - DNA, 279 bp, Homo sapiens
  CDS 107..277
tttgtgaatgcagaagctctcaggaaaacagatgctgcatttcagctggtcttgtctgaataaataaattacccaaatctccaaatttttaatttcatgtttgaaaatgaagctgtgtaaatattctagaaggggaggaagaaggagatgcagtgtatacattaggtttatatgtgaaatcctcctccctgtgcctgtcaccatcctcagtacagcccccgtggctcaggtggccaactcatggtgtggcttgggtggagcatactgtaaagaggctgc

SEQ ID NO: 2867 - DNA, 332 bp, Homo sapiens
  CDS 137..331
tgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccg

SEQ ID NO: 2868 - DNA, 421 bp, Homo sapiens
  CDS 49..420
tccagtagaatttttgtcaaaatatttttccaggaactgtgtgaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgagagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcagctaatgatgtaa

SEQ ID NO: 2869 - DNA, 430 bp, Homo sapiens
  CDS 252..428
acagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtcca

SEQ ID NO: 2870 - DNA, 353 bp, Homo sapiens
  CDS 117..353
  misc_feature 242: b=c or g or t
  misc_feature 243: m=a or c
  misc_feature 353: n=a, g, c or t
  UNSURE 42: Xaa=Arg or Ser
  UNSURE 43: Xaa=His or Asn
attaagcaggccaccctttggatcgccctgtctctcggcccaactggaagcctccaaagaaatcttaaggaagagtggaaatgcatgggctttggagctggacatttggggtttaaatgctgactctgctgtgggaccgtgggagtagctggacactgcatctatcacaccagatattgggagatgcagggcagatgcttcatgctttcagaggtttccaaagatggccaggctgctgcagbmatgaagatatccagggtgactggacaaaggaggagccctactacgtgaactgtcaacggagtagaagtcaagcaaaggtgacttgctgcctgccacatctgcctcccggn

SEQ ID NO: 2871 - DNA, 276 bp, Homo sapiens
  CDS 58..276
agtggtggaatttgggggaagttttcaaaaatattccattaacactggtataaaactatggtgtgtttattatacacacatatatgtatagatatgtgtgtttattatacacacatgtatagatatgtgtgtatattatacatatatacacatacacacatgtatacagttcataggtatacatatagtatatgtatacacccatataataaaagactcctagacagtatagttgagctcttgtggcaggattttcaccccagactccggacacct

SEQ ID NO: 2872 - DNA, 471 bp, Homo sapiens
  CDS 158..469
  misc_feature 461: m=a or c
  UNSURE 102: Xaa=His or Asn
gctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggmacccacttca

SEQ ID NO: 2873 - DNA, 361 bp, Homo sapiens
  CDS 138..359
agaggcgggctcgggcaagcactttaaccttttaagcccaaccagatgagttgcctgcagttttggaggccttcagagcatttcactagacctctgtctgtgtcggtccagtgtctttagccaagctttgattaaagatgacttccttgtttgctcaagaaattcgcctttctaaaagacatgaagaaatagtatcacaaagattaatgttacttcaacaaatggagaataaattgggtgatcaacacacagaaaaggcatctcaactccaaactgttgagactgcttttaaaaggaaccttagtcttttaaaggatatagaagcagcagaaaagtcactacagaccaggattcaccctaa

SEQ ID NO: 2874 - DNA, 256 bp, Homo sapiens
  CDS 46..255
cttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggct

SEQ ID NO: 2875 - DNA, 344 bp, Homo sapiens
  CDS 33..344
agagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccacgcc

SEQ ID NO: 2876 - DNA, 474 bp, Homo sapiens
  CDS 41..472
  misc_feature 67: n=a, g, c or t
  misc_feature 68: n=a, g, c or t
  misc_feature 255: w=a or t
  misc_feature 368: n=a, g, c or t
  misc_feature 430: r=a or g
  misc_feature 435: m=a or c
  UNSURE 9: Xaa= *  or Cys or Trp
  UNSURE 10: Xaa=Leu or Met or Val
  UNSURE 72: Xaa=Glu or Val
  UNSURE 110: Xaa=Asp or His or Asn or Tyr
  UNSURE 132: Xaa=Asn or Thr
aattttgattttgaggttatacttggagcaattccttttcatgtacacaactgtggtgtattgctgnntgtttgtttttgggaggggtggggggatgggggacagattttcactcttgtcacccaggccagagtgcaatggtgtgatcctggctcactgcaacctccgcctctcgggttcaacccattctcctgtctcagcctccggagtagctgggattacaggcatgcaccaccacgcccagctaatttttgwatttttagtagagacggggtttcaccatgttggccaggctggtcttgaactcctcacctcaggtgatccacctgcctcggcctcccaaagtgctgaggttacaggcgtgagcnaccacacctggcctgctttgtgttatttttacttagttgccttcacacaagtatttttagtrgagamcatacaggtaattaaagctgtgatcttaaacacgatcgt

SEQ ID NO: 2877 - DNA, 333 bp, Homo sapiens
  CDS 127..333
  misc_feature 17: h=a or c or t
  misc_feature 18: y=c or t
  misc_feature 19: k=g or t
  misc_feature 36: n=a, g, c or t
  misc_feature 58: r=a or g
  misc_feature 237: w=a or t
  UNSURE 37: Xaa=His or Gln
actgagaggttggtgghykctggaaagtggaacggnaaaaagtgctgctaattgatarccggccatttgtggaataccaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcawagctcccaagatgttgcctctctctcttcagactgttttctcactgtacttctgggtaaactggagaagagcttcaactctgttcacctgcttgca

SEQ ID NO: 2878 - DNA, 309 bp, Homo sapiens
  CDS 29..307
agaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagagga

SEQ ID NO: 2879 - DNA, 177 bp, Homo sapiens
  CDS 16..177
gcacgttgtcgtaaaatggttcccgcaggtttactccacccgctccccaggccagaaatgcgcggcacgcacgctctttctctacggagcggggacgaggggcactacggggcaggagtgttccagaggggcctgtgcgggcgcaagtttgggagaaataacagacggaaagggggt

SEQ ID NO: 2880 - DNA, 206 bp, Homo sapiens
  CDS 17..205
  misc_feature 7: s=g or c
acaggtsctggagaggatgtggagaaataggaacacttttacaccgttggtgggactgtcaactagttcaaccattgtggaagtcagtgtggcgattcctcagggatctagaactagaaaataccatttgacccagccatcccattactgggtatatacccaaaggactataaatcatgctgctataaagacacatgcacactcgc

SEQ ID NO: 2881 - DNA, 398 bp, Homo sapiens
  CDS 237..398
  misc_feature 288: m=a or c
  misc_feature 328: y=c or t
  misc_feature 335: m=a or c
  misc_feature 352: m=a or c
  misc_feature 364: m=a or c
  misc_feature 367: w=a or t
  misc_feature 368: n=a, g, c or t
  misc_feature 390: r=a or g
  UNSURE 18: Xaa=Lys or Gln
  UNSURE 31: Xaa=Ala or Val
  UNSURE 33: Xaa= *  or Cys
  UNSURE 39: Xaa=Ala or Glu
  UNSURE 43: Xaa=Pro or Gln
  UNSURE 44: Xaa=His or Leu or Gln
  UNSURE 52: Xaa=Glu or Lys
aagtggtgcagccagccccgaagtcggaaggtgctctctagggtgtacaggaagataaagtttgtgcttgatttagaattagctagatcctttgggggagaggggatcgagccgatttcgggaggatgttcactgcgcggatgatgctcaggccatcgagaaatccagaaacaggcgacgaccttcgtcaagagaaaaatgatcctgtggagaaaagtaaatgtcgctaggttgggatggatggtaacaggccaagccccggacctatatctagccacattttttgtmaaggaggaaaccaattctgtagagaaaagtacctccctgycccttgmaaggaccagtgtcaggmaatcctagtgcmacwnttctggctactgcatgtcaagragccagtc

SEQ ID NO: 2882 - DNA, 270 bp, Homo sapiens
  CDS 72..269
tatattgatgcacattttttgcaaacaattgaaattaaggtggtatcaatctgaactagttttaagttaaaatgttaatggcaatcctcagggcagcctctaagaaaataactcaaaaatgcatagtggaagaaacaacaagagagttaaaattgtacactagaaaaatacctaacacaaagaatgcagtaatgacagaagatagtaatggcaaaacagaggaacaaaaaggaaatacacacagaaaacaaatagcaaaatggcaggtct

SEQ ID NO: 2883 - DNA, 276 bp, Homo sapiens
  CDS 110..274
tctgtatgatactctcatggtggatacatgtcattaacatttttccaaacccagaaaatgtatgacatcctgagtgaaccccaagataaactatggactttgagtgattatgatgtgtcagtgtaggttcatcaagtgtaacaaatataccactcttttgaggttgttcataatggaggaggccacacaggtattggggagggggtataatctctacttgccactcagttttgctgtaaacttaaaactgctcttaaaacgtctttatatgacctc

SEQ ID NO: 2884 - DNA, 255 bp, Homo sapiens
  CDS 28..255
tttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggaccac

SEQ ID NO: 2885 - DNA, 239 bp, Homo sapiens
  CDS 55..237
tacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctc

SEQ ID NO: 2886 - DNA, 476 bp, Homo sapiens
  CDS 98..475
  misc_feature 372: k=g or t
  misc_feature 405: r=a or g
  UNSURE 92: Xaa=Met or Arg
  UNSURE 103: Xaa=Lys or Arg
agtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaakgactcgcagggggaaaggagtcttttccatgaraggtggatcgagatctactgccagtgggtcaacaggttctaaattgaaatcagatgagttacagaccatca

SEQ ID NO: 2887 - DNA, 396 bp, Homo sapiens
  CDS 137..394
agaagacggccagaggcacaaagaagccagcgcgctggcagagtcaagggatggggcaggggctgccggggccagcagggaccagctgaaggctgcgcagggggtgcgggccacacagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctact

SEQ ID NO: 2888 - DNA, 396 bp, Homo sapiens
  CDS 215..394
  misc_feature 351: r=a or g
  UNSURE 46: Xaa=Lys or Arg
gtagagaagatggaaagggagtgatcagagagaggtgagggtgccaggaaaacactgttgcagatgcaggggtttcaaaatggagtgtgtggcccacagtgtgatggggtcatgctgtgaggcgccctctgagctaccaacaaggaagcgagagtaactgaatggagtacagaaggaacagaaagcaggttttgagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttargtctcacgtcagcaagccccccctgaggccacacttctttatccc

SEQ ID NO: 2889 - DNA, 218 bp, Homo sapiens
  CDS 2..217
tatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccg

SEQ ID NO: 2890 - DNA, 199 bp, Homo sapiens
  CDS 31..198
  misc_feature 129: y=c or t
catcacaagaacccagagtggaattctgggatggaagagctggacagaaagtggagagagaaggtcctcccagcggcaaagctaattaaaaggagaaacctgttttccacatgcactcctcaatatggyacacatgctgctttcttgtcattacatgcctcacttgtcaccaaagcattttcaatcaattcctgggagt

SEQ ID NO: 2891 - DNA, 283 bp, Homo sapiens
  CDS 49..282
  misc_feature 91: m=a or c
  misc_feature 92: m=a or c
  UNSURE 15: Xaa=His or Asn or Pro or Thr
tggacagttttcactgttggcagctggctttgggttatttctccatttatggcctatggttcagcaagtcaactcttgaggacctattttmmtgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctttcccatctgcatagtttggttaagcatggacagaggcaat

SEQ ID NO: 2892 - DNA, 180 bp, Homo sapiens
  CDS 26..178
  misc_feature 60: r=a or g
  misc_feature 64: m=a or c
  misc_feature 79: m=a or c
  misc_feature 106: r=a or g
  UNSURE 12: Xaa=Glu or Gly
  UNSURE 13: Xaa=Asp or Glu
agatagagataaggagaaggataaaatgaaagcaaagaagggaatgctgaagggcttggragamatgttcaggtttggmaaacatcgaaaagatgacaagattgaraaaacgggtaaaataaaaatacaggaatcctttacatcagaagaggagaggatacgaatgaagcaggagcaaaa

SEQ ID NO: 2893 - DNA, 452 bp, Homo sapiens
  CDS 100..450
  misc_feature 113: k=g or t
  misc_feature 119: w=a or t
  misc_feature 124: r=a or g
  misc_feature 380: d=a or g or t
  misc_feature 381: d=a or g or t
  UNSURE 5: Xaa=Gly or Val
  UNSURE 7: Xaa=Phe or Tyr
  UNSURE 9: Xaa=Asp or Asn
  UNSURE 94: Xaa= *  or Cys or Phe or Leu or Trp or Tyr
agtcacagcagcaagcaagtctagtgaacagataagatgacatgctcagcaaaataacaacgaaaccagagaggctatgtggcccctcccacttgttctatgtcctgcctggktaattwcttgracgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctddggctcactggctgccttcttcacacctcttgcaattatgattgtcacctactttctcactatccatgcaat

SEQ ID NO: 2894 - DNA, 334 bp, Homo sapiens
  CDS 95..334
  misc_feature 304: n=a, g, c or t
  misc_feature 305: d=a or g or t
  UNSURE 70: Xaa=Phe or Leu
  UNSURE 71: Xaa=Ile or Leu or Val
gaactttgagtgcattctgctcatatgaattattgggattgttgatatatattgtattatgctaccaaagaaatattggttttattagaaggaaatggtcatcctctggaccatggagactagctcagaatacgctgatttccctctcctgactttgccaagcctttggctgcttttgcctgataaagggcagggccatctgaagacacttcccccagtcggctttggagtcacgggagctagtgcctgctcacacatttttcaaaagggcagtgcactcagaacttcactgtacctgggattndtaattcctcttgcagtgttgaccagcagc

SEQ ID NO: 2895 - DNA, 239 bp, Homo sapiens
  CDS 84..239
  misc_feature 96: b=c or g or t
  UNSURE 5: Xaa=Phe or Leu or Val
tccttttacatttaaattctgctgtgcaattgcataaacacaatttatttttgcatattgatcttatatcctgctagaaacaaatgctttttggabtcaggtttgattggccagtggcaatatctttggaaacttgcgtatttaccaggcatgaagaatctttctcatttcaattggagctttatcaccagcccaagggagaggaatgtcctaacgcatatcaagttctgaggttgggg

SEQ ID NO: 2896 - DNA, 183 bp, Homo sapiens
  CDS 17..181
catccagttactgaagatgtttagaaccttcaatagtaagaggaaaagggtgtccatagaaaaatggtcttgtcttctcagcaacagacacgtttcttttatatataaaaggtcaaagctgaatggatttttccctccctccagggaagtggcgtttgaaaccagaatatccctcctgactcc

SEQ ID NO: 2897 - DNA, 348 bp, Homo sapiens
  CDS 89..346
  misc_feature 324: v=a or c or g
  misc_feature 325: n=a, g, c or t
  UNSURE 79: Xaa= *  or Cys or Ser or Trp or Tyr
tttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacatvntccatacagaatcatgtgtcaag

SEQ ID NO: 2898 - DNA, 433 bp, Homo sapiens
  CDS 66..431
  misc_feature 258: r=a or g
  misc_feature 306: s=g or c
  misc_feature 403: s=g or c
  UNSURE 65: Xaa=Glu or Lys
  UNSURE 81: Xaa=Asp or His
  UNSURE 113: Xaa=Ser or Thr
taaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaraaaacccattcagattcctcctgggcctcctcgccccatttgcgacasatttgctacctgctccaggtgagtgggttttgggtctcttcactgctctgagccatgttaacatggaaccaggtgagcccagtggtagatgcacaascagtgtcttgacatactttaattcctggaa

SEQ ID NO: 2899 - DNA, 463 bp, Homo sapiens
  CDS 219..461
  misc_feature 395: m=a or c
  misc_feature 414: y=c or t
  misc_feature 421: w=a or t
  misc_feature 432: r=a or g
  UNSURE 66: Xaa=Cys or Arg
  UNSURE 68: Xaa=Lys or Met
  UNSURE 72: Xaa=Gly or Ser
catcaaaattaataacttttgttcatctcaggacctaatcaaaaaactgaaaagacaacctatagtatgggagaacattcttgcaaattatatatctgataatggtctactatccagagtatatataaagaactcttataactcaacagcaaaaggcataaataacttttaaatggacaaaggacttgaatagctatttcttcaaagaagatgtacaaatggccagcaagtacgtgaaaagatgcttggtgtcattagtaattacggaaatcaaaaccacaatgagataccacttcatacccactgggatggttgtgatcaaaagaacaaaaataacaggttttgatgaggatgtacaaaaattggaacccttatacattgcttgcataaatacmaattggtggtacagctgcygtgggawgcagtttggcrgtcctcaaaaagttaacataaaggccgggtt

SEQ ID NO: 2900 - DNA, 172 bp, Homo sapiens
  CDS 12..170
  misc_feature 66: w=a or t
  misc_feature 67: w=a or t
  UNSURE 19: Xaa=Phe or Ile or Asn or Tyr
cattaattcttatgttattttatttatttaagatggagtttcactcatcacccaggctggagtgcwwtggcacgatctcggctcactgcaacctcctcctcgtgggttccaagagcttctcctgcctcaacctcccaagtagttgggattggaggcgcacaccaccaccctc

SEQ ID NO: 2901 - DNA, 427 bp, Homo sapiens
  CDS 243..425
  misc_feature 381: k=g or t
  misc_feature 382: n=a, g, c or t
  misc_feature 404: v=a or c or g
  UNSURE 47: Xaa=Ala or Cys or Asp or Phe or Gly or Ser or Val or Tyr
taaattagatacaaaaccagttaatgtcctatagttcaataaaactgtaaccataatcttttttactagacaagttatttgtatttctttgagacaaaaatctacaagttaacatgtaacttaatacagtctgggtcctgatcaatgaaacacaagttaaacaaaggcatatctttccagagaattaaataatcctttttatgggcctgttaaacaatgctccagtatgacattgaaagaacatgcagtcacccttctcctttcccttatctctacattttgggaaatttttcttaacagtgcttcctactaacttctttaaatgtagtagtctttgtgctgtggggacaaaaatatggccacaagtagtaacttttctgkntttttctttaatagacaatccvcagaaatcagtcaacgggatggc

SEQ ID NO: 2902 - DNA, 212 bp, Homo sapiens
  CDS 12..212
ctcgttagttgatgcagtttcttcctagccttgatggtctttacattttggcatgtttttgcagtggctggtaccggtttttcctttccatgtttagtgcttccttcaggagctcttttagggtaggcctggtggtgacaaaatctctcaacatttgcttgtctgtaaagtattttatttctccttcacttatgaagcttagtttggctgga

SEQ ID NO: 2903 - DNA, 399 bp, Homo sapiens
  CDS 108..398
gtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccagg

SEQ ID NO: 2904 - DNA, 288 bp, Homo sapiens
  CDS 30..287
  misc_feature 269: m=a or c
  misc_feature 281: r=a or g
  UNSURE 80: Xaa=Lys or Asn
attatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaamctgcttcatggrgacataa

SEQ ID NO: 2905 - DNA, 375 bp, Homo sapiens
  CDS 170..373
tcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactcccc

SEQ ID NO: 2906 - DNA, 410 bp, Homo sapiens
  CDS 226..408
  misc_feature 13: m=a or c
  misc_feature 14: r=a or g
  misc_feature 72: w=a or t
aaggcagaaggamrcagtggtcattgctggaggttaaaactgttctgaccgggcgcagtggctcacgcctgwattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaatt

SEQ ID NO: 2907 - DNA, 278 bp, Homo sapiens
  CDS 63..278
  misc_feature 25: w=a or t
attttcccaagaagccacctacggwtcactggagggaaaggagccccaaaagacggtagggaatgactgggctgtgcttgagtggggtcgagccctggggtgttttgcctcctaagactgatccccttcaaagtcgccactcccccaaagtccctcaaacattgtactcaagaacaatggtggggagatggtgggccccctcacctgttccctctttgaagcagggctccacccaggactcggccatcaaggacttcgtgctgaagtacgccctgcgc

SEQ ID NO: 2908 - DNA, 370 bp, Homo sapiens
  CDS 149..370
  misc_feature 349: n=a, g, c or t
  UNSURE 67: Xaa=Asp or Glu
aaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaaganaaaaaaatggaaaaagaccct

SEQ ID NO: 2909 - DNA, 489 bp, Homo sapiens
  CDS 133..489
  misc_feature 91: s=g or c
  misc_feature 306: k=g or t
  misc_feature 307: w=a or t
  misc_feature 308: w=a or t
  misc_feature 371: b=c or g or t
  misc_feature 373: s=g or c
  UNSURE 58: Xaa=Asp or Glu
  UNSURE 59: Xaa= *  or Ile or Lys or Leu
  UNSURE 80: Xaa=Leu or Ser or Trp
  UNSURE 81: Xaa=Glu or Gln
atactctttacggtactaggcactgctgagctgggagatgtcggcggcgtgttgggaggaaccgtggggtcttcccggcggctttgcgaasgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagakwwaatagatatagtactacattttgccgcacaaacacatgtagatctttcattcgtacgtgcttbgsagtttacctatgttaatgtttatggcactcacgttttggtaagtgctgctcatgaagccagagtggagagtttatttatgtcagcacagatgaagtatatggtggcagtcttgata

SEQ ID NO: 2910 - DNA, 426 bp, Homo sapiens
  CDS 98..424
  misc_feature 97: y=c or t
tagtgcacctttaccatttatagttggagttgactcaaggtattttgatcttcatgacccaccacaagatgttgtttgcattgacttggatacgaayatgttatatgtatcagatgaaaagaagaacatgaactggaagcaacttcccaaaaagccgtgcaaaaatctacttagcaccttaaagaaattgtatccccagctgtcttcagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgtga

SEQ ID NO: 2911 - DNA, 339 bp, Homo sapiens
  CDS 40..339
  misc_feature 32: n=a, g, c or t
  misc_feature 184: n=a, g, c or t
  misc_feature 185: k=g or t
  UNSURE 49: Xaa=Cys or Phe or Gly or Ile or Leu or Arg or Ser or Val
gcttttaaacccaaagcggccgccgtaggaanggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcagnktcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaaga

SEQ ID NO: 2912 - DNA, 193 bp, Homo sapiens
  CDS 10..192
acttccctgatgtggcggccgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccac

SEQ ID NO: 2913 - DNA, 432 bp, Homo sapiens
  CDS 253..432
  misc_feature 336: m=a or c
  misc_feature 402: s=g or c
  misc_feature 409: m=a or c
  UNSURE 28: Xaa=Asp or Glu
  UNSURE 50: Xaa=Lys or Asn
  UNSURE 53: Xaa=Leu or Met
gacttcctgcctcatcacccacctggcttgtgactgtgagcaggtcccttcaccgctcagtctcggttttcccatctgaaaaatgggaacagccgtctccctccccaaaggtgcttgtgaggattaactgacatctgaaaggtttctttcctcccggctggaaacctgaaactgccccttgaggttggccaccgctaatcacccctgcccggtgattgctggggacagagtgctggggtctgaggctccaacatgttgtgccttggtcctgcagagaaagagaagagggacaaagccagccaagagggaggggacgtcctgggggcccgccaagamtgcaccccccccttgaagagcttggtcgccactgggaacctgctggacttagaggagacggctaasgccccgmtgtccacggtcagcgccaacacg

SEQ ID NO: 2914 - DNA, 352 bp, Homo sapiens
  CDS 70..351
aatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaga

SEQ ID NO: 2915 - DNA, 173 bp, Homo sapiens
  CDS 16..171
  misc_feature 138: s=g or c
  misc_feature 152: w=a or t
  UNSURE 46: Xaa=His or Leu
tgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtscctcctcaccagcwctccagccaggacgatcacac

SEQ ID NO: 2916 - DNA, 303 bp, Homo sapiens
  CDS 77..301
agagatgtgctcatgaagattatgcttgttggtaaatgatcctacttccttgtttcttcagctgaaataatacgacatgccacttccttttttcctcttacatcaagccctgagtatgcctttgtttttatttttgtcttatattataaactactgtgtgcatataggtgtttggaaccatgagagtgttttatcaagaaagaatcatggcactgagaggattgatagtgacttcattagaagcactttagttacggcaagattttataaagttcttaatggttatacatttgtccccaaatg

SEQ ID NO: 2917 - DNA, 192 bp, Homo sapiens
  CDS 16..192
gaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgatatc

SEQ ID NO: 2918 - DNA, 231 bp, Homo sapiens
  CDS 73..231
accattttagaaagcacccagccagttgatgaattagaaggcagatactttcaggttgaggttgagaaaagaatggtccccagtgcagcagcttctcagaatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggac

SEQ ID NO: 2919 - DNA, 282 bp, Homo sapiens
  CDS 41..280
  misc_feature 263: k=g or t
  misc_feature 264: r=a or g
  UNSURE 75: Xaa=Cys or Asp or Gly or Tyr
tttcacactagcaggagggagggcgctgggtcaccctcctatgcagaagggcagccaagggtgcgcacttccccatcccctgcctggagcctcacttccagcccagcctgggcccgcagaccaccgcgggtgggagtgccgcatcggagagaaactcactgcagagctgggtaagttctgggtgcggggccacagtgctgcctgtcagcggaccctgtgcctgtgcagtgggaggaggggctccctttggacagcggctggckrctatctaattctaaacac

SEQ ID NO: 2920 - DNA, 344 bp, Homo sapiens
  CDS 4..342
caaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataa

SEQ ID NO: 2921 - DNA, 285 bp, Homo sapiens
  CDS 121..285
  misc_feature 7: n=a, g, c or t
  misc_feature 8: n=a, g, c or t
  misc_feature 140: w=a or t
  UNSURE 7: Xaa= *  or Leu
tgaattnntcgtttcagttattgtacttttcaacaccagaatttccgtttggttctttttgttgttaaattctgttagtctctgtttgtttagaaattgtcatattttacttctttaagcatggtttcctttagttcatwgaacataagcataagagctgtttttgaggtctctgctaagtctggaccttctcaaagtcagtttcttttgcctactttttttctgtatgtggggcacacattcttctgtgcatgtcttaaatttttttgtttaaaaccggaccta

SEQ ID NO: 2922 - DNA, 271 bp, Homo sapiens
  CDS 115..270
  misc_feature 7: n=a, g, c or t
  misc_feature 64: r=a or g
  misc_feature 119: w=a or t
  misc_feature 130: r=a or g
  misc_feature 133: r=a or g
  misc_feature 140: r=a or g
  UNSURE 2: Xaa=Phe or Tyr
  UNSURE 6: Xaa=Ile or Val
  UNSURE 7: Xaa=Met or Val
  UNSURE 9: Xaa=Glu or Gly
tacaatntggagaaagacattacaccatctgaattgcctgcaaacccaggttgtctgcattcaraagagcattctattaaagctaccttaatttggcgcttatttttcttaatcatgtwtctgacaatcrtartgtgtgraatggttgctgctttaagtgcaataagagctaactgccatcaagagccatcagtatgtcttcaagctgcatgcccagaaagctggattggttttcaaagaaagtgtttctatttttctgatgacaccaaga

SEQ ID NO: 2923 - DNA, 347 bp, Homo sapiens
  CDS 37..345
  misc_feature 8: k=g or t
  misc_feature 9: m=a or c
  misc_feature 10: n=a, g, c or t
  misc_feature 119: m=a or c
  UNSURE 28: Xaa=Ala or Glu
gcttctgkmntctgcagggcagtcccagcaggacccatggagtgtccttcgtgccagcatgtctccaaggaggaaacccccaagttctgcagccagtgcggagagaggctgcctcctgmagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgccaa

SEQ ID NO: 2924 - DNA, 204 bp, Homo sapiens
  CDS 11..202
ccttctgattatgattttacctctgaggaatgccactcaagaatttataattaggccaggtgcagtggcttacacctgtaatccaagcactttgggaggctggggtgggtggatcacggggtcaggagttcgggaccggcctggacaacgtggcggagcccatcttaaaaatgcaaaaattagccgggcttgctggtgggctgc

SEQ ID NO: 2925 - DNA, 293 bp, Homo sapiens
  CDS 73..291
  misc_feature 7: y=c or t
  misc_feature 11: m=a or c
  misc_feature 124: n=a, g, c or t
  misc_feature 125: n=a, g, c or t
  misc_feature 138: r=a or g
  misc_feature 293: n=a, g, c or t
  UNSURE 18: Xaa= *  or Ala or Glu or Gly or Lys or Leu or Met or Pro or Gln or Arg or Ser or Thr or Val or Trp
taatggytctmctcccccccactccccaaaaaagattggttcaagtagctccaattttctcattttactccaatgtctcttgtggtgatggacgttaaaattgagcaagtcatttgtaaagtanngttgaagcacaaratctgtaaactgtgtcaagcccccatctctgcctgtctccactgctcctttgttcgaaagcacatgtctgactgtgaaaagttgatgcaaacgtgttacacgcccagtcatgttggagggaacacctcctccagcccccagtcccccaggccggn

SEQ ID NO: 2926 - DNA, 250 bp, Homo sapiens
  CDS 41..250
cactatcatcaaagacccaaaggtagataaaaccacaaagatggagaaaaaacagagcagaaaaactggaaactctaaaaatcagagtgcctctcctcctccaaaggaacacagctcctcaccagcaacggaacaaagctggacggagagtgactttgacgagttgagagaagaaggcttcagacgatcaaactactccgagctaaaggaggaagttcgaacccatggcaaagaagttaaaaaccttgga

SEQ ID NO: 2927 - DNA, 302 bp, Homo sapiens
  CDS 68..301
cattgttgcagtaacgtagccacaagctgctgtagtctcagcctcctgggtggctggaattacaggcatgcgctaccatgcccagatgttctttgtatttttagtggagacggggtttcgccatgttggccaggctggtctgaaactcctgacctcaggtgatccacccgcctcggtctcccgaggtgtccagacactggaatttaaatttcatataagttgcatgtttcatgagctattaattcttttccccccaaccattaaaaaaatgttaaaatacctttcttcgcttgcacggcccc

SEQ ID NO: 2928 - DNA, 471 bp, Homo sapiens
  CDS 152..469
  misc_feature 330: d=a or g or t
  misc_feature 408: r=a or g
  misc_feature 409: d=a or g or t
  misc_feature 410: k=g or t
  misc_feature 415: r=a or g
  UNSURE 60: Xaa=Ile or Lys or Arg
  UNSURE 86: Xaa= *  or Cys or Trp or Tyr
  UNSURE 87: Xaa= *  or Glu
ctctttccattgtaaatgtgtgaatttctaagcactgttaatccttctttttatttccgtaggttgatgaaaaaaccgtagagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagadaaaatcagccttcactcgaactgtgtcccctggatctgtatcacctattcatggacagggacaagtggtagaaacttrdkaagcrcaggccctttgttcctggactgcaaagaagataccacttgaacttctcaaacatga

SEQ ID NO: 2929 - DNA, 171 bp, Homo sapiens
  CDS 13..171
tggaatggctagatgatcctaacagaagaaatcttacaggtctttactgctaaacctaaggagatgagagtaaacagtaagtggccaactcaaagaagcatggactatgttgaaacatggactatagctgcaatttcccagtggtgcagttttcaagtgttttaccccagg

SEQ ID NO: 2930 - DNA, 206 bp, Homo sapiens
  CDS 16..204
  misc_feature 2: v=a or c or g
  misc_feature 7: s=g or c
  misc_feature 27: w=a or t
  misc_feature 69: v=a or c or g
  misc_feature 81: w=a or t
  misc_feature 88: w=a or t
  misc_feature 115: w=a or t
  misc_feature 145: w=a or t
  misc_feature 147: n=a, g, c or t
  misc_feature 148: w=a or t
  misc_feature 169: w=a or t
  misc_feature 179: n=a, g, c or t
  misc_feature 182: w=a or t
  misc_feature 195: m=a or c
  UNSURE 18: Xaa=Phe or Leu
  UNSURE 22: Xaa=Asp or Glu
  UNSURE 25: Xaa=Ser or Thr
  UNSURE 34: Xaa= *  or Lys
  UNSURE 44: Xaa= *  or Lys or Asn or Tyr
  UNSURE 45: Xaa= *  or Lys
  UNSURE 52: Xaa= *  or Lys
  UNSURE 55: Xaa=Ile or Lys or Arg or Thr
  UNSURE 56: Xaa=Asp or Val
tvttacstctttataatgacttatggwagcgtcttcaacaatacagtcagcatatccaagggaattttvatgcaagtggawctacagwcctctatgttgacctacaacacatggwagatgatgcacaagaatatattcataccawanwagccagattatgatccagaawaggctttganagwctcactacaaccmtatgaggctgg

SEQ ID NO: 2931 - DNA, 468 bp, Homo sapiens
  CDS 122..466
  misc_feature 208: m=a or c
  misc_feature 209: m=a or c
  misc_feature 322: m=a or c
  misc_feature 323: m=a or c
  misc_feature 398: r=a or g
  misc_feature 403: r=a or g
  misc_feature 410: m=a or c
  misc_feature 425: m=a or c
  misc_feature 439: m=a or c
  misc_feature 440: m=a or c
  misc_feature 460: w=a or t
  UNSURE 30: Xaa=His or Asn
  UNSURE 67: Xaa=His or Gln
  UNSURE 68: Xaa=His or Asn
  UNSURE 93: Xaa=Ile or Val
  UNSURE 97: Xaa=His or Asn
  UNSURE 102: Xaa=Lys or Gln
  UNSURE 106: Xaa=His or Gln
  UNSURE 107: Xaa=His or Asn
ggttttctccccgcttgccggggtggtcctcttccctttgtcgattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaatmmaccaaattaccacaacatctcagagttctttcagctatcctggaagtaaccaagaagcatgcatgtatcccggtaattcaaatccaatttcacagccactgctgaatatccammattatcctcaacaaatttctgtttctgatatgcataatgggacagttgtggcctcacacacttcagtagaaagartaacrtatgccmatgttaatggacccmaacaactaactcammatttgcagatgtcttcaggwgttaccca

SEQ ID NO: 2932 - DNA, 474 bp, Homo sapiens
  CDS 39..473
  misc_feature 46: s=g or c
  misc_feature 58: y=c or t
  misc_feature 131: s=g or c
  misc_feature 420: r=a or g
  misc_feature 437: k=g or t
  misc_feature 439: d=a or g or t
  UNSURE 3: Xaa=Pro or Arg
  UNSURE 7: Xaa=Leu or Pro
  UNSURE 31: Xaa=His or Gln
  UNSURE 128: Xaa=Gly or Ser
  UNSURE 133: Xaa=Cys or Trp
  UNSURE 134: Xaa= *  or Leu
ttcctggaccgcgctggaagccctggcggcggcggcccatggggcscttggcgctgcycgcctggctgcagcccaggtataggaagaatgcgtatcttttcatctattacttaatccagttctgtggccastcttggatatttgcaaatatgacagtcagattcttttcatttggaaaagattcaatggttgacactttttatgctattggacttgtgatgcgactttgccaatccgtatctctcctggaactgctgcacatatatgttggcattgagtcaaaccatcttctcccaaggtttttgcagctcacagaaagaataatcatcctttttgtggtgatcaccagtcgaagaggaagtccaacgagaaatatgtggtgtgtgtgttattcgtctttggatctatggatatggttargtacacttatagcatgktdatcagtcataggaatatcctatgctgtcttgacat

SEQ ID NO: 2933 - DNA, 311 bp, Homo sapiens
  CDS 47..310
  misc_feature 142: k=g or t
  UNSURE 32: Xaa=Asp or Glu
aaatgaagacaaaccaattgctccttgtggagctattgccaacagcatgtttaatgatacattagaattgtttctcattggcaatgattcttatcctatacctatcgctttgaaaaagaaaggtattgcttggtggacagakaaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcgg

SEQ ID NO: 2934 - DNA, 451 bp, Homo sapiens
  CDS 168..449
tgtgcctgcattcagctggtgcacaataagtgcttgttactgtgccaatttcagtatgactagggctgtggtaggagcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcg

SEQ ID NO: 2935 - DNA, 306 bp, Homo sapiens
  CDS 126..305
atctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagcc

SEQ ID NO: 2936 - DNA, 466 bp, Homo sapiens
  CDS 57..464
  misc_feature 445: n=a, g, c or t
  UNSURE 130: Xaa=Lys or Met or Arg or Thr
ttccgttatctggttcttctgtacatccactgagggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgangttcatcaatgaccagcacga

SEQ ID NO: 2937 - DNA, 253 bp, Homo sapiens
  CDS 82..252
tttctacttcaatacacagcaggtagactctctccacacactttcgcctatttggaagatgaggcctagtaataatttgaaatgaccaaaggagaggcagaactcttacaccagagccaagatttctgcctgagtatcgaccatttttcctccaccttgaatccagcatccccctcccaacattccgctaccatcacttctcctgatgcttcagattacaactcttttacccgtttcacccagtctggcccct

SEQ ID NO: 2938 - DNA, 211 bp, Homo sapiens
  CDS 58..210
actgttgcttcgccgtcacgcccgtcgttgtcacgcccttccccgcggacaccgagaatgacccatagcggaaaattctaccgcactacctccctgaggcagcgaccggtaagaaacaaccttttcttcaggcttcccaccacccaaacacagtcgcagtcaactggccactatcacccaccaccctgcaggaacaattacccagcctcga

SEQ ID NO: 2939 - DNA, 233 bp, Homo sapiens
  CDS 53..232
  misc_feature 196: s=g or c
  UNSURE 48: Xaa=Asp or Glu
catacgttattgttggtcaaaagccgcagccctacctgaggctttgagagatatgaacaccaatgacttttcttttcctgactcccgaaataccaagaaaaagcaacttccccaaatggacagaaacagaaagtacccttggttgaacacagaggcctggttccagccatcgttagacgtgggaaggaactcagascccctctcctacctcatccccaaccccttccccacac

SEQ ID NO: 2940 - DNA, 254 bp, Homo sapiens
  CDS 9..254
caaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgag

SEQ ID NO: 2941 - DNA, 263 bp, Homo sapiens
  CDS 103..261
tagacccgcccatccacccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtctaag

SEQ ID NO: 2942 - DNA, 308 bp, Homo sapiens
  CDS 81..308
  misc_feature 284: w=a or t
  misc_feature 288: v=a or c or g
  UNSURE 70: Xaa=Asp or His or Asn
tttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcwaaavatgtatctacctccaaacct

SEQ ID NO: 2943 - DNA, 259 bp, Homo sapiens
  CDS 47..259
  misc_feature 16: y=c or t
tcctttgctgtttttyagtcttttctccaaatctaactcctcaagaatgggatgcctcccttatcccctgcaaaacaaaaacctcccagatcctagaatgttgaaggctttcttcagtagcgaattacaaaaagcatgtaaaactcatggtgggtggggggtgggaggcttgttacagggaatggagctggcagtgatttattttgacttctcttacagaagttgctttagagcagttggcacatttatcccctgggca

SEQ ID NO: 2944 - DNA, 398 bp, Homo sapiens
  CDS 139..396
  misc_feature 264: r=a or g
  misc_feature 367: k=g or t
  misc_feature 368: k=g or t
  misc_feature 371: m=a or c
  UNSURE 42: Xaa=Ile or Met
  UNSURE 77: Xaa= *  or Gly or Leu or Val
  UNSURE 78: Xaa=Asn or Thr
aaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatrcatacctgtataactccaaggagcctggagtacaagcctacattggcaaccggctcttctgctttcgcaacgaggacgtggacttctatctgccccagttgckkaamcatgtacatccacatggatgaggacgt

SEQ ID NO: 2945 - DNA, 422 bp, Homo sapiens
  CDS 112..420
acttccggtgtgtgagcctgcggttgctacataaccacgtagtttgagccatttctgcgtctggcgggtccttctgaacttgtcaccttcgcttggggtcgcaacgacccgatgatcgatgatccaagcaagggaaaagaagccttggcggagagcggaggtttggtgggggcggggaatggggtttttttcccgtccacggaagctttctgggatgggggtgctgtgctcgcatcccgggggttggaattggcggggtcctctgtgccctgctgtgagcgtttccaggactttgacctcgctcagcctgcctctctccaccctacctgtgcgaccgctttctcgcagtgtgacgtggagtgttactcaatgtccttatactttccattgctgtttttggtaatggggacattagaaccatc

SEQ ID NO: 2946 - DNA, 229 bp, Homo sapiens
  CDS 72..227
  misc_feature 87: y=c or t
  UNSURE 6: Xaa=Pro or Ser
ctttggggggaaggcggggccagaggcttgaagtgtggggagaacttggtctcctctctgctatatgaaatatgggagacgacagaycgtttgtgtgcaatgccccgggctgtggacagagatttacaaacgaggaccacctggcagttcataaacacaagcatgagatgacattgaaatttggcccagcccgaactgactcagtcatcattgcagatcaaacgccaga

SEQ ID NO: 2947 - DNA, 330 bp, Homo sapiens
  CDS 24..329
  misc_feature 138: r=a or g
  misc_feature 139: m=a or c
  UNSURE 39: Xaa=Ala or Asp or Asn or Thr
gagatttaatttgcatccagtctatggatgggatgctgatggtatttgagcaggagagctatgcttttggaagatttctccctggctttcttctgcctggtcctcttgcctacagttcccgtacagattccttccttrmtgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatgct

SEQ ID NO: 2948 - DNA, 265 bp, Homo sapiens
  CDS 47..265
  misc_feature 14: s=g or c
  misc_feature 116: s=g or c
  UNSURE 24: Xaa=Leu or Val
aaaagttattttgsttcgagagaaggcaagtggaaaatactatgctatgaagattctgaagaaagaagtcattattgcaaaggatgaagtggcacacactctaactgaaagcagastattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgccac

SEQ ID NO: 2949 - DNA, 381 bp, Homo sapiens
  CDS 69..380
gttttgcttgcatctgatgagtagaaattcagcctattctttgttttggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagat

SEQ ID NO: 2950 - DNA, 352 bp, Homo sapiens
  CDS 111..350
  misc_feature 119: s=g or c
  misc_feature 121: s=g or c
  misc_feature 188: m=a or c
  misc_feature 189: s=g or c
  misc_feature 260: v=a or c or g
  UNSURE 4: Xaa=Arg or Thr
  UNSURE 27: Xaa=Asp or His
  UNSURE 50: Xaa=Asp or Glu
tttattgaaatcaactagagatgatgtgatccaaatctgtggccctgcagatggaatcagactttttaatgcattaaaaggccggatggtgcgtccaaggttaaccatttatgtttgtsasggaatcactgcagttgagggagcagcaacaacagcagcagcaacagcagcagaagcatgaggatggmsactcaaatggtactttcttcgtttaccatgctatctatctagaagaactaacagctgttgaattgacagavaaaattgctcagcttttcagcatttccccttgccagatcagccagatttacaagcaggggccaacaggaattcatgtgctcatcagtgatga

SEQ ID NO: 2951 - DNA, 411 bp, Homo sapiens
  CDS 223..411
  misc_feature 11: b=c or g or t
  misc_feature 47: s=g or c
  misc_feature 52: s=g or c
  misc_feature 137: s=g or c
  misc_feature 154: s=g or c
  misc_feature 374: s=g or c
  UNSURE 51: Xaa=Ala or Gly
cttgctgttgbcgccgccgcagctgctgccgcggttggtggggttgsgtgasaggaggagctgtcgcggaccctgtagagtcggtctctgttgctctttttgcctgaggagtcttccatcctacgtcgagctctgastcccgtgctgtcgagasggagtccccggggacacctcggcacgcagcggagatgcctctttttgccaccaatcccttcgatcaggatgttgagaaagcaaccacgcgagatgaatactgctgaggactggggcctcattttggatatctgtgataaagttggtcagtctcgcactggacctaaggattgtcttcggtctattatgagaagagtgaaccacaaagatcctcacgttgstatgcaggctttgactcttctaggagcatgtgtatca

SEQ ID NO: 2952 - DNA, 375 bp, Homo sapiens
  CDS 61..375
  misc_feature 93: w=a or t
  misc_feature 94: k=g or t
  UNSURE 11: Xaa=Arg or Ser
  UNSURE 12: Xaa= *  or Glu
ttgtggtcatggaataccttgctagggggtcactcactgactgtggtaacagaaacctgcatggatgaagcacagattgccgcggtatgcagwkagagtttacaggcattggagtttttacatgctaatcaagtgatccacagagacatcaaaagtgacagtgtacttttgggaatggaaggatcggttaagctcactgactttggtttctgtgcccagatcacccctgagcagagcaaacgcagtaccgtggtcagaacgccatactggatggcaccagaagtggttacacggaaggcttatggccctaaagtcaatgtatggtctctgggtatcatggctactgagatggtagaaggagagcctccatacccc

SEQ ID NO: 2953 - DNA, 459 bp, Homo sapiens
  CDS 17..457
  misc_feature 9: s=g or c
  misc_feature 10: k=g or t
  misc_feature 13: s=g or c
  misc_feature 179: r=a or g
  misc_feature 180: r=a or g
  UNSURE 55: Xaa=Glu or Gly or Lys or Arg
cattgtttskggstctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgggrracctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgc

SEQ ID NO: 2954 - DNA, 436 bp, Homo sapiens
  CDS 225..434
  misc_feature 170: s=g or c
  misc_feature 171: b=c or g or t
  misc_feature 172: k=g or t
  misc_feature 180: s=g or c
  misc_feature 181: s=g or c
  misc_feature 293: r=a or g
  misc_feature 365: r=a or g
  misc_feature 369: r=a or g
  misc_feature 376: r=a or g
  misc_feature 413: w=a or t
  misc_feature 416: r=a or g
  UNSURE 49: Xaa=Glu or Lys
  UNSURE 51: Xaa=Lys or Arg
ctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataasbkggctaggssgagtgcagaagaatgaaactggaccccccacctttcaccgtatatgaaaattaactcaagatggattaaagatttaaatgtaagacctcaaactgtaaaaatcctagaagaraacctaggaaatacccttatcaacatcagccttggcaaagaacttttggctaagtccccaaaggcaattgcracaraacagarattggcaagtggggacctaattaaagcactctgcacwgcraaagacactatcaacagagt

SEQ ID NO: 2955 - DNA, 319 bp, Homo sapiens
  CDS 86..319
aaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacc

SEQ ID NO: 2956 - DNA, 426 bp, Homo sapiens
  CDS 239..424
  misc_feature 13: w=a or t
  misc_feature 218: r=a or g
  misc_feature 219: r=a or g
  misc_feature 367: n=a, g, c or t
  misc_feature 399: n=a, g, c or t
  misc_feature 405: n=a, g, c or t
  misc_feature 407: h=a or c or t
  UNSURE 54: Xaa=Leu or Pro or Gln or Arg
  UNSURE 56: Xaa=Cys or Phe or Ser or Tyr
  UNSURE 57: Xaa= *  or Lys or Gln
atagagacacaawaaaacccttccaaaaattaatgaatccaggagctggttttttgaaaggatcaacaaaattgataggccgctagcaagactaataaagaaaaaaagagagaagaatcaaatagacacaataaaaaatgacaaaggggatatcaccaccgatcccacataaatacaaactaccatcagagaatactacaaacacctctacacaaatrractagaaaatccagaagaaatggataaattcctcgacacatacactctcccaagactaaaccaggaagaagctgaatctctgaatagaccaataacaggatctgaaattgtggcaataatcaatagcttaccaaccaaaaagagtgcnggactagatggattcacagccgaattgtaccngaggtnchaggaggagctggtagcgtt

SEQ ID NO: 2957 - DNA, 481 bp, Homo sapiens
  CDS 230..481
  misc_feature 353: s=g or c
  UNSURE 42: Xaa=Glu or Gln
acctaggctgtatgataaagcctattgctcctagactacaaacctgtggaacatgtatactgtattgagtactgtagacaattgtaacacaaggattgtaaaccatggctgtgtggatacaagctcagcagctccaaggagaagcccttcatcagatgcaagcgttatatggccagcattttcccattgaggtgcggcattatttatcccagtggattgaaagccaagcatggagaacattaaggccacccagctcctggagggcctggtgcaggagctgcagaagaaggcagagcaccaggtgggggaagatgggtttttactgaagatcaagctggggcactatgccacgsagctccagaacacgtatgaccgctgccccatggagctggtccgctgcatccgccatatattgtacaatgaacagaggttggtccgagaagccaacaatggtagctctccagctggaagccttgctgat

SEQ ID NO: 2958 - DNA, 187 bp, Homo sapiens
  CDS 14..187
acacacattggggatgagtctctgtccacctctgtctgttagatatgagtcccctcctgcttccccttgtcaggtacgtgtctccatctgttttctattggatatgaattcctcctgcctctgcctgttgggtgcgtgtccttatcctccatccctgcctgttgggtatgtgttctctcctgccatt

SEQ ID NO: 2959 - DNA, 318 bp, Homo sapiens
  CDS 151..318
  misc_feature 22: s=g or c
  misc_feature 26: n=a, g, c or t
agaacaaagcaggaaagcgtastganagcgtcctgtgacggccagcaggagctcacctttacaaacaaactccttgccgggcctttgggttggcgatttgcccagacaagaagcttaagacttcgaagctgcattgcttcgaggcacccaatgcttgaaagtgaggacgcagagaaagtcctgcaagtgtgtttggatgagatcaccttttggacttgttcaaggtccttcagctatttagttcccatgtttgatggtgaaaatggactcagcagctattgcctttggcaaaaggtacttggtctgatccacagtcgt

SEQ ID NO: 2960 - DNA, 359 bp, Homo sapiens
  CDS 116..358
  misc_feature 255: n=a, g, c or t
  misc_feature 312: r=a or g
  UNSURE 47: Xaa=Ile or Lys or Arg or Thr
  UNSURE 66: Xaa=Lys or Arg
agacgtccctgggttccggtgttcgcggaagagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaaganagagaacaaatctctaaaaagagatacaaaggcaataatagatactggacttaaaaraactacacagtgccccaaactagaagactcagaaaaagaatatgttc

SEQ ID NO: 2961 - DNA, 440 bp, Homo sapiens
  CDS 99..440
  misc_feature 406: r=a or g
  UNSURE 103: Xaa=Glu or Gly
attcgcaggtgattttttcatcgtgtggggatctggatctgcttgagcaccagacaagcttggtatcttctgaggacggtgcccgagagcaggagaacatggatgacacaaacagcgagcagcagtttagagtcttcagagacttcgacttcctagatgtggagctggaggatggagagggtgagagtatggacaatttcaactggggagtgcgcagacgttctctggacagcctggataagtgtgatatgcagattctggaggagcgccaactgtcaggaagcactcctagcctgaataaaatgcaccatgaggactccgatgaatcatccgaggaggaggacctcacagccagccagatcctggagcactcagacctaatcatgactctctccccctctgaagrgacgaatcccatggagctgctcaccacagcctgt

SEQ ID NO: 2962 - DNA, 294 bp, Homo sapiens
  CDS 19..294
acggacagatttattggaatgcatggagctggtctgacctatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccc

SEQ ID NO: 2963 - DNA, 441 bp, Homo sapiens
  CDS 198..440
  misc_feature 323: r=a or g
  UNSURE 42: Xaa= *  or Trp
aggaggactcattttcaggacacttgtgacagtctaatcatagggcaccacctaaggtggcagcataaacacagtctgtccccagactgtaaccagatgctcctacttgagaccaaacagcaaatgggttaggctccaagccagaagagagctgggggtcccaccttctgtcctctccatggttttctacaaggagcatgtcccactttcaacattgtaaaaaatgtgcaagccttgtttctgtttctaaaagcagcctgactgctgaagcttaccttcagtcaagggaaagatttcactcatcttctggcgggccatcctgrccttggaacaatttgcaatccctgcctcatgtgcaatcccagcatgctgggctcatctctccagctacatctcaaaccaccggcctctcaacatggcagccagcttcgtgtactcaaa

SEQ ID NO: 2964 - DNA, 269 bp, Homo sapiens
  CDS 108..269
cttaacacgaaatgttgggtattaagtagtttcaccacaaaagtctcgttttgaaaattttgcacttaaacagttcaaattaaagttcgtttttagaactggtttttatgattgtctgtataagtccttttaactttctactcttatctcaccattccctgaagctgcagagaaaatcctttgattggtgttcaagagttgtaccttttatagaaaacaggatagatggcatcactttaataaggcaggtgcatgctttgaagccagtc

SEQ ID NO: 2965 - DNA, 416 bp, Homo sapiens
  CDS 108..416
  misc_feature 7: s=g or c
  misc_feature 8: b=c or g or t
attcccsbccgcccccttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcct

SEQ ID NO: 2966 - DNA, 329 bp, Homo sapiens
  CDS 112..327
  misc_feature 303: s=g or c
  UNSURE 64: Xaa= *  or Tyr
gaagcgtgctttaggttgtacgcaaatgatcttcatttccaggatgagttgtatttctcctggtggagctgttatctaggccatagccacagaagagatcactcaggctgcatgtttttcaaagtgggttccatagaacccctcttcatgcacagctcattatttaggataagcagctctccactccagagactacatgggcccctagacagccaactggaggcacctctctgctttagaagaacccagcaaatttgcttttctttcacttcctgccgacttcatgccttgttaacgaggtasacgaggttgacgacaccatccagacc

SEQ ID NO: 2967 - DNA, 221 bp, Homo sapiens
  CDS 11..220
aaacagaattatgcagttgctcgatgtgcctcctggtgaagacaaggggggatatgtgatcaaagcatcagaagggcctgctttcttccccgggcgatgtgcagagatctttgccaggggtcaaagcgtcgggaagcttggggtccttcatcctgacgttatcaccaaatttgagctgaccatgccctgctcctccctagaaatcaatattggacccattc

SEQ ID NO: 2968 - DNA, 416 bp, Homo sapiens
  CDS 40..414
  misc_feature 19: r=a or g
  misc_feature 60: r=a or g
  misc_feature 81: s=g or c
  UNSURE 14: Xaa=Asp or Glu
aagaggcgctgcggctgtratccaggctggggcgagaccatgtcggacctgggctcggargagttggaggaggagggagasaatgatattggggtgagagctcctggagagtgggcaaatgacctgcggcacggccatggcgtatactactacatcaataatgacacctacactggagagtggtttgctcatcaaaggcatgggcaaggcacctatttatacgcagagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggcca

SEQ ID NO: 2969 - DNA, 252 bp, Homo sapiens
  CDS 50..250
aatcagcgtgaatgaaaccattgtccttgtggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacg

SEQ ID NO: 2970 - DNA, 368 bp, Homo sapiens
  CDS 134..367
  misc_feature 15: r=a or g
  misc_feature 22: d=a or g or t
  misc_feature 30: r=a or g
  misc_feature 34: r=a or g
  misc_feature 37: d=a or g or t
  misc_feature 48: m=a or c
  misc_feature 75: m=a or c
  misc_feature 77: d=a or g or t
  misc_feature 78: r=a or g
  misc_feature 247: r=a or g
  misc_feature 248: r=a or g
  misc_feature 289: m=a or c
  UNSURE 39: Xaa=Asp or Asn
cttctcaccggccargatgcadacatgatrgcargadctggagcagcmacctgaggacccagagctcaaagccamadrttgagaagggcagagataactgtatccactctggactgctgacctttgaactattatgttatttccagggaaatgcaaaccaaaggatgtggtctctgatctaatccttagagaatgtgaccatgaagacacttttcctacctggtcaaaaggggcaggaattggagarracgtctacaaagcttccaacaccatggccctgggggtgacmtcctcggtaccctgcctgcccctccccaacatcctactcatggccagtgtcaaatggcaccaggggcagaaccagacat

SEQ ID NO: 2971 - DNA, 299 bp, Homo sapiens
  CDS 48..299
ctctgctttgtgtcttgtagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccag

SEQ ID NO: 2972 - DNA, 391 bp, Homo sapiens
  CDS 165..389
ataggcagaggggtctgagtgggaagagacagaggtggtgggagcagtgggctctgcctgtccccaccccgacctggggcctcataccatcccactatcatgggtagtgcctaccactgggaggcccggcgccggcagatggctttggaccgaagagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccaca

SEQ ID NO: 2973 - DNA, 454 bp, Homo sapiens
  CDS 299..454
  misc_feature 320: h=a or c or t
  UNSURE 8: Xaa=Cys or Arg or Ser
agtcagtagctcgcagtggagggaggaggagctccaactgtgctctttgatggcagtttttgcacctttgggtgcttgtcatgttcgtttatttttcaaagaagacagcaggtccctgacctcatagaccagctagtttgggaggtggcggcagaataagggctgaggacccagatctgcctggggtcaggctgcttctaaaagtgcagggccaccctcagtagtgtggctgctagggcagcacagttacaatttcgctgaaggctgaggcaggagtggagaggcatggagaggccccatggggaatatactgacctgthgtatcaactcccactgtggctggcccagggggaaggacgcaccctgttatgaatctgatactgatatttatgagactgtggctgctgcaacatcagaatccactactgtagagcctggcaagctggatgtggga

SEQ ID NO: 2974 - DNA, 443 bp, Homo sapiens
  CDS 52..441
  misc_feature 287: b=c or g or t
  misc_feature 288: b=c or g or t
  misc_feature 301: n=a, g, c or t
  misc_feature 302: n=a, g, c or t
  misc_feature 372: k=g or t
  misc_feature 379: y=c or t
  misc_feature 395: r=a or g
  UNSURE 79: Xaa=Ala or Gly or Val
  UNSURE 84: Xaa=Ala or Cys or Asp or Phe or Gly or His or Ile or Leu or Asn or Pro or Arg or Ser or Thr or Val or Tyr
  UNSURE 115: Xaa=Glu or Gly
gttgttaccgttcacagtggaaggcagaggaaatcggccctgttcctagaaatgtgctttatcagagatcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagbbaaactttctgtcnnctcaaccatagatgctcctgtcgctccttcagacaaaggagagcaggagcctggggtcgaggcccagggkcccggtytgctgctgtggattgraactgacacatggcagatatggaacggtccttatagttggaacagaac

SEQ ID NO: 2975 - DNA, 247 bp, Homo sapiens
  CDS 68..247
  misc_feature 83: k=g or t
  UNSURE 6: Xaa=Ala or Ser
tgcctggaccaagctactccagatcatctgaccaactcttaaaaatcacggccaggcacagtggctcatgcctgtaatcccakcactttgggaagcagaggtggcaggatcattccagcccaggagttcaagaccagcctgggcaacacagcctcctcccaaggagaacatgagaccacttcatatctggaactctagaaacactggctgcagcaatcaacctcctgtgccaaggctggcccctatg

SEQ ID NO: 2976 - DNA, 228 bp, Homo sapiens
  CDS 29..226
  misc_feature 17: r=a or g
  misc_feature 20: m=a or c
  misc_feature 90: s=g or c
  misc_feature 122: s=g or c
  misc_feature 124: s=g or c
  misc_feature 126: s=g or c
  misc_feature 144: s=g or c
  misc_feature 158: s=g or c
  misc_feature 162: s=g or c
  misc_feature 207: k=g or t
  misc_feature 208: k=g or t
  misc_feature 217: s=g or c
  UNSURE 21: Xaa= *  or Ser
  UNSURE 32: Xaa=Leu or Val
  UNSURE 33: Xaa=Arg or Thr
  UNSURE 39: Xaa= *  or Ser
  UNSURE 44: Xaa=Glu or Gln
  UNSURE 45: Xaa=Ser or Thr
  UNSURE 60: Xaa=Gly or Val
  UNSURE 63: Xaa=Asp or Glu
ttctcataacattccartgmggctttttatgcaatggcatgtttcagtgataaaagttccagttatgtatctcgacgatgtgacacagtsacagtccctaaaggaggtcatcacagattttstsasacaaactcataaactgtsactctacctttgcsagastatgaaagtaggcactaaaggaccaggcgataacttacaccaagkkgcacctgasctactcctccc

SEQ ID NO: 2977 - DNA, 375 bp, Homo sapiens
  CDS 14..373
  misc_feature 106: k=g or t
  UNSURE 31: Xaa=Asp or Glu
agatgcaggggccatggcactcttaacaccccagggagtgaaagaagtcttccaatttcagagaccacaaggtcgggagcgcctgcggaggcttctgaactgggakgagtttgacgaacagagagcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccacccacctgctggccctctgtgactacttccaccacaccttcatccgccacta

SEQ ID NO: 2978 - DNA, 416 bp, Homo sapiens
  CDS 87..416
  misc_feature 17: y=c or t
gggttagagcggcgcgygtgtccagtccgcggaacggggagatcgttggcaccttcgcttttttaggggaacggggatagttcgccatggagccagagagggaagggaccgagagacaccccaggaaggtcagggaaagcaggcaggccccaaataagctggtcggggcagctgaggcgatgaaagccggttgggatctcgaagagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttt

SEQ ID NO: 2979 - DNA, 199 bp, Homo sapiens
  CDS 47..199
  misc_feature 12: s=g or c
  misc_feature 164: w=a or t
  UNSURE 40: Xaa= *  or Lys
tgaagatctaasgaatggggaagagaagaaagggataagataagagatgctgaaaggtattcttaatagacttaagtattttacttgggttatgctcttttctataattttcactggctcattagaagtagaaaagtttataagtagagaatttaatagaagawaggcaggtaatgttgttgagatgtgtggggtcaga

SEQ ID NO: 2980 - DNA, 283 bp, Homo sapiens
  CDS 130..282
  misc_feature 261: w=a or t
  UNSURE 44: Xaa=Asp or Glu
acctttgacttactgatgagttaaggaaggactgaagacaaaagaaactatgggctgctctctctttccctttctttctatgtcaccattttcacttaagtggttggtcgatacaaggaattaacactaatgctatgtgcaaatgggataggaagaaatggcagcatgcattatgcacacctctcctctgctcagactcaaattatcgaaacttcagaggaaaaatttaaactttcctacaccagaatcagcttgagagawgaacctagttgccaccccggcc

SEQ ID NO: 2981 - DNA, 330 bp, Homo sapiens
  CDS 173..328
aggggatcgtggtccgtccggaggtggcgggagggcagctccgggctcgacccagcgtgggtcctgcctgaggccctttgcgcctcccgctccaggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagac

SEQ ID NO: 2982 - DNA, 438 bp, Homo sapiens
  CDS 65..436
actcccagaatgctgaccaaagtgggaggagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcagtcacactctgccacagcgcaaacttctcaccaggggccagagtcagggggccggtgaaggtcctggacagcaggaggctctactcctgcaaatgggtacagtctca

SEQ ID NO: 2983 - DNA, 416 bp, Homo sapiens
  CDS 90..416
  misc_feature 290: m=a or c
  misc_feature 346: r=a or g
  misc_feature 357: r=a or g
  UNSURE 67: Xaa=Asp or Glu
  UNSURE 86: Xaa=Lys or Arg
  UNSURE 90: Xaa=Glu or Lys
ggggcctgtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgamgaacttgaagaactttatttattagagaggtgttttcctgaagcagagaaattgaracaggaaactraattgctttctcagtggaagcactacattcaatgtgatgggagtcctgatccttcagta

SEQ ID NO: 2984 - DNA, 262 bp, Homo sapiens
  CDS 97..261
attggctgatccctcatgaatatgtagattactctcacccttcacctcgctctggaaaaaccagccaccatgttgtaaggatgctcaagtagcactatggagattcacacgtggcaaagagctgaggcctcccaccaacagccacatgagggagccagagtaggagtggctcctccagccccagtcgaaccttcagatgtgacagacttggctgctgacagtttgcaatctcatgagaccctgagccagaaccacccagctt

SEQ ID NO: 2985 - DNA, 459 bp, Homo sapiens
  CDS 254..457
  misc_feature 13: w=a or t
tccttcctctccwtccttttcttaggaggcctcatgcctcagtttgactggctggtcttattgtcttccaggaaactgaggccatggggacacataggtcctcttcccagcaatctccccagggatccaaggcacctctgggaaagccacagcccttctctgggccgcagttttctcattggagaagtgcctgggacagctctagacctcattgactgagctgcccagagggacacttgagatttaggggtgcatgtgtgtgagctgtgtgtgtgtgagtgtgtgggtgtccacagactttagaactgcagccctagaacatttgtcaggttacggggggagaaagagactgaagcgagggctgttctctaggaccaccaggatcccacaggactttccagcgcctgtgtctccatcctctccccgcagccttgctccttcgggtgtttcagatcccct

SEQ ID NO: 2986 - DNA, 260 bp, Homo sapiens
  CDS 103..258
caaattagaagaaaataacttaaaaattcaacaattgaagaatagtttatgagttgaattaggtatcttaaatgtgtaattcagggcctggcgcagtggctcatgcctgtgatcccagcactttgggaggctgaggggggtggatcgcttgaggtcgggagtttgagaccagcctggccaatacccccgtctctactaaaaatacaaaaattagccgggcatggtggtgcatgcctgtggtcccggctactcgggtggca

SEQ ID NO: 2987 - DNA, 183 bp, Homo sapiens
  CDS 5..181
  misc_feature 45: w=a or t
  UNSURE 14: Xaa=Glu or Val
caagatgctggatgcagccgtgattaagatggaaggaggcacggwgaatgatctccgcatcctggagcaggaggaggaggaggagcaggcaggaaagcctggggagcccagcaagaaagaagaaggacgggctggagcaggcctaggggacggggagcgcaaaaccaacgacaaggaggagaa

SEQ ID NO: 2988 - DNA, 183 bp, Homo sapiens
  CDS 28..183
  misc_feature 100: k=g or t
  misc_feature 162: r=a or g
  UNSURE 25: Xaa=Ala or Ser
cttcttcctcctcgggcgcccgcggcgatgttcaaccgcgccgtgagccggctgagcaggaagcggccgccgtcagacatccacgacagcgatggcagtkccagcagcagccaccagagcctcaagagcacagccaaatgggcggcatccctggagaatctrctggaagacccagaaggcgtg

SEQ ID NO: 2989 - DNA, 171 bp, Homo sapiens
  CDS 18..170
acaagtccggtgactctatgtatcgaacacttcatctgagtacagaacaggtggccgcattttgccgcagtttgcatgagatgaacccctctgaccagagcccatctcctcaggactccacggggcctcagctggcgaccatgagacaactctcggatgcagataagctgc

SEQ ID NO: 2990 - DNA, 369 bp, Homo sapiens
  CDS 94..369
  misc_feature 340: s=g or c
  misc_feature 356: b=c or g or t
  misc_feature 357: r=a or g
  UNSURE 83: Xaa=Glu or Gln
  UNSURE 88: Xaa=Ala or Gly or Val
agaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaattttggaaacacatgctactgtaactccgtgcttcaggcattgtactcctgccgtccattccgggagaatgtgttggcatacaaggcccagcaaaagaagaaggaaaacttgctgacgtgcctggcggaccttttccacagcattgccacasagaagaagaaggttgbrtcatcccacctg

SEQ ID NO: 2991 - DNA, 194 bp, Homo sapiens
  CDS 31..192
tatatatataattttatttatttatttgagatggagtctcactctgtcgcccaggctggagtgcagtggcatgagctcggctcgctgcagcctccgcctcccaggttcaagcaattctcctgcctcagcttcgctcatagctggaattgcgggcgcgcgccaccatgcctggctaatttttttttttttttttt

SEQ ID NO: 2992 - DNA, 396 bp, Homo sapiens
  CDS 173..394
  misc_feature 69: k=g or t
  misc_feature 70: v=a or c or g
  misc_feature 110: k=g or t
  misc_feature 124: s=g or c
atcttttccatctcctgctccttccgccttcccgccatccgccctccacacgattcagcccggtggtgkvagccccctggactcgattcctgaggcaaacagtgcccctkaaggtcggcgacasctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcact

SEQ ID NO: 2993 - DNA, 217 bp, Homo sapiens
  CDS 32..217
  misc_feature 14: r=a or g
  misc_feature 26: w=a or t
  misc_feature 69: m=a or c
  misc_feature 107: h=a or c or t
  UNSURE 13: Xaa=Ala or Glu
  UNSURE 26: Xaa= *  or Lys or Gln
cagagatatcttgratggaatcagawtaataatggcagataaggaggttggtaacaaggaagatgctgmgaaggaagtagctatttctaccttctcatccagtaachaggtatcctgcccgctatgtgaccaatgctttccacccacaaagattgaacgacatgccatgtactgcaatggtctgatggaggaagatacagtattgactcggagccaa

SEQ ID NO: 2994 - DNA, 296 bp, Homo sapiens
  CDS 25..294
actttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacag

SEQ ID NO: 2995 - DNA, 390 bp, Homo sapiens
  CDS 179..388
  misc_feature 329: s=g or c
  misc_feature 345: r=a or g
  misc_feature 361: r=a or g
  UNSURE 51: Xaa=Ala or Pro
  UNSURE 56: Xaa=Glu or Gly
gagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagascccctgaccagctggrgttgaccgatgcggarttaaaggaggagttcactcggattttgac

SEQ ID NO: 2996 - DNA, 219 bp, Homo sapiens
  CDS 61..219
agaaggaagaagtctttcctggagctgcaagctgcatgtcctggggttggaagaggagtgatgcaagtactacattggctgctccagctggctggtatcttaaaaaagggaaaacatcaaaggcaaactcatgtgacaacctccttggaacagaaatttgccccaaattttgaatttactatctttccatttaagtttcagaaattaaaaaagagcgca

SEQ ID NO: 2997 - DNA, 448 bp, Homo sapiens
  CDS 58..447
  misc_feature 13: y=c or t
  misc_feature 62: r=a or g
  misc_feature 388: s=g or c
  misc_feature 399: s=g or c
  UNSURE 2: Xaa=Lys or Arg
  UNSURE 111: Xaa=Asp or His
aactctggtttgyttacccccgacctctgctctttcttcctctgtttctcccagcccatgaracccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggccagccagctcggtgtgtacaaagcgtttgtcgataactataaagtcgctctggagacagctgagaagtgcagccagtccaacaaccagttccagaagatctcagaggaactcaaagtgaaaggtcccaaggactccaaggacagcsacacgtctgtsaccatggaagctctgctctacaagcccattgaccgggtcactcggagca

SEQ ID NO: 2998 - DNA, 204 bp, Homo sapiens
  CDS 23..202
ccttcttctaccatttgaacatatggagtatatttatatttattttattttattttatttttttgagatgaactcttgctgtttcgcccaggctggagtgcagtggcgtgatctcggctcactgcaacctccatctcccgggttcaagcaattctcttgcctcagcctcctgagtagctgggactaccggcacccgccaccacc

SEQ ID NO: 2999 - DNA, 431 bp, Homo sapiens
  CDS 71..430
  misc_feature 13: s=g or c
  misc_feature 17: y=c or t
  misc_feature 22: s=g or c
  misc_feature 28: y=c or t
  misc_feature 29: w=a or t
  misc_feature 384: v=a or c or g
  misc_feature 385: n=a, g, c or t
  misc_feature 397: s=g or c
  misc_feature 398: h=a or c or t
  misc_feature 400: m=a or c
  misc_feature 406: m=a or c
  misc_feature 425: m=a or c
  UNSURE 105: Xaa=His or Pro or Gln or Arg
  UNSURE 110: Xaa=Pro or Ser or Thr
  UNSURE 112: Xaa= *  or Tyr
  UNSURE 119: Xaa=Ile or Leu
aatccaggccctstgcycctasaccctywcctctttctaatggggtggtaaacgaggaggggcaactcagatgcctaagaagcttgggcccaaatctcagagacagcgtggggctgttgcccccctcacccaggtccagcaggcggcctgttcccccacttataaacaggccaagcgcaatgccaggagctatcagggccgccgctgccgccgtcgttgcagccagaataccacttccagggttcctagccaactgcaagcagttgactcttcatctgcttcctgcaggacctacaagaacagtgaggagcttcggtctcgtattgtgtctggaatcatcacacctatccatgagcagtgggaaaaggctaatgtaagcagtcvnaccgggagttcshcmtgctamcgccagagaggtggaccamtccggc

SEQ ID NO: 3000 - DNA, 300 bp, Homo sapiens
  CDS 128..298
cctgatttttagaatggtacatgaacactagctaaaacttaaaatcaccagctgcatgagcccctgacaagagagtcagctttgaagctttgaagccaggcattgatttctcctcttctagctatgaatggccaatatggcatcttcttctaatagccatttcatctacaatgaaaatctgttgttacatgtagccatcttcatcattgatcttagcttaaccttcaggacaacttgctacagcttctacatcatcattcgctgcttcaccttgcacttttatattatagagatggcttc

SEQ ID NO: 3001 - DNA, 355 bp, Homo sapiens
  CDS 191..355
aagtcagtcgaaagcgaaccagaagcaccgggcacagcagctcctctggctgtgtagacagacctggcaatgtggccgtgcagcccagacgatcagagagaagccaggcgttgaccaagccccaaggtgcctgaggccatggtgcaactctgctggtgactggggcaccttggagcagagcttcacccggatgggaaatcctcactcctgggtggcactccctcctggacaggcccggtggcagagtgtccgtgctgctgggtgctgtccccagccctcctggtccatcttcttaagatgcgtccactgctttatatttaaaattctctttttcacaggcaaggaaaggaaactc

SEQ ID NO: 3002 - DNA, 473 bp, Homo sapiens
  CDS 98..472
  misc_feature 21: d=a or g or t
  misc_feature 102: k=g or t
  misc_feature 127: r=a or g
  misc_feature 145: k=g or t
  misc_feature 232: s=g or c
  misc_feature 362: n=a, g, c or t
  misc_feature 460: k=g or t
  UNSURE 2: Xaa=Leu or Trp
  UNSURE 45: Xaa=Lys or Asn
  UNSURE 89: Xaa=Ile or Leu or Val
cagcatccttttcaaggatadctgaacagaaccttctaagtctcagacacgtaaacccaagtgtggcaaaggaactcattgctctcgaaatgcatatatgtkggtttatagactgcaaactcaagaraagcccaacactactgtkcaagttccagcctttcttcaagagctggtagatcgggataattccaaatttgaggagtggtgtattgaaatggctgagatgcgtaasaaagtgtggataaaggaaaagcaaaacacgaagaggttaaggagctgtaccaaaggttacctgctggagctgagccctatgagtttgtctctctggaatggctgcaaaagtggttggatgaatcagcaantaccaaacctattgataatcacgcttgcctgtgttcccatgacaagcttcacccggaataaaatatcaattatgaagaggatatctgaatatgcagckgacattttctata

SEQ ID NO: 3003 - DNA, 250 bp, Homo sapiens
  CDS 4..249
  misc_feature 136: s=g or c
  UNSURE 45: Xaa=Leu or Val
aggatgctggagagcccagagagggaagagaagaaacccagcgttggtgcggtgcccaccgaggactcgacttcattccaccttcacgctctgagagaggccaagatacctagagagagttcgcggggccggaagstccctgctgtctcctgcaagtgcgtgggggtggggtctgatttccacccgtgttggacgtcagcggcctccgacgctttttggaagcaggtgaagggtcaaggccacccccgga

SEQ ID NO: 3004 - DNA, 428 bp, Homo sapiens
  CDS 16..426
cagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgg

SEQ ID NO: 3005 - DNA, 307 bp, Homo sapiens
  CDS 91..306
atggggaggtcaggtctgggaaactaggccctggggttttccctgagcaggagcggtgcccgagggcctcggcgtcagtccaggccctgaatggctggtctccagcggttggcgtcacatctgcctgtgggcgttatgctcccacataatacaacggaagctccagggccccactcagccaagcaagactcttacgaacaaggtgactcttcccagcagtccttgaaggggcacctgaggaacaatttccagaagcagcttttgagcaacaaagagttgattctggataaagtctatactcacccct

SEQ ID NO: 3006 - DNA, 307 bp, Homo sapiens
  CDS 85..306
gggaatctgcttgtgtcctgtttgatagtatgggaggtttgttttttttgcactttgcagtaagtcttgttattgctcactgttatggtttatgttgcttttatgagctgtaacacaaaagtttgcagcttcattcttgaagccagtgagaccacgaacccaccgtcaggagcgaccaacttcagttgtgcagctttaagagctgtgacactcaccgtgaaggtttgcagcttcatttctgaatcagcgagaccagggacccaccagaagaaaaaaactccaaatgcatctgaacatcagaaggaac

SEQ ID NO: 3007 - DNA, 235 bp, Homo sapiens
  CDS 33..233
gacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccagag

SEQ ID NO: 3008 - DNA, 300 bp, Homo sapiens
  CDS 77..298
  misc_feature 39: w=a or t
  misc_feature 104: b=c or g or t
  misc_feature 107: r=a or g
  misc_feature 124: r=a or g
  UNSURE 10: Xaa=Asp or His or Tyr
  UNSURE 11: Xaa=Asp or Asn
aatctgatcccacaggcctgagaaagtctgctctccagwacctgctgctgatctgtttcagccgacaagaggcaccatgaaattggaattcacggagaaaaacbacratagcttcgtgctgcaraacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccaa

SEQ ID NO: 3009 - DNA, 476 bp, Homo sapiens
  CDS 48..476
  misc_feature 357: v=a or c or g
  misc_feature 437: w=a or t
  UNSURE 104: Xaa=Glu or Lys or Gln
tgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttvaggacagactgcatctccgaggctatacacctgaaggaacagttttgaccgtccggccccctctcttgccatatattgtwacatcaaaggacagcgcatcaagaaaagtgtggcctata

SEQ ID NO: 3010 - DNA, 289 bp, Homo sapiens
  CDS 51..287
  misc_feature 155: r=a or g
aggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaargcagctgggcagatccaggcctggtggcgtggggtcctggtgcgcaggaccctgctggttgctgccctcagggcctggatgattcagtgctggtggaggacgttggtgcagagacggatccgtcagcggcggca

SEQ ID NO: 3011 - DNA, 413 bp, Homo sapiens
  CDS 121..411
  misc_feature 35: s=g or c
  misc_feature 333: n=a, g, c or t
  misc_feature 334: b=c or g or t
  misc_feature 341: m=a or c
  misc_feature 384: m=a or c
  UNSURE 71: Xaa=His or Gln
  UNSURE 72: Xaa= *  or Gly or Arg
  UNSURE 74: Xaa=Ala or Asp
  UNSURE 88: Xaa=His or Gln
agaaggcctcaggggtggctgtgtagcaagatgasggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaaatctttgctggcaaaatcctcanbgatccgmctcactggcacagtgtggagtgcgagatggcctcactgtccamctggtcatcaagaggcagcaccgtgccat

SEQ ID NO: 3012 - DNA, 250 bp, Homo sapiens
  CDS 85..249
  misc_feature 110: m=a or c
  misc_feature 124: r=a or g
  misc_feature 125: w=a or t
  misc_feature 185: v=a or c or g
  misc_feature 203: k=g or t
  misc_feature 229: k=g or t
  UNSURE 9: Xaa=Pro or Gln
  UNSURE 14: Xaa=Glu or Lys or Met or Val
  UNSURE 34: Xaa=Lys or Arg or Thr
  UNSURE 40: Xaa=Gly or Val
  UNSURE 49: Xaa=Asp or Tyr
actaggagaaccactaaagaagaagaaacagctagttcctgccttaactgatgaactgaccttgcagcattgcaccattgtgatatgttcctgccccaactaatccatcmaccttgtgatgttrwgccttgtgacctcccctacctcgtgactatgcaccttgtgacattcttcccctgcccgavaaaactgcccctaactgkaactttccactacctactccaagcckataaaactaactccactccca

SEQ ID NO: 3013 - DNA, 358 bp, Homo sapiens
  CDS 145..357
gatttacttcagtgaactcctaagagtagattcacttagaagactgtatgtcctctgggagtttttttattatttcagtagattttatggttatggattaaaattttaatcacattttttttcagttcagaattatactttagcatgttttgcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaaggaca

SEQ ID NO: 3014 - DNA, 379 bp, Homo sapiens
  CDS 175..378
  misc_feature 302: b=c or g or t
  misc_feature 303: n=a, g, c or t
  misc_feature 304: m=a or c
  misc_feature 338: m=a or c
  UNSURE 43: Xaa=Leu or Pro or Arg
  UNSURE 55: Xaa=Ala or Glu
gattggctgggcagatgggctgactggctgggcagatgggtgggtgagttccctctccccagagccatcggccaggtaccaaagctcagctgtatggattcccaacaggaggacctgcgcttccctgggacccattgttgtactggattaacaagcgacggcgctacggcatgaatgcagccatcaacacgggccctgcccctgctgtcaccaagactgagactgaggtccagaatccagatgttctgtgggatttggacatccccgaagccaggagccatgctgaccaagacagcaacccbnmggcggaagccctgctcccctgcaacctgcactgmagctggctccacagcagccccaggccagatccccattccca

SEQ ID NO: 3015 - DNA, 196 bp, Homo sapiens
  CDS 38..196
  misc_feature 35: s=g or c
  misc_feature 49: s=g or c
  misc_feature 63: w=a or t
  misc_feature 71: k=g or t
  misc_feature 83: s=g or c
  misc_feature 84: s=g or c
  misc_feature 138: s=g or c
  misc_feature 139: s=g or c
  misc_feature 142: v=a or c or g
  misc_feature 143: d=a or g or t
  UNSURE 4: Xaa=His or Gln
  UNSURE 9: Xaa=Phe or Tyr
  UNSURE 12: Xaa=Leu or Val
  UNSURE 16: Xaa=Ala or Gly or Pro or Arg
  UNSURE 34: Xaa=Pro or Arg
  UNSURE 36: Xaa=Leu or Met or Val
tatcctgcctcagcctcctgaggctgggattacasgcatgtgccaccasgcctggctcatttwtgtatgtktagtagagatgssgttccacaatgttggcccagctggactcgaactcctgacctcaggtgatccacssacvdtggcctcccaaaatgctgggattacaggtgtgagccaccgcacccagcctcta

SEQ ID NO: 3016 - DNA, 307 bp, Homo sapiens
  CDS 95..307
  misc_feature 132: s=g or c
  misc_feature 133: s=g or c
  misc_feature 143: r=a or g
  misc_feature 162: r=a or g
  misc_feature 168: k=g or t
  misc_feature 217: k=g or t
  misc_feature 221: y=c or t
  UNSURE 13: Xaa=Cys or Ser or Trp
  UNSURE 17: Xaa=Ala or Thr
  UNSURE 23: Xaa=Asn or Ser
  UNSURE 25: Xaa=Met or Arg
  UNSURE 43: Xaa=His or Tyr
ttccaaccgccctcacaggccctccctggggaccctgccctcctcccaggccagagtgtcaccaagtcagacttcctccccaagactcacctacatggagatgagttcctacctgtgttgggccagaggctssaagcgggaarcagccttcagccgagggartgaaakgattctgaaccccagagtgccccctccctgcccagaacccagcagcgtkagtyaccagcagtttcagccacttcatcggatgcaacagacaaacgttgccctgcttggccgggagactgtggggaaaaaggagccttgc

SEQ ID NO: 3017 - DNA, 369 bp, Homo sapiens
  CDS 171..368
  misc_feature 15: w=a or t
  misc_feature 307: r=a or g
  misc_feature 344: m=a or c
  UNSURE 46: Xaa=Glu or Gly
agattctggtgggtwcttccgctcaggctgggtgaagcgcttccgggtcgccgccggcagcagcctcccggcgcgatgaagacactgaggctcagagaggttaagtgactcagccaaggtcaaacagctagtaagtggtggagccaggactcaaagccagtctaggagccatgtccactttgttcccctcactcttccctcgtgtgactgagactctgtggtttaatctggatcgaccctgtgtggaagagacagagctgcagcagcaggaacagcagcatcaggcctggctccaaagcattgcggrgaaagacaacaacctggttcctattggcaagccagcmtcagagcactatgatgacgaggtcg

SEQ ID NO: 3018 - DNA, 261 bp, Homo sapiens
  CDS 77..259
  misc_feature 13: m=a or c
  misc_feature 37: w=a or t
  misc_feature 248: w=a or t
  misc_feature 249: w=a or t
  UNSURE 58: Xaa= *  or Ile or Lys or Leu
attgtcatatgamaagagggctgagactttagctgtwgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaawwacaagcaacagg

SEQ ID NO: 3019 - DNA, 335 bp, Homo sapiens
  CDS 49..333
  misc_feature 26: s=g or c
  misc_feature 30: w=a or t
  misc_feature 187: k=g or t
  misc_feature 293: h=a or c or t
  UNSURE 47: Xaa=Ala or Ser
  UNSURE 82: Xaa= *  or Leu or Ser
ttgcccgcagagctgcggcggcgaasggawgagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagtkctggaacaggcctctccagccctcctctggccacccaaactgttgtgcctctacagcactgcaagatccccgagctgccagtccaggccagcattctgtttgagthgcagctcttcttctgccagctcatagcactcttcgtccacta

SEQ ID NO: 3020 - DNA, 240 bp, Homo sapiens
  CDS 23..238
catttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccag

SEQ ID NO: 3021 - DNA, 310 bp, Homo sapiens
  CDS 127..309
gtggctggggccagagacgtggagtacagggacctgtgcctctgggcattccctggaggtgggaagggacagctgagagaaggacaggagagggtcctgtcaacatgcccgagtgctgtgaacgttatgagagggccttgttgggaacacgtgctcctgggaatcagcccttccctctgtcctgttcccactcctccccgacgatgctcctgctcagaacccactcctcacctcagtgaagcaacgcagcgggcaccctgtggacaaagctggatattggctctgaataaaagcgaatcatggggaaaat

SEQ ID NO: 3022 - DNA, 220 bp, Homo sapiens
  CDS 31..219
acttccgtcgcatttcggggcggtaccaagatggactcctcgcgggcccggcagcagctccggcggcgattcctcctcctgccggacgccgaggcccagctggaccgcgagggtgacgccgggccgaaaacctccacagctgttgagaaaaaggagaaacctcttccaagacttaatatccattctggattctggattttggcatccattgttgtgacca

SEQ ID NO: 3023 - DNA, 352 bp, Homo sapiens
  CDS 188..352
tcgttatcatatttcttcatatctttgcagcactgcagatgacaatctacaaagaacaagttacacagcaaaatatcagtccataaaatgaaatccttccttatttaggttagctcagtgattaaggatcttcttccatatcatctggattaggagccataatgaagtgctttgggtatacaaggttatgtgtgtatgcatgtatttcccagcgagcatcatcactttcatgtgtaatgtaacgttctccaatgcgagtttcaaattctctaaggtcaagccaagtctgatagtcctaggagaaaatgaaattgtaatgatgaaacaaaagaaacaaaatactgtcaaccca

SEQ ID NO: 3024 - DNA, 188 bp, Homo sapiens
  CDS 2..187
  misc_feature 85: d=a or g or t
  misc_feature 92: d=a or g or t
  misc_feature 106: m=a or c
  misc_feature 107: w=a or t
  misc_feature 108: k=g or t
  misc_feature 116: k=g or t
  UNSURE 31: Xaa= *  or Gly or Arg
  UNSURE 36: Xaa=Leu or Met or Arg or Trp
  UNSURE 39: Xaa= *  or Glu
gatgcgcgccagccaaccaggccaaggccaggggacctcgagaccggcagcctcgacgaagaaccggaaggaggaaaaggaacgdgagggadgaagatctcccgcmwkgacttcakaaccaagttctgggtccctgcctctggagtgcctgatgagacaaaacggctcctcgtcctgcatccccgcac

SEQ ID NO: 3025 - DNA, 313 bp, Homo sapiens
  CDS 159..311
  misc_feature 163: k=g or t
  misc_feature 164: n=a, g, c or t
  misc_feature 287: k=g or t
  UNSURE 2: Xaa=Ile or Met or Arg or Ser
gcaacctgctcaggtccccttccacactgtggaagctttgttcttttgctctttgcaattaatcttgttactgctcactctttgggtccacactgcttttatgagctgtaacactcaccgcgaaggtctgcagcttcactcctgaagccagtgagcccatgaknccaccgggaggaacgaacaactccagatgcgccaccttaagagctgtaacactcaccgcgaaggtctgtagcttcactcctgagccagcgagaccacgaacccaccagaaggaagaaactcckgacacatccgaacatcagaaggaagc

SEQ ID NO: 3026 - DNA, 385 bp, Homo sapiens
  CDS 36..383
aggatggaacaagaactccagccactgactgtctcatgtatctgcaagggccgaggaaattaatgacccaaggaggctatgatatggtccaaaaacttttcctggattttttccgtaggcggctgagccagaggccaactgcagaggaactggaacagaggaacattttgaaacctcggaatgaacaagaggaacaggaggagaagagagagatcaagaggaggctaacccgaaagctcagtcaaaggcccacggtggaagagcttcgggaaagaaagatcctcatccgcttcagtgactacgtggaggtggctgacgctcaggactatgaccgcagggcagataagccgtggacccgcctcaccgctgcagacaaagctgccaa

SEQ ID NO: 3027 - DNA, 239 bp, Homo sapiens
  CDS 23..238
  misc_feature 22: s=g or c
  misc_feature 130: r=a or g
agttcctgggctcccgcggagsatgagacgttgtgaattagatgtgagaagagggacgcttggtctgcgaccaccaagaccccacaggatcgatgcacccacccctgctgatgaccatgaccatctaaargggaaacatcatttgaggggccctactcatggatcagaagcccctcttcactgtggggtgtgctgggttggcgggcagttgccgtggaatcagtttcctcaggacccgc

SEQ ID NO: 3028 - DNA, 328 bp, Homo sapiens
  CDS 175..327
  misc_feature 159: s=g or c
  misc_feature 160: m=a or c
  misc_feature 294: w=a or t
tgaattactgtggcgagacagggcgtgcctgtcagaaatctgagatgtttgtacgctctgagatgttgaacctttctggtgggcagcaccgacacccaggggtggacccccgaggatgaatgcctctaggcctccgcaacatattcaagaatgaatggsmgacgctagagtaaaatgggggcagagaggatatcagggagcaagatgcaaactgtgtgcatccactctcgtaaacaagtagctggtcacaaccagaaaggttcatctctcctaagcaaaacagcgactctttcwagcagggaagtttccctctttcaatcgtggcctc

SEQ ID NO: 3029 - DNA, 226 bp, Homo sapiens
  CDS 4..225
aacatgggcatgcatctcataatgattctgctgtatatttttctgatggttaatgatgttgcgcatcttttcatgagctcagtggccatctgtatatcttctttggagaaatacctattcagatccttttcctatttgtcatctgggttgtctttttattgttcaagtttaagagttcttttattattatgtctttgtcaaatatacattttacgtagggaggcct

SEQ ID NO: 3030 - DNA, 355 bp, Homo sapiens
  CDS 91..354
  misc_feature 16: s=g or c
  misc_feature 17: m=a or c
  misc_feature 266: m=a or c
  misc_feature 267: y=c or t
  UNSURE 59: Xaa=Ala or Asp
aggaaacagcaaccasmgggagatgatcacctgaaccactgctccaaaccatgggcagtaaatgctgtcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaccttgcctgcgacccagagagaagtggtgctctccaacaccctcgmyttgaacagcaagctggcgtactgcgaggggaagctcacgtacctggctgacagagtgcagatggtgtccaggaccgaggagggcgact

SEQ ID NO: 3031 - DNA, 281 bp, Homo sapiens
  CDS 116..280
  misc_feature 259: b=c or g or t
  misc_feature 266: n=a, g, c or t
  misc_feature 267: b=c or g or t
  misc_feature 268: d=a or g or t
  UNSURE 51: Xaa= *  or Ala or Cys or Phe or Gly or Ile or Leu or Met or Pro or Arg or Ser or Thr or Val or Trp
acggcgggctcccggagctccgggtcagggtcatgtcggggacttgaccactcggccgggtttcccgtcagctgggacacttgcagctgccccaggacgggcagcctcgatcctgatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtbcgaggcnbdgagatgacaccgc

SEQ ID NO: 3032 - DNA, 405 bp, Homo sapiens
  CDS 239..403
catacaaagctgagcaatctaggggtgagaatgctaacatattatctgtttttgtttttaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctga

SEQ ID NO: 3033 - DNA, 286 bp, Homo sapiens
  CDS 107..286
  misc_feature 24: s=g or c
  misc_feature 175: s=g or c
  misc_feature 176: k=g or t
  misc_feature 261: b=c or g or t
  UNSURE 23: Xaa= *  or Tyr
  UNSURE 24: Xaa=Phe or Val
  UNSURE 52: Xaa=Cys or Phe or Ser
attcctggcccccaagcccttggsaactacaattctactttctgcttctatcatttgactactttagatacctcatgttctagaggtcaccgcctttccttggttcatggctgctctccttcatcttcaaagccagaaacattgggccaagcccttctgtctctccctcttctaskttaaaagacccttgtggcccagcctggccaacatggctcacagaagggaggcaggcacagatggaaaaacgtttttcttttcgtbctcctctaccagtacgctctcgccc

SEQ ID NO: 3034 - DNA, 222 bp, Homo sapiens
  CDS 44..220
  misc_feature 16: r=a or g
  misc_feature 87: s=g or c
  misc_feature 94: r=a or g
  misc_feature 103: r=a or g
  misc_feature 110: w=a or t
  misc_feature 113: w=a or t
  misc_feature 115: k=g or t
  misc_feature 129: w=a or t
  misc_feature 144: w=a or t
  misc_feature 156: r=a or g
  misc_feature 158: w=a or t
  misc_feature 178: w=a or t
  misc_feature 193: w=a or t
  misc_feature 199: d=a or g or t
  misc_feature 215: r=a or g
  UNSURE 15: Xaa=Arg or Thr
  UNSURE 23: Xaa=Ile or Leu
  UNSURE 24: Xaa=Ser or Thr
  UNSURE 29: Xaa=Phe or Tyr
  UNSURE 34: Xaa=Phe or Tyr
  UNSURE 38: Xaa=Cys or Tyr
  UNSURE 39: Xaa=Leu or Met
  UNSURE 58: Xaa=Ala or Thr
ctcaaagaaatcactraagggaaaacagtccagatccccgtgtatgactttgtctcccattcccgtattaagggacatcagcgagasaggcagrgatcttgarcagattwtawckcagtacattacgtwcgtcaagcctgcctwtgaggaattctrcwtgccaacaaagaagtatgcwgatgtgatcatcccwagaggdgcagataatctggtgrccattct

SEQ ID NO: 3035 - DNA, 219 bp, Homo sapiens
  CDS 12..218
cgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccacgcc

SEQ ID NO: 3036 - DNA, 430 bp, Homo sapiens
  CDS 199..429
ctcagccggctggccggcgcggcatggaggtctacatcccgtcctttcgctatgaagagagcgacctggagcggggatacacggtgagggtcttgcagtgttgcccaggcaggccctgaactcctggtctcaagcgatcctaccgcttcagcctcccaagatgctggcattacagccgtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacact

SEQ ID NO: 3037 - DNA, 274 bp, Homo sapiens
  CDS 1..273
  misc_feature 125: y=c or t
  misc_feature 190: m=a or c
  UNSURE 42: Xaa=Leu or Pro
  UNSURE 64: Xaa=Pro or Thr
atggaagacaagcattccagtgatgccagtagtttgctcccacagaatattttgtctcaaacaagcagacacaatgacagagactacagactgccaagagcagagactcacagtagttctacgcyagtacagcaccccatcaaaccagtggttcatccaactgctaccccaagcactgttccttctagtmcatttacgctacagtctgatcaccagccaaagaaatcatttgatgctaatggagcatctactttatcaaaactgcctactccca

SEQ ID NO: 3038 - DNA, 291 bp, Homo sapiens
  CDS 102..290
agcaacccgctcgggtccctttccatgctgtggaagctctgttcttttgctcttcgcaataaatcttgctgctgctcactctttgggtttacactacctttatgagctgtaacactcaccgcgaaggtctgcagcttcacttcaagccagcgagaccaggaacgcaccaggaggaacaaacaactccagacatgccacctttaagagctgtaacactcactgcaaaggtctgtggcttcactcctaaagtcagtgagaccacgaacccaacgaaagaaactccggacgact

SEQ ID NO: 3039 - DNA, 166 bp, Homo sapiens
  CDS 7..165
  misc_feature 163: n=a, g, c or t
  UNSURE 53: Xaa=Phe or Ile or Leu or Val
gcctgtatgatcaaacaaagctcaagggtgtggctttgccttgtcaccaggagggtatatatagggagggcaagagctctgggacatcccactgggaagcttcaacatagctgtggaagtctgcagtctacaggagcctactatagacattctacaaccaacntcc

SEQ ID NO: 3040 - DNA, 316 bp, Homo sapiens
  CDS 79..315
  misc_feature 200: b=c or g or t
  UNSURE 41: Xaa=Ile or Ser or Thr
attctaacctggaaaacagccgcaacgaggagtgtgcttcagttgctgcactccacgagcgacgtggtgcggcagtacatggccaggctcatcaatgcttttgcgtcactggcagaaggtcgcctctaccttgcccaaaacacaaaggtgctgcagatgctggagggaaggctgaaggaggaggacaaggatatcatcabcagggagaatgttcttggggccctgcagaagttcagtctcaggcgcccgctgcagacagcgatgattcaagacggcctcatcttctggctggttgatgttctgaaggaccctgacc

SEQ ID NO: 3041 - DNA, 364 bp, Homo sapiens
  CDS 205..363
  misc_feature 26: w=a or t
  misc_feature 188: w=a or t
  misc_feature 210: d=a or g or t
  misc_feature 211: m=a or c
  UNSURE 2: Xaa=Arg or Ser
  UNSURE 3: Xaa=Arg or Ser
ctcctgggaatgcaacccatctccgwaaaggattaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagawtgggacagcttctttgatgagdmgtggccacttggccaaatcacgggacttcatttgtgtaaacatcctggaaaggggtctgcaccccttcgtgaggactgaagcctggaaattcctcacgggctacttctcatggcagagttcccaggatgagcggctcacggtggacagcatga

SEQ ID NO: 3042 - DNA, 248 bp, Homo sapiens
  CDS 1..246
  misc_feature 192: r=a or g
  misc_feature 223: k=g or t
  misc_feature 234: w=a or t
  UNSURE 75: Xaa=Ala or Ser
atgtacgcaggtgtggggtttgggggactttgcgggagaggctccagaggagacactgccaggtctctgctggagggagatgaccactttagcccggaaaatagactggacatgcaagaaacaacacgaaaaacatggcgtaccagctcggccatgagcgccggtgggtgcagtggggagaagaactgcttraggtggacccgctctccagggagtcctcctkccggctgcggwggcctgagccgtgt

SEQ ID NO: 3043 - DNA, 193 bp, Homo sapiens
  CDS 11..193
accaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggctaaaagctacaagcgcctt

SEQ ID NO: 3044 - DNA, 243 bp, Homo sapiens
  CDS 17..241
cactgatcatgagaaaatgcaaatcaaaaccacaatgagataccatctcatgccagccagaatggtgattattaagaagttaagaaacactagatgcttgcgaggctgtggagaaataggaaagcttttaccctgttggcaggaatgtaaattagttcaatcattgtggaaggcagtgtggcgattcctcaaggatctagaaccagaaatactgtttgacccagaaatcctattactaggtat

SEQ ID NO: 3045 - DNA, 250 bp, Homo sapiens
  CDS 32..250
  misc_feature 161: n=a, g, c or t
  misc_feature 172: r=a or g
  misc_feature 185: m=a or c
  misc_feature 198: y=c or t
  misc_feature 204: s=g or c
  misc_feature 206: r=a or g
  misc_feature 212: y=c or t
  misc_feature 215: s=g or c
  misc_feature 238: m=a or c
  misc_feature 244: m=a or c
  UNSURE 44: Xaa= *  or Glu or Lys or Gln
  UNSURE 56: Xaa=Ile or Thr
  UNSURE 58: Xaa=Pro or Arg
  UNSURE 59: Xaa=Ile or Val
  UNSURE 61: Xaa=Pro or Ser
  UNSURE 62: Xaa=Ala or Pro
taaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagnagcgtcaggartctctagaaagamgaacctcggccayagggcscrtcctcycascaggacatccttcatctgcagcmagcgcmcccgac

SEQ ID NO: 3046 - DNA, 410 bp, Homo sapiens
  CDS 39..410
  misc_feature 348: m=a or c
  misc_feature 381: m=a or c
  UNSURE 104: Xaa=Lys or Gln
  UNSURE 115: Xaa=Pro or Thr
ctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcaagaaagggtacaaaggatttcagggcaattgctatcgccagtgacatgcaagatgattttatctctccatgtggggcctgcmaggcaaagctcatgcagagagtttggcaccaamctggcccgtgttacatgaccaagccggat

SEQ ID NO: 3047 - DNA, 328 bp, Homo sapiens
  CDS 40..327
  misc_feature 8: h=a or c or t
  misc_feature 12: h=a or c or t
  misc_feature 114: m=a or c
  misc_feature 168: v=a or c or g
  misc_feature 191: d=a or g or t
  misc_feature 276: w=a or t
  misc_feature 285: n=a, g, c or t
  UNSURE 43: Xaa=Ile or Met
  UNSURE 51: Xaa= *  or Leu or Trp
  UNSURE 82: Xaa= *  or Cys or Trp
tagtggghatahgataacttgaaaggatcttacagtcaaatgggaaaaaccagagaaatcgatactagtactagagggcaacaaatgctgttacaaattggggtacgtagaggmaggtacttggtagaggacaggggcatgtttccggggcatagatcaaagtatatvaataaggaactgccaggccagtdgcggtggctcactcctgtaatcccagcactttgggaggccgaggcaggaggatcacgaggtcaggagatcgagaccatcctagcwacacaatgnagcccatctctactgaaaattaagtcaggcgtggtggtgggcg

SEQ ID NO: 3048 - DNA, 337 bp, Homo sapiens
  CDS 162..335
  misc_feature 66: w=a or t
  misc_feature 67: k=g or t
  misc_feature 140: n=a, g, c or t
gcttttgggtttctaggcattggtggatctgcagctacacacagaagcccaggctcaaattgtgcwkagctggaaagagctggccgacttcacatgcgcattcacaaaggctgtggctgaggcgccctttcaagtgagtnaccccagcaagtccagcctccatgctgggcctgtcctttaccatggctcttgcagtcaaagcaaatgtccctttcccctcatctctgcagtcagcccattgtctctcaagcttgaggcagaaggagctgacctcacactggggattcttgggaagagtcctcaagcctagcgccttttcaaatattctcctcccgcc

SEQ ID NO: 3049 - DNA, 165 bp, Homo sapiens
  CDS 3..164
agatgattgagagaatgacagagaaaatgttggaatctcctcctatgcatgagtcagagaggaaattgctaccatcttcaaggtctactgaggaagcacatactgaatgctggaagcaccaggggagatccccagctgttcttgtcagagcaaccctgaaagcaa

SEQ ID NO: 3050 - DNA, 374 bp, Homo sapiens
  CDS 214..372
  misc_feature 61: m=a or c
  misc_feature 65: k=g or t
  misc_feature 73: m=a or c
  misc_feature 267: w=a or t
  misc_feature 294: m=a or c
  misc_feature 295: m=a or c
  misc_feature 334: m=a or c
  misc_feature 340: r=a or g
  UNSURE 27: Xaa= *  or Cys
  UNSURE 28: Xaa=His or Asn
  UNSURE 41: Xaa=Leu or Met
  UNSURE 43: Xaa=Met or Val
atcataatttctgatgtaaagagcatgatgccatggacaaaatgggccctcagtgactatmcgakgcagggcmaggcactgaatgcagatgcatatactggagctcagaggatttcagtgagttaccccggccacagccagtgagcagcgatgtcaagatgtcttgaatcctgggcctcagctgcaaagccgtaaccagtcctctgtgttcccatgggccagtgctttacaaaggtccttgcaggttcatccctagaagattgtggwatttctggccatacgcaggaaaggtgmmacagatgctcaagtataaggcatcagctaccaccccatmtgctgrtggtgctcatacttctccgggatacctcccctcc

SEQ ID NO: 3051 - DNA, 363 bp, Homo sapiens
  CDS 136..363
  misc_feature 27: m=a or c
  misc_feature 65: s=g or c
  misc_feature 66: r=a or g
  misc_feature 162: m=a or c
  misc_feature 226: m=a or c
  misc_feature 242: m=a or c
  misc_feature 243: y=c or t
  UNSURE 31: Xaa=His or Asn
  UNSURE 36: Xaa=Ala or Asp
aaacaacagccacttttgtgggagccmaagaaacagcagctttaaaacagggtaaatattcaggsrtcattaggatcctgaatacaagcaagccagtaaaatacgggatctactcagaagggcacaatctatcagatggtcaagacaaataaacctggggcmaaggtagcggtttcagcaaagagagggtctgaggttactactaacacatcccctcagcagggamatgggtacgttcttgmytcaagccatcgaagtgctgcagtctccctgaacccttcccaccgaagatcagaagctgcacatcccaccactccccattcggcatcagactaccctcgatctgtctccctccagtcagga

SEQ ID NO: 3052 - DNA, 423 bp, Homo sapiens
  CDS 258..422
  misc_feature 396: m=a or c
  UNSURE 47: Xaa=Lys or Gln
tttatgtccacattttccctgtaggccacacggacatggccaggtgctgggggtgggtctggacaagatggtagagcccatggattaccccatcgagcggccacctcagaggagatgccacccatcatcaaaagactaaattgggaaaagaagcctcctggcttggtgcagtggctcacacctgtaatcccagcactctgggaggccaaggcgggctgatcacttgagctcaggtgttcgagaccagcctggccaacatggtgagcctgcgtcacctggcttctggcacacagctcggccactgtgtccctcctgcctccctggcaggtccttctaggggccctctcctggctggctttccagggcattccttccactctatccagggtccttccmaagaccacacccaggtcccagtcattc

SEQ ID NO: 3053 - DNA, 435 bp, Homo sapiens
  CDS 262..435
  misc_feature 2: n=a, g, c or t
  misc_feature 3: b=c or g or t
  misc_feature 233: n=a, g, c or t
  misc_feature 234: n=a, g, c or t
  misc_feature 322: w=a or t
  misc_feature 323: m=a or c
  misc_feature 324: s=g or c
  UNSURE 21: Xaa= *  or Lys or Asn or Ser or Thr or Tyr
anbtcctgagccacaggggttttaggagcatctttcattctagtgtttggtctttgaccccggttcccaacaaacagctcctactcccttggaatttattgggtgatgggagtgtcttgttctaatgaagcaactctaatgggctcctggacggggctggtcaccagaaagaccaggttatgctgagaagcttgaaaccgtcagtcccccgccaccccatcctctgggaaggnnagaggagctggagatcatgcccatgtgatgaggcctccgtcaaagtccttgcactccgggatgtggctgccggacatgcggaggcgcwmsgagagcggcacacctggagagggcgtggaagctccaacaccccacctccacaccgcgtgctatgcatctctcccgtcagctgctcctgggtttcagtctttcctaatgaac

SEQ ID NO: 3054 - DNA, 314 bp, Homo sapiens
  CDS 159..314
  misc_feature 139: m=a or c
  misc_feature 273: w=a or t
  misc_feature 274: s=g or c
  misc_feature 275: n=a, g, c or t
  misc_feature 279: w=a or t
  UNSURE 39: Xaa= *  or Cys or Arg or Ser or Thr or Trp
  UNSURE 41: Xaa= *  or Arg
gcaacctgctcaggtccccttccacactgtggaagctttgttcttttgctctttgcaattaatcttgttactgctcactctttgggtccacactgcttttatgagctgtaacactcaccgcgaaggtctgcagcttcamtcctgaagccagtgagcccatgagcccaccgggaggaacgaacaactccagatgcgccaccttaagagctgtaacactcaccgcgaaggtctgtagcttcactcctgagccagcgagaccacgaacccacccawsnggawgaaactccgaacacatccgaacatcagaaggaagc

SEQ ID NO: 3055 - DNA, 328 bp, Homo sapiens
  CDS 92..328
  misc_feature 108: r=a or g
  misc_feature 131: r=a or g
  misc_feature 327: r=a or g
  UNSURE 6: Xaa=Gln or Arg
  UNSURE 14: Xaa=Gly or Arg
  UNSURE 79: Xaa=Cys or Tyr
gtttcccgcttccagggcccggttcgttcccgcccgcacccgtccctctcctctgcacccctgctgcttctgctttgaaggcggaggctccatgttgtcccctcagcragtggcagcagctgcctcaagargagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattrc

SEQ ID NO: 3056 - DNA, 258 bp, Homo sapiens
  CDS 10..258
  misc_feature 122: m=a or c
  misc_feature 123: s=g or c
  misc_feature 192: k=g or t
  misc_feature 224: d=a or g or t
  UNSURE 38: Xaa=Ala or Asp or Glu
  UNSURE 61: Xaa=Phe or Leu
  UNSURE 72: Xaa=Glu or Gly or Val
tatagacatatgtttttcatttctttcgagtgtgtacctaggagtagaattgctagatcatatggtaattccgtgtttaactttttgaggaactgccagactgttttgcaaagcagctgcgmsattttacattcccatcagcaatgtctgagggttccaatttctccacattcttgccaacatttgtctttkaagattctagccatccatcctagtgtctgtgdagtggcatctcattgtggttttgatttttttttt

SEQ ID NO: 3057 - DNA, 402 bp, Homo sapiens
  CDS 49..402
  misc_feature 2: n=a, g, c or t
  misc_feature 138: m=a or c
  misc_feature 148: m=a or c
  misc_feature 195: r=a or g
  misc_feature 196: s=g or c
  misc_feature 248: w=a or t
  misc_feature 280: v=a or c or g
  misc_feature 283: d=a or g or t
  misc_feature 284: b=c or g or t
  misc_feature 291: d=a or g or t
  misc_feature 292: n=a, g, c or t
  misc_feature 346: n=a, g, c or t
  misc_feature 349: m=a or c
  misc_feature 350: y=c or t
  UNSURE 34: Xaa=Pro or Thr
  UNSURE 50: Xaa=Ala or Pro
  UNSURE 67: Xaa=Phe or Tyr
  UNSURE 78: Xaa=Ile or Leu or Val
  UNSURE 79: Xaa= *  or Ala or Gly or Ile or Leu or Arg or Ser or Thr or Val
  UNSURE 81: Xaa=Ile or Met
  UNSURE 82: Xaa=Asp or His or Asn or Tyr
  UNSURE 100: Xaa= *  or Gly or Arg
  UNSURE 101: Xaa=Leu or Met or Pro or Thr
cntcctccggccgtttaagaagagcctgccacctctttgtcttccgccatgattataagtttcctgaggcctcctcagccacgattcctgtgcagcctgcagagcctttcatatatatatattttgagacagggtctmactctgtcamccaggctggagtgcagggttgtgatcaatagctcactgcagcctcarsctcctggcctcaagcgatcctccagccttagcctccgaaagcaatggaattwcaggtgtgagccaccatgcccagctctggaavtcdbaaaaatdnatgagaaaaggcaagttaaaaggtcagaggtatacattgagaatggcctgaatngamygaagaaccacaaaagaagtgaaaatagccaattcctgcctttactgatgaca

SEQ ID NO: 3058 - DNA, 240 bp, Homo sapiens
  CDS 50..238
  misc_feature 16: m=a or c
  misc_feature 17: m=a or c
  misc_feature 61: b=c or g or t
  misc_feature 62: y=c or t
  misc_feature 64: h=a or c or t
  misc_feature 78: w=a or t
  misc_feature 103: m=a or c
  misc_feature 115: w=a or t
  misc_feature 156: m=a or c
  misc_feature 158: w=a or t
  misc_feature 170: w=a or t
  misc_feature 185: m=a or c
  misc_feature 206: r=a or g
  misc_feature 221: w=a or t
  UNSURE 4: Xaa=Arg or Ser
  UNSURE 5: Xaa= *  or Cys or Arg
  UNSURE 10: Xaa=Glu or Val
  UNSURE 22: Xaa= *  or Cys
  UNSURE 36: Xaa=Pro or Gln
  UNSURE 37: Xaa=Cys or Ser
  UNSURE 41: Xaa=Ser or Thr
  UNSURE 46: Xaa=Pro or Thr
  UNSURE 53: Xaa=Met or Val
  UNSURE 58: Xaa= *  or Lys
ctctcttactccccgmmccttccgccccaggcgtggccagacaacccggatggcgcaaagbyghaacagagattttgwagatgtcgcaaaggcactcaggtcmagctggcactgwagcaggaaatggggcgagactctcctccaattgtcaactcmawgtactccacctwcagagatttttgttmcacatcttcatttcaagatartggctacaatgagtwaaaatcttgtagctttgat

SEQ ID NO: 3059 - DNA, 275 bp, Homo sapiens
  CDS 72..275
actgtcctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagaccgctcatagacttgacaattccacccaagacaaaatatcactatcagccc

SEQ ID NO: 3060 - DNA, 403 bp, Homo sapiens
  CDS 26..403
  misc_feature 171: s=g or c
  UNSURE 49: Xaa=Ser or Thr
acttcaggagcaagctgaaaaagaaatgtactccttgtgtcttttagcaacattaatgggagaagatgtatggtcttatgcaaagggacttcctcacatgtttcagcagggtggtgtattctacagtattatgaagaaaaccatgggtatggctgatggcaagcattgtasttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaagaaatctgagcata

SEQ ID NO: 3061 - DNA, 310 bp, Homo sapiens
  CDS 121..309
  misc_feature 240: s=g or c
  misc_feature 255: m=a or c
  UNSURE 40: Xaa=Lys or Asn
ttatacgcttgatttttaaaacctaaatgttgggcttcacatttcttccttgtaaatttcatcttggtgattgcagtctaccctctggcctttaaaaattgtctgagccttgattcgatcatgaaaccagcttacccttcccctgtgtgctggccccagttttctaaccaggtgttgaatgaactggatggactctgccagatccctccgtgcaaggctggaatcagtccattgttcaastgtgccctttggggmtgtggttcatttggctctgatttttcctatatgttctctcctccaacccccataa

SEQ ID NO: 3062 - DNA, 202 bp, Homo sapiens
  CDS 5..202
agagatggggtttctccatgttggtcaggctggtctggaactcccaacctcagatctgcccgcctcggcctcccaaagtgctgggattataggtgtgggccaccacaccggcctcccttgttctttaagatatctccaagagatgcagagccctaggctggcagcaactttctttccctggcacgacaacgacccccgcaat

SEQ ID NO: 3063 - DNA, 265 bp, Homo sapiens
  CDS 106..264
  misc_feature 103: n=a, g, c or t
aaaggatgtgacgtcactgagataaccagctcggctgttagcaactctgttagcaacgctgtttgtctttctcggaaacaacagtaacgataagcctcttggnatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcc

SEQ ID NO: 3064 - DNA, 313 bp, Homo sapiens
  CDS 159..311
  misc_feature 281: n=a, g, c or t
  UNSURE 41: Xaa=Asp or Glu
gcaacctgctcaggtccccttccacactgtggaagctttgttcttttgctctttgcaattaatcttgttactgctcactctttgggtccacactgcttttatgagctgtaacactcaccgcgaaggtctgcagcttcactcctgaagccagtgagcccatgagcccaccgggaggaacgaacaactccagatgcgccaccttaagagctgtaacactcaccgcgaaggtctgtagcttcactcctgagccagcgagaccacgaacccaccagaaggaaganactccgaacacatccgaacatcagaaggaagc

SEQ ID NO: 3065 - DNA, 183 bp, Homo sapiens
  CDS 10..183
  misc_feature 14: w=a or t
  misc_feature 116: r=a or g
  UNSURE 2: Xaa=Asp or Val
  UNSURE 36: Xaa=Lys or Arg
aggtcagagatggwcatcacatcaacaaggaagccaccaagcccggaaggtgctaaaagagcacacccaggggaccccaccatgaatgtgtcagtagcaggtgcacaaggacagargccatggccagaaagagtcccgctggaggtcagaggaagctgggacacacagcactctcaccagccc

SEQ ID NO: 3066 - DNA, 204 bp, Homo sapiens
  CDS 23..202
  misc_feature 41: k=g or t
  misc_feature 132: m=a or c
  UNSURE 7: Xaa=Asp or Tyr
  UNSURE 37: Xaa=Pro or Gln
ccttcttctaccatttgaacatatggagtatatttatattkattttattttattttatttttttgagatgaactcttgctgtttcgcccaggctggagtgcagtggcgtgatctcggctcactgcaacctcmatctcccgggttcaagcaattctcttgcctcagcctcctgagtagctgggactaccggcacccgccaccacc

SEQ ID NO: 3067 - DNA, 355 bp, Homo sapiens
  CDS 3..353
  misc_feature 300: b=c or g or t
  misc_feature 336: s=g or c
  UNSURE 100: Xaa=Gly or Arg or Trp
  UNSURE 112: Xaa=Gly or Arg
caatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaabgggtagtggaaatagttcgaggcatattggaaagasgaggtgaagtgaatgcatt

SEQ ID NO: 3068 - DNA, 168 bp, Homo sapiens
  CDS 14..166
  misc_feature 104: n=a, g, c or t
  misc_feature 145: r=a or g
  UNSURE 31: Xaa=Leu or Met or Val
atttttagtggagatggggtttctccatgttggacgaggctggtctcaaactcgacctcgggtgatccacccgcctgggcctcccaaggtgctgggattacagntgtgggccaccgtgcccggccgattcttatttttcaaaaarttacatgacaaacagcagcccat

SEQ ID NO: 3069 - DNA, 273 bp, Homo sapiens
  CDS 119..271
  misc_feature 190: n=a, g, c or t
  misc_feature 201: k=g or t
  misc_feature 202: s=g or c
  UNSURE 28: Xaa=Leu or Arg
ctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcnggaacctaccksacctttgaggcatgcaagaatacagtcactgcaactgcgaagagtttgggcaggagacagacctgggagta

SEQ ID NO: 3070 - DNA, 338 bp, Homo sapiens
  CDS 66..338
  misc_feature 60: w=a or t
  misc_feature 61: r=a or g
  misc_feature 64: n=a, g, c or t
  misc_feature 96: y=c or t
  misc_feature 101: s=g or c
  misc_feature 144: m=a or c
  misc_feature 197: s=g or c
  misc_feature 198: r=a or g
  misc_feature 234: s=g or c
  misc_feature 295: s=g or c
  UNSURE 11: Xaa= *  or Gln
  UNSURE 12: Xaa=Asp or Glu
  UNSURE 27: Xaa=Ile or Leu
  UNSURE 44: Xaa=His or Gln
  UNSURE 45: Xaa=Glu or Lys
  UNSURE 57: Xaa=Ala or Pro
  UNSURE 77: Xaa=Ala or Gly
attggccccacctccaattctctgggctctgcctcccacactcgcctgggagccgcaggwragngatgctggtgcccacgctccccgctgccgggyaggascccccacccaccaccgaagctggggctaggctctttgatctgmtcctgccccgaggggagcctaaaagccaaagccacgtcttccaccggtggcasragcaccttcctcgtgtcctccttggttgctgcgcascctgggcctcctgctcctgttcgtttcaggggcctctgcccttcccgccggtgtgcacagscccaggttctgccttgagaactctcccctctgcagtggaaaga

SEQ ID NO: 3071 - DNA, 251 bp, Homo sapiens
  CDS 12..251
  misc_feature 15: w=a or t
  misc_feature 36: w=a or t
  misc_feature 95: d=a or g or t
  misc_feature 96: w=a or t
  misc_feature 100: w=a or t
  misc_feature 119: w=a or t
  misc_feature 132: k=g or t
  misc_feature 208: d=a or g or t
  misc_feature 230: k=g or t
  misc_feature 240: k=g or t
  misc_feature 242: w=a or t
  UNSURE 2: Xaa=Ser or Thr
  UNSURE 9: Xaa=Cys or Ser
  UNSURE 29: Xaa=Ser or Thr
  UNSURE 30: Xaa=Leu or Gln
  UNSURE 41: Xaa=Ala or Ser
  UNSURE 66: Xaa=Leu or Gln or Arg
  UNSURE 73: Xaa=Ile or Met
  UNSURE 77: Xaa=Ala or Ser
agtcttggttcatgwctacccgtcttaccaataggwgttcccactccgtaacctttggagtcaatgaggcccccgatctgagtgaggttgcagtdwctcwgcgtcacatactcaatgcwgggtggactccakcagcagcgcgtagtctgtggtggagatttttgatttctggagggaaagaaaacacactcaccagcagaagagggcdggaaaaatacgacctaaagatkcttttatackcwaccacaagc

SEQ ID NO: 3072 - DNA, 361 bp, Homo sapiens
  CDS 136..360
  misc_feature 321: m=a or c
ataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcmaaagaagcagaaaatgaaaagatgaaggccatcggtgccc

SEQ ID NO: 3073 - DNA, 247 bp, Homo sapiens
  CDS 73..246
  misc_feature 104: r=a or g
  misc_feature 117: m=a or c
  misc_feature 169: r=a or g
  misc_feature 239: y=c or t
  UNSURE 11: Xaa=His or Arg
  UNSURE 15: Xaa=Phe or Leu
  UNSURE 33: Xaa=Ala or Thr
  UNSURE 56: Xaa=Leu or Ser
atcaacaccagacctgtcctacaagaagtgctagctaaagagagttcttcaatctgaaagaaaaagaccttaatgggcattaagaactcatctgaagcaggtcrtaagacctcattmaagaggtaccttccctatacccagaggaaagaagcattcttatcttcaaagrcacagaaatgtcaagaggaatctgaacaaacaggctttgctaagttcttctcaattactaccgttagatyataccacc

SEQ ID NO: 3074 - DNA, 243 bp, Homo sapiens
  CDS 57..242
  misc_feature 11: s=g or c
  misc_feature 36: y=c or t
  misc_feature 52: r=a or g
  misc_feature 53: r=a or g
  misc_feature 73: r=a or g
  misc_feature 74: r=a or g
  misc_feature 77: r=a or g
  misc_feature 78: s=g or c
  misc_feature 105: m=a or c
  misc_feature 122: s=g or c
  misc_feature 123: m=a or c
  misc_feature 126: m=a or c
  misc_feature 127: m=a or c
  misc_feature 133: m=a or c
  misc_feature 134: r=a or g
  misc_feature 180: n=a, g, c or t
  UNSURE 6: Xaa=Lys or Arg
  UNSURE 8: Xaa=Ala or Pro
  UNSURE 17: Xaa=Lys or Gln
  UNSURE 22: Xaa=Lys or Asn
  UNSURE 23: Xaa=Lys or Gln
  UNSURE 24: Xaa=His or Asn or Pro or Thr
  UNSURE 26: Xaa=Ala or Glu
  UNSURE 42: Xaa= *  or Glu or Lys or Gln
taattacatastcatctataaatatatacaaatcayataaatttagtaaatrraatatgtggcatatgatgarrgtrsctgtcaccatggagaaagaaggagggmaaaatacctttaaaaasmaammtaaggmraattcaacaagccagcgcgtccacaccaacatgctcaggtgccttnagtgcaataaacagcatgttcggcggctcgctttctgcaggaatcctttttcagtgctccctt

SEQ ID NO: 3075 - DNA, 390 bp, Homo sapiens
  CDS 160..390
  misc_feature 315: n=a, g, c or t
  misc_feature 316: n=a, g, c or t
  misc_feature 321: n=a, g, c or t
  misc_feature 322: n=a, g, c or t
  UNSURE 52: Xaa=Ile or Met
  UNSURE 53: Xaa=Ala or Pro or Ser or Thr
  UNSURE 54: Xaa=Lys or Asn
  UNSURE 55: Xaa=Ala or Pro or Ser or Thr
agaagctctcaaatatcactgttgtgaatacagagagggaaaaccaactgtaacgtgccacccaaataaagctcattactagtcctgtccagcaacgtgcctctcctggccctagagttcttggaaatagcccaggccaaagagaaggcctttctccccatggtcagccacacgttccacatgcgcacagaggagtctgatgcctcacaggagggcgatgacctacccaagtcctcagcaaacaccagccatcccaagcaggatgacagccccaagtcctcagaagaaaccatccagcccaaggagggtgacatnnccaannccccagaagaaaccatccaatccaagaaggaggacctccccaagtcctcggaaaaagccacccagccc

SEQ ID NO: 3076 - DNA, 341 bp, Homo sapiens
  CDS 114..341
  misc_feature 102: r=a or g
  misc_feature 108: m=a or c
  misc_feature 171: n=a, g, c or t
  misc_feature 243: r=a or g
  misc_feature 273: m=a or c
  misc_feature 278: s=g or c
  UNSURE 20: Xaa=Asp or His or Asn or Tyr
  UNSURE 44: Xaa=Asp or Asn
  UNSURE 54: Xaa=Arg or Ser
  UNSURE 55: Xaa=Lys or Asn
aggcagattccacttggcacttttcaggggacattcagaggcatcagccccttcctcctcaccagctcccagagttcccatctccatccccaatcctaaagraaggamatcggatgccacggtcctcaaggagccctggggacccaggcgccctactcgaagatgtggccnacaatcccagaccccggaggattgcccagcgaggccggaacaccagcaggatggcagatgacacctccccaracatgaatgacaacatcctgttgcctgtcmgcaasaatgaccaagccctaggcctgactcagtgcatgctgggatgtgtgtcctggttcacctgtttt

SEQ ID NO: 3077 - DNA, 359 bp, Homo sapiens
  CDS 146..358
  misc_feature 109: w=a or t
  misc_feature 117: r=a or g
  misc_feature 118: m=a or c
  misc_feature 143: r=a or g
  misc_feature 144: n=a, g, c or t
ataaaaataaaaatcggagttttattcaaccaatcccttctgcatgtgtggaaactgtggtggggcccatccctgccctggaagatcctttgcaaaaagagttctgtawtactaggrmactgacattttggagggacaagctrncatgaaagtaaatgtcaggctttctgtccagagagtgcctaccaaggatgaggcaggactggcttcctggaaggggaaatatgtaacaggtgtgagctggaacagaagaagcctcacagtcaaggaagatagctcattttccagccgaaaaatgatgacaggcataatggggacactgggttgggggagggtttatgtttggaaaaggaaggagc

SEQ ID NO: 3078 - DNA, 372 bp, Homo sapiens
  CDS 140..370
  misc_feature 113: n=a, g, c or t
  misc_feature 114: h=a or c or t
  misc_feature 136: r=a or g
  misc_feature 237: w=a or t
  misc_feature 254: n=a, g, c or t
  misc_feature 283: m=a or c
  misc_feature 291: n=a, g, c or t
  misc_feature 292: d=a or g or t
  misc_feature 329: n=a, g, c or t
  misc_feature 330: r=a or g
  UNSURE 33: Xaa=Ile or Asn
  UNSURE 39: Xaa=Ala or Pro or Ser or Thr
  UNSURE 48: Xaa=Phe or Leu
  UNSURE 51: Xaa= *  or Cys or Phe or Leu or Ser or Trp or Tyr
  UNSURE 64: Xaa= *  or Glu or Gly or Lys or Gln or Arg
acaagaaaagaacatggtctagactgaagtaccaactaaatcatctcctttcaaattatcaccgacaccatcatggattcaagcaccgcacacagtccggtgtttctggtatnhcctccagaaatcactgcttcaraatatgagtccacagaactttcagccacgaccttttcaactcaaagccccttgcaaaaaattatttgctagaaaaatgaaaatcttagggactatccagawcctgtttggaattatgnccttttcttttggagttatcttccttttmaccttgtndaaaccatatccaaggtttccctttatatttctttcanratatccattctggggctctgttttgttcattaattctggagc

SEQ ID NO: 3079 - DNA, 322 bp, Homo sapiens
  CDS 67..321
  misc_feature 49: h=a or c or t
  misc_feature 117: w=a or t
  misc_feature 126: m=a or c
  misc_feature 132: w=a or t
  misc_feature 133: v=a or c or g
  misc_feature 155: w=a or t
  misc_feature 193: r=a or g
  misc_feature 212: n=a, g, c or t
  misc_feature 310: m=a or c
  UNSURE 20: Xaa= *  or Tyr
  UNSURE 23: Xaa=Glu or Lys or Gln
  UNSURE 30: Xaa=Glu or Val
  UNSURE 43: Xaa=Ala or Thr
  UNSURE 49: Xaa= *  or Leu or Ser or Trp
gaggggcatatttatggaggggactctccagggctagatgattcaagghtggcaacacaatgagccatggaggtggctgggggagcctgttgggagagtagggagggatctggagcwggaaactamcaagcwvaatccaaagagatatccaaggwgggtcctgggacaagagtgacggctgagatggggatgrcgagcagctgccctacctngatggaaggccaagtgcagtggctcacacccgtaaccccagcacttttggaggctgagatgggaggatcacttgagaccaggagttcgcgaccagccmggagatgctata

SEQ ID NO: 3080 - DNA, 249 bp, Homo sapiens
  CDS 29..247
  misc_feature 107: k=g or t
  misc_feature 117: w=a or t
  UNSURE 27: Xaa=Asp or Tyr
  UNSURE 30: Xaa= *  or Leu
caatttcatctgtatccctacaaaggacatgaactcatcatttttttttaattttttttatttattttatttttttattttttatttttattattattattattttkattatacttwaagttttagggtacatgtgcacattgtgcaggttagttacatatgtatacatgtgccatgctggtgcactgcacccactaacttgtcatctagccttaggtatatctcccaatgctatccctccccgctcaa

SEQ ID NO: 3081 - DNA, 171 bp, Homo sapiens
  CDS 9..170
ataatggaatggaagtgaatggaatcaacacgagtgcaggggaatggaatggaatggaatgcaatggaatggaatcatccggaatggaatggaatggaatggaatcaactccattgcaatggaatggaatggaatggaatggaatagaatggaatggaattaacccgatga

SEQ ID NO: 3082 - DNA, 192 bp, Homo sapiens
  CDS 1..192
  misc_feature 12: s=g or c
  misc_feature 84: s=g or c
  misc_feature 105: s=g or c
  UNSURE 28: Xaa=His or Gln
atgaacgatggsttctttctaaaagtaacagccctgactcagaagcctgatgtctacatccccgagaccctggagcccgggcasccggtgacggtcatctgtgtstttaactgggcctttgaggaatgtccacccccttctttctcctggacgggggctgccctctcctcccaaggaaccaaaccaacgacc

SEQ ID NO: 3083 - DNA, 233 bp, Homo sapiens
  CDS 50..232
  misc_feature 25: k=g or t
  misc_feature 146: r=a or g
  UNSURE 33: Xaa=Asp or Asn
tgggaatcacgctgatgtgacgcakttaaatttacaccttaaaaaatggatgccaagacaacataaacaagacccagggacaccaacagggtatggtgctgtgccccagagtcagggtcctgggttcttacccagggaagtgagarataaagataacttttccctgctccctctctcctcccctgacactgatcttcccaccctgtacctccctcttctgctcccaaaccccc

SEQ ID NO: 3084 - DNA, 208 bp, Homo sapiens
  CDS 30..206
caattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcaca

SEQ ID NO: 3085 - DNA, 276 bp, Homo sapiens
  CDS 73..276
ttcacggaggcgtccacgtttgcgggcgagaaggtgttgggctcgttcaggagggagatcacactcaggagaatggtcctgtggggagagtgggtcggagtggggcggcccggggcaccccagccttccggctcttctctggccctgagggtcacggggacgcctggacccacccagcaggtgaccttcatctggcctcatggcctctgcttttgtctcaggcccccagaacagcaggggctggacctgcatcagtctcctccctcccacgcctat

SEQ ID NO: 3086 - DNA, 291 bp, Homo sapiens
  CDS 120..290
tttgtatttttagtagagacggggtttcatcatgttggccaggctggtcttaacttctgacctcaagtgatgtacccccgttggcctcccagagtgctaggattacaagcgtgagcaccatgcccggcctgttggactttatatcctcagaaatttatacaaagcctaaaataatatcactattaacaattataataataatgattagcatttgtttttattaccaggatagatccatcaatgttcagtgtgttgtttgtgtttttactcatttacccttcacagtaagcc

SEQ ID NO: 3087 - DNA, 356 bp, Homo sapiens
  CDS 183..356
  misc_feature 347: s=g or c
  misc_feature 348: h=a or c or t
  UNSURE 55: Xaa=Asp or Glu
  UNSURE 56: Xaa=His or Asn or Tyr
aactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgashatgtgcac

SEQ ID NO: 3088 - DNA, 221 bp, Homo sapiens
  CDS 62..220
atttcctgcctatcatttgaagacgttccttgaggaggtttgaaaaaatgcggtttgcctcatgtcacccagcctggaatgcagtggcgcgatctcggctcattgcaacctccgcctcctgggttcaggcgattctcctgcctcggcctcccgagtatctgggattgcagccatgcgcctccacgcccagctaatttttgtattttcagtagagacggact

SEQ ID NO: 3089 - DNA, 214 bp, Homo sapiens
  CDS 47..214
  misc_feature 3: b=c or g or t
  misc_feature 10: n=a, g, c or t
atbatgatcntcatatatcacatactgtactagaagaatagaggttatgattggactagacagagagtgccagagcaagtatctgtgggatgctgagatgaagatattcaactttctatctaacaaagtagatccagagcctggaagaaaaacagaggctaagatacagatactggaaaccctcatgcagggactttttttttttttttttttt

SEQ ID NO: 3090 - DNA, 357 bp, Homo sapiens
  CDS 178..357
aggaaagcagctgagatccagaggagtggaaggctcccccttgactaaagcttttttgccctaataaccctgcaggttggtactcaggacagttttatagctgcagtgtatgaacatgctgtcattttgccaaataaaacagaaacaccagtttctcaggaggatgccttgaatctcatgaacgagaatatagacattctggagacagcgatcaagcaggcagctgagcagggtgctcgaatcattgtgactccagaagatgcactttatggatggaaatttaccagggaaactgttttcccttatctggaggatatcccagaccctcaggtgaactggattccgtgtcagaccccc

SEQ ID NO: 3091 - DNA, 224 bp, Homo sapiens
  CDS 34..222
  misc_feature 97: n=a, g, c or t
  UNSURE 22: Xaa=Phe or Ile or Leu or Val
cagcaagtgttcgcgtcccccagtaaacaccccatggacagcaagggggaggagtccaagatcagctaccccaacatcttcttcatgattgacagcntcgaggaggtgttcagcgacatgaccgtagggaaggagagatggtctgtgtggagctggtggctagtgacaaaaccaacacgttccagggggtcatctttcagggctccatccgctacgaggcggct

SEQ ID NO: 3092 - DNA, 380 bp, Homo sapiens
  CDS 183..380
  misc_feature 252: k=g or t
  UNSURE 24: Xaa= *  or Glu
tagaggcatctagacagacccaggtcacaagaagtgcaaagaaagagagtgaggcagggaattattgagattttcctgaaaacgatggttctagctttggctgtattttcaagatagagggatcatttagcaacagagaggaaatagagtgtaagagcgttcccattagagtgttgggccgaatgcaaatgagggtgctatgccttttcctcaactacacaaagcaaatgggtaggtctagtgaaggcagakaggccagctcccttccaggaaaggctttgttctcactacctatgaaggcagcagtgttgacagtgaaagaaaccgtttctcagctctgtttgcccgctgtaggcacaacgatctatgacagagaggcc

SEQ ID NO: 3093 - DNA, 415 bp, Homo sapiens
  CDS 42..413
  misc_feature 52: y=c or t
  UNSURE 4: Xaa=Phe or Ser
agagaggcgagcaccgggaaggggagcgtggggccgctggaatgggtgaatytaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgt

SEQ ID NO: 3094 - DNA, 183 bp, Homo sapiens
  CDS 12..182
ctgctgggaaaatgaacatcagtgttgatttggaaacgaattatgccgagttggttctagatgtgggaagagtcactcttggagagaacagtaggaaaaaaatgaaggattgtaaactgagaaaaaagcagaatgaaagggtctcacgagctatgtgtgctctgctcaattctggagggggat

SEQ ID NO: 3095 - DNA, 376 bp, Homo sapiens
  CDS 69..374
  misc_feature 367: m=a or c
  UNSURE 100: Xaa=Lys or Thr
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagamaaccagcgc

SEQ ID NO: 3096 - DNA, 392 bp, Homo sapiens
  CDS 210..392
  misc_feature 256: n=a, g, c or t
  misc_feature 260: d=a or g or t
  misc_feature 326: w=a or t
  misc_feature 338: m=a or c
  UNSURE 16: Xaa=Ile or Lys or Arg or Thr
  UNSURE 17: Xaa=Asp or Glu
  UNSURE 39: Xaa=Asp or Glu
tatctagacaagaagaacttaaggaaagagcaagagttctgcttgagcaagcaagaagagatgcagccttaaaggcggggaataagcacaataccaacacagccaccccattctgcaacaggcagctaagtgatcaagatgaagagcgacgtcggcagctgagagagagagctcgtcagctaatagcagaagctcgatctggagtgaagatgtcagaacttcccagctatggtgaaatggctgcagaaaagttganagadaggtcaaaggcatctggagatgaaaatgataatattgagatagatactaacgaggagatccctgawggctttgttgtmggaggtggagatgaacttactaacttagaaaatgaccttgatactcccgaacaa

SEQ ID NO: 3097 - DNA, 263 bp, Homo sapiens
  CDS 28..261
gaggacttgtcattttgatacacaattatgctttattttctttttatttatttatttatttttaaattttttttatttatttttttcctttttttctctttttttaattattattatactttaagttttagggtacatgtgcacaacgtgcaggttacttacatatgtatacatgtgccatgctggtgcgctgcacccactaactcgtcatctagcattatgtatatctcctggtgctatccctgccccctccccccacccct

SEQ ID NO: 3098 - DNA, 287 bp, Homo sapiens
  CDS 80..286
  misc_feature 22: s=g or c
  misc_feature 94: m=a or c
  misc_feature 97: y=c or t
  misc_feature 103: k=g or t
  misc_feature 213: d=a or g or t
  UNSURE 5: Xaa=His or Gln
  UNSURE 45: Xaa=His or Leu or Arg
cttttgtgctgcggccgcggasccccgagggcccagtgttcaccatcataccaggggccagaggcgatggcttgcctccatgagacccgaacamccytctccktcctttgggggctttgtgtctaccctaagtgaggcatccattcgcaagctggacccagacacttctgactgcactcccgagaaggacctgacgcctacccagtgtgtacdtcgagatgtggtaccccttggtgggcagggtgggggagggcccagcccctccccaggtggagagccgccccctt

SEQ ID NO: 3099 - DNA, 415 bp, Homo sapiens
  CDS 208..414
  misc_feature 52: k=g or t
  misc_feature 54: w=a or t
  misc_feature 67: k=g or t
  misc_feature 95: y=c or t
  misc_feature 105: h=a or c or t
  misc_feature 106: r=a or g
  misc_feature 231: w=a or t
  UNSURE 8: Xaa=Asp or Glu
taatcgaaaaattgggatctaagtaaactaaagagcttctgcacagcaaaakawaccaccgtcagaktgaacaggcaacctatagaatgggagayaatttttachrtctacttatctgacaaagggctaatatccagaatctacaaagaactccaacaaatttacaagataagaacaaacaaccccatcaaaaagtgggcaaaggatatgaacagacacttctcaaaagawgatatttatgcagccaacagacacacaaaaaaatgctcatcatcactggccatcagagaaatgcaaatcaaaaccacaatgagataccatctcacaccagttagaatggcgatcattaaaaagtcaggaaacaacaggtgctggagaggatgtggagaaatagaaacacttttacactgttggg

SEQ ID NO: 3100 - DNA, 363 bp, Homo sapiens
  CDS 208..363
  misc_feature 291: v=a or c or g
  misc_feature 297: r=a or g
  misc_feature 303: v=a or c or g
  misc_feature 308: m=a or c
  misc_feature 309: r=a or g
  misc_feature 325: r=a or g
  misc_feature 343: r=a or g
  UNSURE 28: Xaa=Asp or Glu
  UNSURE 32: Xaa=Lys or Asn
  UNSURE 34: Xaa=Lys or Thr
  UNSURE 40: Xaa=Ala or Thr
  UNSURE 46: Xaa=Ile or Val
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagavatgcaratcaavaccamratgagataccatctcrcaccagttagaatggcgrtcattaaaaagtcaggaaca

SEQ ID NO: 3101 - DNA, 401 bp, Homo sapiens
  CDS 138..401
  misc_feature 97: m=a or c
  misc_feature 101: m=a or c
  misc_feature 104: k=g or t
catttcacttggctagaaattacactgtgctcaatgccttaataaatccctgaaagaaataaaaaccactgtgtgcaatgccttgctgtggcccccmaacmackgcttaggcctcccaacttctccccaggccaagtatggggctctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagc

SEQ ID NO: 3102 - DNA, 239 bp, Homo sapiens
  CDS 39..239
  misc_feature 97: s=g or c
  UNSURE 20: Xaa=Pro or Arg
taaaagaaaaaacggggagaaaaaaatagcttctattgatgagttttatcatctcaattgaatctttcctttccctgatgaagacagctggtgggcsaagtgcggcaaagaagccagaaggaaccagaatcccagtgccctacacccaccaccagacacactcacacccacacacgttctcagacacacacaagagtgcttgccggttataccaaaccctactattactgcctgcaaaa

SEQ ID NO: 3103 - DNA, 390 bp, Homo sapiens
  CDS 209..388
  misc_feature 83: k=g or t
  misc_feature 95: m=a or c
  misc_feature 96: b=c or g or t
  misc_feature 103: k=g or t
  misc_feature 261: r=a or g
  misc_feature 303: r=a or g
  misc_feature 304: r=a or g
  misc_feature 362: r=a or g
  UNSURE 18: Xaa=Lys or Arg
  UNSURE 32: Xaa=Lys or Arg
  UNSURE 52: Xaa=Asp or Asn
taatcgaaaaattgggatctaagtaaactaaagagcttctgcacagcaaaagaaaccaccgtcagagtgaacaggcaacctakagaatggggagmbaattttkacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaraaaatgctcatcatcactggccatcagagaaatgcaaatcarraccacaatgagataccatctcacaccagttagaatggcgatcattaaaaagtcaggaracaacaggtgctggagaggatgtggaga

SEQ ID NO: 3104 - DNA, 387 bp, Homo sapiens
  CDS 207..386
  misc_feature 63: r=a or g
  misc_feature 80: d=a or g or t
  misc_feature 82: r=a or g
ctccaaggcttcatggctcccaagcaaaagagaagaaaactccaaagtgaagattcagcaaaractgaggaagtggatgdaragaagaaaatggtagaggaagcaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaaga

SEQ ID NO: 3105 - DNA, 394 bp, Homo sapiens
  CDS 173..394
  misc_feature 267: r=a or g
  UNSURE 32: Xaa=Glu or Gly
aagaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgagaaactgtgagcaagagcgtctgtgctgraccatggcgccaccagaggtcgcgcgatcccgccccaaccaacttcccgctgaagtgccagaagcagcgaggagcttcaacttcctcagggcagcacgggggtcgtgttaatttggtgttcttcatt

SEQ ID NO: 3106 - DNA, 392 bp, Homo sapiens
  CDS 208..390
  misc_feature 351: m=a or c
  misc_feature 389: v=a or c or g
  UNSURE 48: Xaa=Lys or Asn
  UNSURE 61: Xaa=Ala or Glu or Gly
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaamaagtcaggcaacaacaggtgctggagaggatgtggagvaat

SEQ ID NO: 3107 - DNA, 331 bp, Homo sapiens
  CDS 89..331
tcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcact

SEQ ID NO: 3108 - DNA, 301 bp, Homo sapiens
  CDS 34..300
  misc_feature 87: n=a, g, c or t
  UNSURE 18: Xaa=His or Gln
agaacagctctgcagagaggatcggcggggaccatggcgggctccccagaccaggagggcttcttcaatctgctgagccacgtgcanggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctggga

SEQ ID NO: 3109 - DNA, 354 bp, Homo sapiens
  CDS 160..354
  misc_feature 108: r=a or g
  misc_feature 196: r=a or g
  misc_feature 326: m=a or c
  UNSURE 13: Xaa=Ile or Val
  UNSURE 56: Xaa=His or Pro
ccctattcataataactctattgccaacaaagtcctatcgtctatttccctccaaaaacaagatctagaaggcaagaattttctcagctgcctctcctctactttcaractcagttacatcttgtattttcctatctccttcctcgtatctctccacctatgctttcctgcccccatcctgtgctttcaatcctartccctcctgacttctctagagccttacttggtcaattacgcattatttttcaaaacgtcactctttcgtgttctgttgcctccttctcgccctataaaggtggtttaaatcttcctgagttcacctcacmctgcttctccctcagtctcactgtacct

SEQ ID NO: 3110 - DNA, 239 bp, Homo sapiens
  CDS 6..239
tggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactcac

SEQ ID NO: 3111 - DNA, 364 bp, Homo sapiens
  CDS 209..364
  misc_feature 89: k=g or t
  misc_feature 95: n=a, g, c or t
taatcgaaaaattgggatctaagtaaactaaagagcttctgcacagcaaaagaaaccaccgtcagagtgaacaggcaacctatagaatkgggagncaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggaaca

SEQ ID NO: 3112 - DNA, 337 bp, Homo sapiens
  CDS 119..337
aaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccaggcc

SEQ ID NO: 3113 - DNA, 372 bp, Homo sapiens
  CDS 208..372
  misc_feature 296: m=a or c
  misc_feature 301: v=a or c or g
  misc_feature 341: s=g or c
  misc_feature 360: r=a or g
  misc_feature 362: r=a or g
  UNSURE 30: Xaa=Pro or Gln
  UNSURE 32: Xaa=Glu or Lys or Gln
  UNSURE 45: Xaa=Ala or Gly
  UNSURE 52: Xaa=Asn or Ser
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcmaatcvaaaccacaatgagataccatctcacaccagttagaatggsgatcattaaaaagtcaggrarcaacaggtgc

SEQ ID NO: 3114 - DNA, 232 bp, Homo sapiens
  CDS 31..231
  misc_feature 212: k=g or t
  UNSURE 61: Xaa= *  or Leu
atttttcaccactgcatagtgttacattgtatgattttcccacattgcatgtactgtttagagtgtataactaagaatggattgctaggtttaaaggtgcttccactctatgggataatgctaatttttttccctaaagtggtttataacaatcaacccttgcactacaagtcagtaatggtgtttcagttgacttcattcttgtcgatttkaatttttgtcaaccccactc

SEQ ID NO: 3115 - DNA, 299 bp, Homo sapiens
  CDS 141..299
cacaatatctgcaaaaacaaacaaacaaacaaacacttaggaatatatctaatcaaggatgtgaaagacctctacaaggaaaactacgaaacactgctgaaagaaatcatagatgacacaaacaaatagaaacatatcccatgctcatggatggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagccccaac

SEQ ID NO: 3116 - DNA, 440 bp, Homo sapiens
  CDS 208..438
  misc_feature 89: k=g or t
  misc_feature 360: r=a or g
taatcgaaaaattgggatctaagtaaactaaagagcttctgcacagcaaaagaaaccaccgtcagagtgaacaggcaacctatagaatkggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggraacaacaggtgctggagaggatgtggagaaatagaaacacttttacactgttggggggctgtaactagttcaatcattgt

SEQ ID NO: 3117 - DNA, 357 bp, Homo sapiens
  CDS 62..355
taaaattcacctagcataccttgcagatttattcaaacacttaaatgaactcagtgcatctatgcagaggactgggatgaacacagtatcagctagagagaagttatctgcttttgttaggaagtttccattttggcaaaaacgaattgagaaaagaaattttaccaattttccttttcttgaagaaataattgtttcagataatgaaggcatattcattgcagctgaaataacactgcatctgcaacaattgagcaacttcttccatggatatttttccattggagatcttaatgaggcaagtaaatggatattggatccatttctttttaatatcgattttgttgatgatagtta

SEQ ID NO: 3118 - DNA, 356 bp, Homo sapiens
  CDS 87..356
  misc_feature 97: w=a or t
  misc_feature 108: k=g or t
  misc_feature 118: r=a or g
  misc_feature 153: s=g or c
  misc_feature 173: r=a or g
  misc_feature 290: v=a or c or g
  misc_feature 300: r=a or g
  misc_feature 303: r=a or g
  UNSURE 4: Xaa=Ile or Asn
  UNSURE 8: Xaa=Asp or Tyr
  UNSURE 11: Xaa=Asp or Gly
  UNSURE 23: Xaa=Glu or Gln
  UNSURE 68: Xaa=Asp or Glu
  UNSURE 72: Xaa=Glu or Lys
  UNSURE 73: Xaa=Ala or Thr
taatcgaaaaattgggatctaagtaaactaaagagcttctgcacagcaaaagaaaccaccgtcagagtgaacaggcaacctatagaatgggagacawttttacaatckacttatctgrcaaagggctaatatccagaatctacaaagaactcsaacaaatttacaagaaaagracaaacaaccccatcaaaaagtgggcaaaggatatgaacagacacttctcaaaagaagatatttatgcagccaacagacacacaaaaaaatgctcatcatcactggccatcagagavatgcaaatcraarccacaatgagataccatctcacaccagttagaatggcgatcattaaaaagtca

SEQ ID NO: 3119 - DNA, 347 bp, Homo sapiens
  CDS 134..346
  misc_feature 245: r=a or g
  UNSURE 38: Xaa=Glu or Lys
aattatttcttatttatccgaaattcaagtttaaatggatgccttgtatttttatttgctaaatctggcaaatctacttcccatacaacccagacatttcacctccatgtaattacccaagagaaataaaaatatgtccacgtgtacaccaatgtttacagcagcctctctttctctctctttctttatttctcccttccttccttccttcctttcacagactcccactctgttgcccaggctgragtgcagtgctgtgatttccggtcgctgcaacctccgcttcccaggttcaggtgattctcatgcctcagcttcccaagaagctgggattacggacgcgcccc

SEQ ID NO: 3120 - DNA, 377 bp, Homo sapiens
  CDS 209..376
  misc_feature 86: w=a or t
  misc_feature 88: w=a or t
  misc_feature 93: h=a or c or t
  misc_feature 95: m=a or c
  misc_feature 298: r=a or g
  misc_feature 337: m=a or c
  UNSURE 43: Xaa=Arg or Ser
taatcgaaaaattgggatctaagtaaactaaagagcttctgcacagcaaaagaaaccaccgtcagagtgaacaggcaacctatagwawtggghgmcaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaratcaaaaccacaatgagataccatctcacaccagttagmatggcgatcattaaaaagtcaggaaacaacaggtgctgga

SEQ ID NO: 3121 - DNA, 206 bp, Homo sapiens
  CDS 23..205
  misc_feature 112: k=g or t
  misc_feature 115: k=g or t
  misc_feature 119: k=g or t
  misc_feature 206: k=g or t
  UNSURE 31: Xaa=Phe or Leu
  UNSURE 33: Xaa=Phe or Val
caaatttcatctttccaaattgatgggtgggctagtaataaaatatttaaaaaaaaaacattcaaaaacatggccacatccaacatttcctcaggcaattccttttgattckttkttcktccccctccatgtagaagagggagaaggagaggctctgaaagctgcttctgggggatttcaagggactgggggtgccaaccacctck

SEQ ID NO: 3122 - DNA, 362 bp, Homo sapiens
  CDS 114..362
  misc_feature 326: r=a or g
ttttatagagatagggtctcactatgctggccagtctggtcttgaatgcctgggctcaagtgatcctcccgccctggcctcccaaagtgctgggattacaggtgtgagccaccatgcttggcctcatctttgtgtgtgaagatttaattaaaactccagaaaagggcagtgaccactcctttatgataccacattttaaattggcttttacatactactttctgactctacaacagtatgtttacaagtttgtagtctatctagccgtggagtttcccaagaacagacactgtcattttataggggcacaaggccagcttgaattrataatcatacctaactttaagatatcagtggaaaac

SEQ ID NO: 3123 - DNA, 454 bp, Homo sapiens
  CDS 208..453
  misc_feature 397: r=a or g
  misc_feature 413: k=g or t
  misc_feature 414: n=a, g, c or t
  misc_feature 415: r=a or g
  UNSURE 64: Xaa=Ala or Thr
  UNSURE 69: Xaa= *  or Cys or Phe or Leu or Trp
  UNSURE 70: Xaa=Gly or Arg
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggaaacaacaggtgctggagaggatgtggagaaatagaarcacttttacactgttknrgggactgtaaactagttcaatcattgtggaagacagtgt

SEQ ID NO: 3124 - DNA, 386 bp, Homo sapiens
  CDS 34..384
  misc_feature 252: m=a or c
  misc_feature 253: m=a or c
  misc_feature 290: r=a or g
  misc_feature 342: r=a or g
  misc_feature 346: w=a or t
  misc_feature 347: h=a or c or t
  UNSURE 74: Xaa=Leu or Met
  UNSURE 86: Xaa=Asp or Gly
  UNSURE 105: Xaa= *  or Lys or Leu or Met or Ser or Thr
gagctccggagccagatgtaacattgaccttaaatggtaaaagctccccagagtgaagagaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagggtcctcctaccgcagagtatcttgcagtccaactcccacgattgtmmtgactggggatgccacttcaccagaaggagaaaccgrcaaaaacctggccaacagagttcacagtccccacaagaggctttctcaccgrcacwhgaaggtgtccactgcctccctgacatctgtggaccccgc

SEQ ID NO: 3125 - DNA, 302 bp, Homo sapiens
  CDS 83..301
  misc_feature 302: n=a, g, c or t
agaggctgcgctccttccagggcccaaggactcacagcttcctccgctgccttcccggaccaacaaccccccaaaagttgtgatgcttttctttacccagtgctttggggctgtattagatctcattcatctccggtttcagcactacaaggctaaacgggttttctccgctgccgggcaacttgtctgtgtcgtcaaccccacacacaacctaaagtatgtgtccagtcggcgcgccgtcactcagagcgctccagagcaaggcagcttccaccctcaccatctctcccaccaccacaggn

SEQ ID NO: 3126 - DNA, 385 bp, Homo sapiens
  CDS 30..383
  misc_feature 304: m=a or c
  UNSURE 92: Xaa=Asn or Thr
agtaaggccccgcgggcgtcctggccgccatgtgcaccgtagtggaccctcgcattgtccggagatacctactcaggcggcagctcgggcaggggagaacattccgggaaatcacgctcctccaggagtttggggaccatcccaacatcatcagcctccttgacgtgatccgggcagagaacgacagggacatttacctggtgtttgagtttatggacactgacctgaacgcagtcatccggaagggcggcctgctgcaggacgtccacgtgcgctccatcttctaccagctcctgcgggccamccggttcctccactcggggcacgttgtgcaccgggaccagaagccgtccaatgtgctcctggatgccaactgcacagtgaa

SEQ ID NO: 3127 - DNA, 302 bp, Homo sapiens
  CDS 109..300
gatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcacac

SEQ ID NO: 3128 - DNA, 377 bp, Homo sapiens
  CDS 125..376
  misc_feature 91: r=a or g
  misc_feature 262: m=a or c
  misc_feature 349: r=a or g
  misc_feature 350: n=a, g, c or t
  UNSURE 46: Xaa=Asp or Glu
  UNSURE 76: Xaa=Ala or Pro or Ser or Thr
tagtgtttacttccgcttgacctggcccggacgccagaaaatgttccacgtgggataccctgcgtggggttcactgtagtagctgcactargtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgamtcctctccgcagctgtggcccgaaccggatttcaggaatccgccaaggaaggcgtctaaggccagcttagactttaagcgttacgtrnccgatcggagattggctgagacctggc

SEQ ID NO: 3129 - DNA, 483 bp, Homo sapiens
  CDS 151..483
  misc_feature 91: r=a or g
  misc_feature 92: s=g or c
  misc_feature 312: n=a, g, c or t
  misc_feature 313: h=a or c or t
  misc_feature 357: s=g or c
  misc_feature 452: m=a or c
  UNSURE 54: Xaa=Arg or Ser
  UNSURE 55: Xaa= *  or Lys or Gln
  UNSURE 69: Xaa=Arg or Ser
  UNSURE 101: Xaa=Ala or Asp
gccgtgttgatggtagcccagaggtagatagaagggtagctgtcctggtccaggtttggtattggtcattcatgctccaccggctcgcagrsagctgggctgttgctgtgctcttgtgctagctgtgccgcgctgcacggtgagtaagagatggaccgcttcctgggttttgtcaaggcgataagaagatctaggagaagaaaggggaaaaagtaccgaccagaagaggattaccacgagggctatgaggatgtctattattacgcttcagagcattttcgaaatgagagtccctacactaaatccgccagnhagacaaagccgcctgatggagcgttggctgtgaggagacagagsatcccagaggaattcaagggctccacagtcgtcgagctgatgaagaaggaaggcactaccctgggtctgacggtatcgggaggaattgataaggmtggcaagccaagagtatctaatctgcggcaa

SEQ ID NO: 3130 - DNA, 507 bp, Homo sapiens
  CDS 283..507
  misc_feature 346: h=a or c or t
  misc_feature 347: r=a or g
  misc_feature 407: n=a, g, c or t
  misc_feature 413: k=g or t
  misc_feature 422: s=g or c
  misc_feature 423: m=a or c
  misc_feature 499: n=a, g, c or t
  UNSURE 22: Xaa= *  or Lys or Gln or Arg or Trp
  UNSURE 42: Xaa=Ala or Glu or Gly or Val
  UNSURE 44: Xaa=Ile or Arg
  UNSURE 47: Xaa=Ala or Gly
  UNSURE 73: Xaa=Leu or Met or Val
gaaacacccccccaaaaaaagaaaacccatgacaaagctcccctgggggcctctgagtgcacaggcctctccatctgcccagcaccccaccacctgcagtccacctccccgtaagccatgcttgcctcccagccccaaccacatttggggagtttggggaatccagttcatcctctacttttgggggcagccagccaagcccactgcaagagctgaccggcacccctccactttgtcctccaccccagtgacctgacggtgaagttctggagtgtccggcggatggggccagctgctctggggacagagggcgtggccccctctcctgccctcctccctctcccthrgccttcccacaggacactgttccctcatccctcccctgcctctcaggagcctctgggtgnagagakaggctgggsmaggaaattaagctgtgaagccaaagggcattatcccttcttgttcccctcctggcagtcgtggccacattgtctcntgctgaac

SEQ ID NO: 3131 - DNA, 316 bp, Homo sapiens
  CDS 91..315
acattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccga

SEQ ID NO: 3132 - DNA, 217 bp, Homo sapiens
  CDS 28..216
  misc_feature 93: s=g or c
  UNSURE 22: Xaa=Cys or Trp
agcatttaaggaaaaacatagacgcccatgtttgtgattgatttaggaattttcaagagaaattttgaaggaattagattttgccatacatgstgggctttaaatgttaaatctcaggatgagattccacttctacttagtggcccttgcgggggttggcccttgtgggagttggtggattttctggttaagagtttagtttgtttcctccccccct

SEQ ID NO: 3133 - DNA, 364 bp, Homo sapiens
  CDS 129..362
ccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccaac

SEQ ID NO: 3134 - DNA, 266 bp, Homo sapiens
  CDS 16..264
  misc_feature 50: s=g or c
  misc_feature 102: m=a or c
  UNSURE 12: Xaa=Arg or Thr
  UNSURE 29: Xaa=Arg or Ser
caccgcgccgcatccatgttcgacaccacaccccactctggccggagcasgccaagcagctccccatcgctccggaaacggctgcagctcctgcccccaagmcggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccc

SEQ ID NO: 3135 - DNA, 177 bp, Homo sapiens
  CDS 12..176
gacaaaaacaaatggaaaaacattccatgctcatggataggaagatcaatatcatgaaaatggccatactgcccaaagtaatttatagattcaatgctatacccatcaagctaccattgactttcttcacagaattagaaaaaactaaatttcatatggaaccaaaaaagagcgcct

SEQ ID NO: 3136 - DNA, 275 bp, Homo sapiens
  CDS 84..275
  misc_feature 46: w=a or t
  misc_feature 99: n=a, g, c or t
  misc_feature 100: k=g or t
  misc_feature 164: s=g or c
  misc_feature 215: s=g or c
  misc_feature 252: s=g or c
  UNSURE 6: Xaa= *  or Gly or Ile or Leu or Arg or Val
  UNSURE 27: Xaa=Asp or Glu
  UNSURE 57: Xaa=Leu or Val
gtggtgtgtagccggcttggcgtgaccctcgcctgatccagttgtwagagttggaagcttggcagttggcctcccttcttcccatggaggacgggggcnkaacagcctttgaagaggaccagagatgcctttcccagagcctccccttgccagtgtcagcagasggcccagctgcacagaccactgctgagcccagcaggtcgttttcctcagcscacagacacctgagcagaaggaatgggctttccagastctgccagagcaggacagcgctc

SEQ ID NO: 3137 - DNA, 455 bp, Homo sapiens
  CDS 69..455
  misc_feature 391: v=a or c or g
  UNSURE 108: Xaa=Ala or Asp or Gly
tctacaacgaactcaaacaaatttacaagaaaaaaacaaacagccccatcaaaaagtgggcaaaggacatggacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataagaacacttttacactgttggtgggactgtaaactagttcaaccattgtggaagtcagtgtggcaattcctcagggatctagaactagaaataccatttgacccagccatcccattactgggtatatacccaaaggvctataaatcatgctgctataaagacacatgcacacatatgtttattgcagcactattcacaata

SEQ ID NO: 3138 - DNA, 336 bp, Homo sapiens
  CDS 84..335
  misc_feature 93: r=a or g
  misc_feature 107: s=g or c
  UNSURE 4: Xaa=Gly or Ser
  UNSURE 8: Xaa=Asp or Glu
aaaaggaaaagtccttgcaccatgtagatcagcgtcccccactttggcatcccggccggccggggacctcccagtctgcggccatgaacgcgrgcagcgagggcgasagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccacca

SEQ ID NO: 3139 - DNA, 214 bp, Homo sapiens
  CDS 7..213
aataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccct

SEQ ID NO: 3140 - DNA, 323 bp, Homo sapiens
  CDS 154..321
tgggatacatgtgcagaacgtgcagcgttgttacataggtatatatgtgccatggtggtttgctgcacccatcaacctgtcatctacattgggtatttctcctaatgctatccctccccttgcccccaacctcccaacaggcaccggtgtgtgatgttcccctccctgtgtccatatgttctcattgttcaacttccacttatgagtgagaacatgcagtgtttggttttctgttcctgtgttagtttgctgagaatgatggtttccagtgtcatccatgatcctgcaaaggacatgaactcatccttttttatggctgctca

SEQ ID NO: 3141 - DNA, 291 bp, Homo sapiens
  CDS 101..289
ctgctgacacacagttgatgtgtggtgagtatgccttcagcgctccattgtggttctgcaaatttgggaaattttaggttgtcgtttctcgaaatattttatgtccatgttctcttcccccacttggactccagctacgtgtgttgatgtggagctgggcacagccttggaggcctccttgactttcctttattccggaattttttcttcttctcagaatgggtcatctcagttgacctatcttcaaggtcacagatgcttttgccaaacaaaacctgatgtcaagctgca

SEQ ID NO: 3142 - DNA, 248 bp, Homo sapiens
  CDS 64..246
  misc_feature 98: v=a or c or g
  UNSURE 12: Xaa=His or Pro or Arg
ggctgcggtccgtgcggaggctgaggccggccgcgggcgcgaccggaggcagtttccgttactatggcaatgacggcagggactacaacaacctttcvtatgagcaaccatacccgggaaagagtgactgtagccaagctcacattggagaatttttatagcaacctaattttacagcatgaagagagagaaaccaggcagaagaaattagaagtggccatggaagaagaaggattagcagatgacga

SEQ ID NO: 3143 - DNA, 216 bp, Homo sapiens
  CDS 10..216
  misc_feature 97: v=a or c or g
  misc_feature 98: n=a, g, c or t
  UNSURE 30: Xaa=Ala or Glu or Gly or Lys or Leu or Met or Pro or Gln or Arg or Thr or Val
aaatggaccatgggcctgcccaccgacaatggccacgacagcgaccaggtgtttgagttcaacggcacccaggcagtgaggatcccggatggcgtcvngtcggtcagccccaaagagccgttcaccatctcggtgtggatgagacatgggccattcggcaggaagaaggagacaattctttgcagttctgataaaacagatatgaatcggcaccac

SEQ ID NO: 3144 - DNA, 250 bp, Homo sapiens
  CDS 76..249
  misc_feature 200: y=c or t
  misc_feature 207: r=a or g
  misc_feature 239: w=a or t
  UNSURE 42: Xaa=Phe or Ser
  UNSURE 44: Xaa= *  or Trp
  UNSURE 55: Xaa=Ile or Asn
agcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacatttttggcttttgacccactctgtgtgtyccactgragttatcttttccttaatagattcacacagawttaccccatca

SEQ ID NO: 3145 - DNA, 257 bp, Homo sapiens
  CDS 78..257
  misc_feature 95: n=a, g, c or t
  misc_feature 97: v=a or c or g
  misc_feature 98: n=a, g, c or t
  misc_feature 216: n=a, g, c or t
  misc_feature 217: n=a, g, c or t
  UNSURE 6: Xaa= *  or Tyr
  UNSURE 7: Xaa=Ala or Asp or Glu or Gly
  UNSURE 47: Xaa= *  or Ala or Glu or Gly or Ile or Lys or Leu or Pro or Gln or Arg or Ser or Thr or Val
gttctctttttcttggtgctttattagcaactctggatatttttataaaactagttacattataaacggtttcaaacatgtttaatttacattangvnttttatgtaagagtgtcatggaagcactcagcaagcaggctgattgcaatagactcagacatgcgaataaatgtaattgagagtctattcatggtgaggagtacatcccagtgccttnnacctggatttctaatcttaagtgaaatgggtgcagcatca

SEQ ID NO: 3146 - DNA, 223 bp, Homo sapiens
  CDS 22..222
ttaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccac

SEQ ID NO: 3147 - DNA, 286 bp, Homo sapiens
  CDS 87..284
ccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggacc

SEQ ID NO: 3148 - DNA, 168 bp, Homo sapiens
  CDS 2..166
  misc_feature 87: n=a, g, c or t
  UNSURE 29: Xaa= *  or Leu or Ser or Trp
aatggaaggatccgagcctgtggccgcccatcagggggaagaggcgtcctgttcttcctgggggactggcagcacaaataaaaattngcccattatgtcaacagcatctgtggaaatcgatgatgcattgtacagtcgacagaggtacgttcttggagacacagcaat

SEQ ID NO: 3149 - DNA, 306 bp, Homo sapiens
  CDS 65..304
  misc_feature 250: r=a or g
  misc_feature 288: r=a or g
  misc_feature 294: r=a or g
  UNSURE 75: Xaa=Asp or Gly
  UNSURE 77: Xaa=Glu or Gly
gttgctgggggaatgcagaagcggccgcgggctagcaagctcccggagccggcggcgcaccaccatgacccagtcggtggtcgtacaggtcggccagtgcggaaaccagatcggctgctgcttctgggacctggcactaagggagcacgccgcggtcaaccagaaaggaatttatgatgaggcaataagcagcttctttagaaatgtggacaccagagtggttggtgatggtggaagtatttccaagggraaaatatgttctttaaaagcacgagcagtcttgattgrtatggragaaggggtgat

SEQ ID NO: 3150 - DNA, 397 bp, Homo sapiens
  CDS 195..395
cgattatttgccctaagtcacacaccgatgctgtttcagacaaagtaggcattcaataaatgtttgatacatagtttaaaatctttgaagaaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatatt

SEQ ID NO: 3151 - DNA, 281 bp, Homo sapiens
  CDS 81..281
gtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggtcg

SEQ ID NO: 3152 - DNA, 426 bp, Homo sapiens
  CDS 41..424
  misc_feature 285: b=c or g or t
  misc_feature 340: s=g or c
  UNSURE 82: Xaa=Leu or Pro or Arg
cacactggatgctcaagatgttttagcacatttggttcaaatggcatttaaatacttggttcactgtcttcaatcagaacttaataattacatgccagcctttctagatgaccctgaagagaacagtctgcaacgaccaaaaatagatgatgtgctgcacacgctcacaggagccatgtccttgctacgacgctgcagagtcaatgccgccctgaccatccagctcttctctcagctcttccacttcatcaatatgtggctgttcaatagattggtgaccgaccbagattcggggctgtgctcccattactggggtgcgattatccgtcagcagttgggscatattgaagcctgggctgagaagcaggggctgggaactggctgcggactgtcatctgagcaggatcgtgcaggcaacgactttgc

SEQ ID NO: 3153 - DNA, 304 bp, Homo sapiens
  CDS 75..302
  misc_feature 83: y=c or t
ctagcttccttccccgcctccatactgttttaggcagcaccgtttatgtgacagagtccgtgtttctcaaatgcatggtggtycctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagaga

SEQ ID NO: 3154 - DNA, 259 bp, Homo sapiens
  CDS 79..258
  misc_feature 229: n=a, g, c or t
  UNSURE 51: Xaa=Ile or Leu or Val
cacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttantagggagtcattattctgtggtacaatgct

SEQ ID NO: 3155 - DNA, 181 bp, Homo sapiens
  CDS 15..179
  misc_feature 24: d=a or g or t
  UNSURE 4: Xaa=Asp or Asn or Tyr
attgaaggactgagatgcctctgdacccgcttcgagttcgactggtttcgcatctcaacaactacgcttcccagcgggaagccggcgagcggcggcccacgcgggcctcggacacattccctgggggaccgtcttcggacatcacccgcacatcgcgcacccgctgttgctgccccagcct

SEQ ID NO: 3156 - DNA, 385 bp, Homo sapiens
  CDS 134..385
  misc_feature 337: n=a, g, c or t
  misc_feature 338: n=a, g, c or t
  misc_feature 339: m=a or c
  UNSURE 68: Xaa=Asp or Glu
  UNSURE 69: Xaa=Ala or Asp or His or Asn or Pro or Ser or Thr or Tyr
tccagtgccccaaggtctctgcactgccgcccctcctcacaggagacggacacctcagcctagatcccttggtgctctccacgctgttcaggctgaattgaagatccctcttacccgccaggtgccaagaactatgaacaggcagggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgannmtgatgaccctgagcttcggatggaagagacatggcagtcgattaaa

SEQ ID NO: 3157 - DNA, 310 bp, Homo sapiens
  CDS 39..308
  misc_feature 26: s=g or c
  misc_feature 30: s=g or c
  misc_feature 92: k=g or t
  misc_feature 173: n=a, g, c or t
  misc_feature 174: s=g or c
  misc_feature 257: s=g or c
  misc_feature 269: r=a or g
  misc_feature 271: s=g or c
  misc_feature 284: s=g or c
  UNSURE 18: Xaa=Asp or Glu
  UNSURE 46: Xaa=Leu or Val
  UNSURE 78: Xaa=Ala or Gly
acacacccggaagcaggggcccgagsggascggccgcgatgagcggggagccggggcagacgtccgtagcgccccctcccgaggaggtcgakccgggcagtggggtccgcatcgtggtggagtactgtgaaccctgcggcttcgaggcgacctacctggagctggccagtgcnstgaaggagcagtatccgggcatcgagatcgagtcgcgcctcgggggcacaggtgcctttgagatagagataaatggacagctsggtgttctccargstggagaatggggstttccctatgagaaagatgtgagtct

SEQ ID NO: 3158 - DNA, 256 bp, Homo sapiens
  CDS 96..254
  misc_feature 128: k=g or t
  misc_feature 132: w=a or t
  UNSURE 11: Xaa=Phe or Leu
  UNSURE 13: Xaa= *  or Lys
tctgaatggctttctagctatctctgcaccatttaatgagtaaccatttcttctccctaatttgaaatggtatctttattatataccatatacctatgtgtattctatttctgaactctttattcttktttwaattattctatcccttctcctataacagacttctaatgaatatagcttcaaatataagtttctatatctgtcaagagtggtttcgtgggaggattctttgtctttttttaatgatagggtctac

SEQ ID NO: 3159 - DNA, 269 bp, Homo sapiens
  CDS 93..269
  misc_feature 5: w=a or t
  misc_feature 13: y=c or t
  misc_feature 75: m=a or c
  misc_feature 105: y=c or t
  misc_feature 123: s=g or c
  misc_feature 140: m=a or c
  misc_feature 148: r=a or g
  misc_feature 200: s=g or c
  misc_feature 212: s=g or c
  UNSURE 11: Xaa=Ala or Pro
  UNSURE 19: Xaa=Lys or Arg
  UNSURE 36: Xaa=Asp or Glu
  UNSURE 40: Xaa=Asp or Glu
gctcwgcagaacycccaggccacggagctgatttcactaactgcagccgtccccctggggcgccccgtctgaccmtacttgccatcacccagatgcgcaggatcytgtggcagaaagcaggascctggatgggaagaggmgcagccargccgaggtgggcgccgctccccctccccggccctgcccaggtcctcagagasctgggacctgasatcattagtgcctgcataatggatgcctccttctctcttcttggaaatccccagtcc

SEQ ID NO: 3160 - DNA, 342 bp, Homo sapiens
  CDS 46..342
  misc_feature 124: r=a or g
  misc_feature 239: m=a or c
  UNSURE 27: Xaa=Glu or Lys
  UNSURE 65: Xaa=Lys or Thr
cagacttgtctgcattaaggaggaaacagcaaccagggctacaccatgcaccaagaccaagagggtgacacggacgctggcctgaaagctgaagaagcaggcattggagacacccccagcctgraagacgaagctgctggtcacgtgacccaagctcgcatggtcagtaaaagcaaagacgggactggaagcgatgacaaaaaagccaagggggctgatggtaaaacgaagatcgccamaccgcggggagcagcccctccaggccagaagggccaggccaacgccaccaggattccagcaaaaaccccgcccgctccaaagacaccacccagctctggtgaa

SEQ ID NO: 3161 - DNA, 369 bp, Homo sapiens
  CDS 83..367
atctaggatgaatgaccagagagaaatgtgttactattgactgacaacactaaaggctctcttgaggtctcaaaaaataaagatggaaaagaacaaagtgaaactgtatcactgtctgaaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtga

SEQ ID NO: 3162 - DNA, 386 bp, Homo sapiens
  CDS 139..384
aaagctccgcgagagcagagatgccttcagattttattcgcgaaggcaccccacgctcctagaaaagagcacgacgcacccgatgctcggattggatgaagtggcaaagctttaatcccctgggaaagtccacgaacaatgaatccatttcatgcatcttgttggaacacctctgccgaacttttaaacaaatcctggaataaagagtttgcttatcaaactgccagtgtggtagatacagtcatcctcccttccatgattgggattatctgttcaacagggctggttggcaacatcctcattgtattcactataataagatccaggaaaaaaacagtccctgacatctatatctgcaacctggctgtggctgatttggtccacat

SEQ ID NO: 3163 - DNA, 186 bp, Homo sapiens
  CDS 18..185
aagattacaatggtgacatggacttcaaaatagctggcactaataaaggaataactgcattacaggctgatattaaattacctggaataccaataaaaattgtgatggaggctattcaaacaagcttcagtggcaaaaaaggagatattacagatcatgaacaaaactatttcaaaacctcgagca

SEQ ID NO: 3164 - DNA, 428 bp, Homo sapiens
  CDS 1..426
  misc_feature 16: k=g or t
  misc_feature 17: r=a or g
  misc_feature 126: y=c or t
  UNSURE 6: Xaa= *  or Glu or Gly
atgccgggcggcagckraggcaggaagatggctgcaggagacatcggcgagctgctagtgccccacatgcccacgatccgcgtgcccaggtccggcgacagggtctacaagaatgagtgcgccttytcctacgactctcccaaggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggcta

SEQ ID NO: 3165 - DNA, 209 bp, Homo sapiens
  CDS 20..208
  misc_feature 12: s=g or c
  misc_feature 55: s=g or c
  misc_feature 117: m=a or c
  misc_feature 120: m=a or c
  misc_feature 125: d=a or g or t
  misc_feature 126: w=a or t
  misc_feature 131: s=g or c
  misc_feature 136: v=a or c or g
  misc_feature 137: m=a or c
  misc_feature 140: m=a or c
  misc_feature 148: v=a or c or g
  misc_feature 150: m=a or c
  misc_feature 152: r=a or g
  misc_feature 158: w=a or t
  misc_feature 159: w=a or t
  misc_feature 160: w=a or t
  misc_feature 174: m=a or c
  misc_feature 198: m=a or c
  UNSURE 12: Xaa= *  or Tyr
  UNSURE 33: Xaa=Ala or Asp
  UNSURE 34: Xaa=Ala or Asp
  UNSURE 36: Xaa=Asp or Phe or Ile or Asn or Val or Tyr
  UNSURE 38: Xaa=Leu or Val
  UNSURE 39: Xaa=His or Gln
  UNSURE 40: Xaa=His or Asn
  UNSURE 41: Xaa=His or Asn
  UNSURE 43: Xaa=Ile or Met
  UNSURE 44: Xaa=His or Pro
  UNSURE 45: Xaa=Ala or Thr
  UNSURE 47: Xaa= *  or Phe or Ile or Lys or Leu or Asn or Tyr
  UNSURE 52: Xaa=Ala or Asp
  UNSURE 60: Xaa=Ala or Glu
aggcgcggcacscccgcgcatgcctggtgcacagagtctgcaggtcgggcggtasgacaggtcagagctgcggcctgagcagccagcgtccggcatgaaggtctggggtctggctgmtgmctgcdwcttgstccavmacmatggaatvcmtrcgcagwwwaccctgcctcctgmcccgcgcgatgagacttccccggmggacgctgtgt

SEQ ID NO: 3166 - DNA, 449 bp, Homo sapiens
  CDS 124..447
  misc_feature 110: d=a or g or t
  misc_feature 223: b=c or g or t
  misc_feature 269: r=a or g
  misc_feature 278: k=g or t
  misc_feature 280: d=a or g or t
  misc_feature 281: d=a or g or t
  misc_feature 370: m=a or c
  misc_feature 383: m=a or c
  misc_feature 384: v=a or c or g
  misc_feature 385: d=a or g or t
  misc_feature 420: r=a or g
  UNSURE 34: Xaa= *  or Glu or Gln
  UNSURE 49: Xaa=Lys or Arg
  UNSURE 52: Xaa=Ile or Ser
  UNSURE 53: Xaa=Cys or Asp or Phe or Gly or Ile or Asn or Ser or Val or Tyr
  UNSURE 83: Xaa=Arg or Ser
  UNSURE 87: Xaa=Ala or Asp or Glu
  UNSURE 88: Xaa=Asp or Asn or Tyr
agcggcgcccagtgtaagggagtgggagctggtccgtgccgcggcggccgcgcagggagctctcgaggcaacgccggggcgcccgaggtctggaaggcgcagaaatggadcaagagccacaaaatggagaacctgctgaaaattaagatcatcagagaagcatataagaaggcctttttatttgttaacaaaggtctgaatacagatgaattaggtcagaagbaagaagcaaagaactactataagcaaggaataggacacctgctcaragggatcakcddttcatcaaaagagtctgaacacacaggtcctgggtgggaatctgctagacagatgcaacagaaaatgaaagaaactctacagaatgtamgcaccaggctggmvdattctagagaagggtcttgccacttctctagcagratgatcttcaggaggtgcccaagttatat

SEQ ID NO: 3167 - DNA, 206 bp, Homo sapiens
  CDS 54..206
  misc_feature 49: w=a or t
  misc_feature 50: w=a or t
  misc_feature 111: k=g or t
  misc_feature 128: w=a or t
  misc_feature 131: w=a or t
  misc_feature 135: n=a, g, c or t
  misc_feature 136: r=a or g
  misc_feature 138: m=a or c
  misc_feature 141: b=c or g or t
  misc_feature 149: w=a or t
  misc_feature 152: r=a or g
  UNSURE 20: Xaa=Cys or Gly
  UNSURE 25: Xaa=Lys or Asn
  UNSURE 28: Xaa= *  or Glu or Gly or Lys or Gln or Arg or Trp
  UNSURE 29: Xaa=His or Asn
  UNSURE 30: Xaa=Ala or Pro or Ser
gttggggaagcaggcaatgttatcctctgaaataccattacttgagaawwacaatgatagctaatgtgtttttgagcatttatacactaggccctggtaagcactttatckgcattatctcatttaawtcwccanrgmatbcctctggwgarattatttgtattatccttgttttacagttgagaaaactgaggcttagagggggt

SEQ ID NO: 3168 - DNA, 361 bp, Homo sapiens
  CDS 190..360
ctactaaatgcaaggaattgtgcttggtgtgtcatgtggattctctcttgcatcttcatgataaatgttattgtcgctgttttaccgatgagggttggattagaggggttaaacaacttgtcttaggctccacagctgggaacaagtggggctgggaagctgacttcgtgctcttcaccaccacaaaggatgtgtgtgcatcctggggcatgcctgcctcatgtgggggtgtcctgggctgaatttcctgggcacttctcagtggaactctctagcctcctggttcggaatgtcaactatgagatcccctcactgaagaagcagattgccaagtgccagcagctgcagcaagaatacagcc

SEQ ID NO: 3169 - DNA, 266 bp, Homo sapiens
  CDS 87..266
tcaccatctttacttctctttttgttttatggcagtatgccataggcagtggcttccagggttgggacaagggtaagtcaagcgagatgcctaggatgcaaaatttaagaaggcactcactcttaggttcctgcaagagccaatcctgcatgtcttcttcaattttgaaccctaggcacctcgcttgtgttatcattttcccaggcctggtggttctatttatactgtctttagtgtttcattcaacagcaataccaccccacacc

SEQ ID NO: 3170 - DNA, 209 bp, Homo sapiens
  CDS 35..208
  misc_feature 2: m=a or c
  misc_feature 9: m=a or c
  misc_feature 47: s=g or c
  misc_feature 55: s=g or c
  misc_feature 56: s=g or c
  UNSURE 5: Xaa=Glu or Gln
  UNSURE 7: Xaa=Cys or Trp
  UNSURE 8: Xaa=Gly or Arg
tmaaaccamatttagcataggaaaaagttgtttaatgctcagggcasaaatttgssggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctc

SEQ ID NO: 3171 - DNA, 277 bp, Homo sapiens
  CDS 118..276
taagtaagtgaaaatatgatcaatatcactagtcattagcaaaatgcaaaacaaaaccacaatgagataatacttcacactcattaggatggcaactgtaaaaacaatacataacaaatgaacacaatccagaaaataacaagtgtatgtaaggatgcagagatactgaaagcagtggtacagccactgtggaaagttgtatcgtcatatttcaaacaattaaacataacattaccatatgatccagcaattacatgtcagtgcatgcaccccccga

SEQ ID NO: 3172 - DNA, 341 bp, Homo sapiens
  CDS 107..340
  misc_feature 276: v=a or c or g
  misc_feature 277: n=a, g, c or t
  UNSURE 57: Xaa=Ala or Asp or Glu or Gly
ccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgvnctgcacagctcaccttgttccctcctgccccggttcgagagccgagtctgtgggcactctctgc

SEQ ID NO: 3173 - DNA, 258 bp, Homo sapiens
  CDS 43..258
tctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagcca

SEQ ID NO: 3174 - DNA, 385 bp, Homo sapiens
  CDS 150..383
  misc_feature 7: s=g or c
  misc_feature 122: m=a or c
  misc_feature 166: r=a or g
  misc_feature 169: r=a or g
  misc_feature 216: w=a or t
  misc_feature 320: r=a or g
  misc_feature 327: r=a or g
  UNSURE 6: Xaa=Lys or Arg
  UNSURE 7: Xaa=His or Arg
  UNSURE 23: Xaa=Cys or Ser
  UNSURE 60: Xaa=Ala or Thr
tcgattsataaagtcacatatcaagaccagccatcctgaggtctccatgagcaccatttctgaggttctcgggaggagggttcagctgaaagggctaattggaaagagagccatgaaatgcmcatattgtgacttttatttcatgaagaatggctcagaccttcargcrtcatatttgggctcatgaaggtgtgaagcccttcaagtgttctttgwgtgagtatgcaactcgtagcaagagtaacctcaaggctcatatgaatcgtcacagcactgagaaaacccacctatgtgacatgtgtggcaagaaattcaaatcraaagggrcactgaaaagtcacaaactccttcacactgcagatgggaagcagtttaagtgcacggt

SEQ ID NO: 3175 - DNA, 273 bp, Homo sapiens
  CDS 120..272
  misc_feature 162: k=g or t
  misc_feature 163: r=a or g
  UNSURE 15: Xaa= *  or Glu or Gly or Trp
acatccccgttcccgattcctgtagtagcggctgtattgcagccgcctgccgaactgacccgggtctggggactggcccctctggcgccgttcggtttctcttattgccttcactgaggatgagtccctttgtggctctatgtggaccctgcggaatccackrgcgcagttcatctagcgactggtcacccttgcaattatggatatttaaaagggtcagacagtgtggagggggagttcccctcctcactcccccttggtgcttgacccact

SEQ ID NO: 3176 - DNA, 366 bp, Homo sapiens
  CDS 35..364
ttggaatgtgctgccagcctctttctcttaaaaaatgggatacttcgtaagaacaagctatgatactgtgataagtattggcttccatgctgtattttctacatatgtatgcatgtatgtcaaagtgtttgaaagagcctggaacaatttatcactctctctcattgaaatagagggactgggctgggtgcagtggctcacgcctgtaatcccagtgctttgggaggccgaggcgggcggatcacaaggtcaggagattgagaccatcctggctaacatgatgaaaagcccatctctactaaaaatacaaaaaattagctgggcgtggtggcgggcgcctgtaagtcccagctactcgggacgcgg

SEQ ID NO: 3177 - DNA, 246 bp, Homo sapiens
  CDS 22..246
  misc_feature 185: y=c or t
  UNSURE 55: Xaa=Ala or Val
gaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgaatacgygctttatagtgaaatgttaatgggtgttatgaaaagaagagaccaaatacaagcagaacgt

SEQ ID NO: 3178 - DNA, 305 bp, Homo sapiens
  CDS 73..303
tttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccaagcacc

SEQ ID NO: 3179 - DNA, 299 bp, Homo sapiens
  CDS 134..298
  misc_feature 289: k=g or t
  UNSURE 52: Xaa=Ile or Met
tctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatktcccccacac

SEQ ID NO: 3180 - DNA, 198 bp, Homo sapiens
  CDS 34..198
atccagcgaaagaagtgggtggacttggcctggatgattaccttctacgtccgcttcttcctcacttatgtgccactattggggctgaaagccttcctgggccttttcttcatagtcaggttcctggaaagcaactggtttgtgtgggtgacacagatgaaccatattcccatgcacattgatcatgaccggaacaaa

SEQ ID NO: 3181 - DNA, 177 bp, Homo sapiens
  CDS 13..177
  misc_feature 146: r=a or g
  misc_feature 170: m=a or c
  UNSURE 45: Xaa=Asp or Gly
  UNSURE 53: Xaa= *  or Ser
gtttttgtatccatgtggaaaacacaggaagctaatagtactgtttttctctggagtgggtgtaagggtagagacttaactctttacatccttatggcagccttcgaataccttttaactcccagttcccttaactgggggtgtgrtatcctagaatcctcgacccattmgaaagta

SEQ ID NO: 3182 - DNA, 255 bp, Homo sapiens
  CDS 77..253
acatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagagattcttcttaatatccttaccctatttgagaatataaatgacaacataaaaaatgaagggctcgcatc

SEQ ID NO: 3183 - DNA, 305 bp, Homo sapiens
  CDS 24..305
  misc_feature 15: w=a or t
  misc_feature 116: r=a or g
  misc_feature 124: k=g or t
  misc_feature 130: s=g or c
  misc_feature 138: h=a or c or t
  misc_feature 144: w=a or t
  misc_feature 180: r=a or g
  misc_feature 285: r=a or g
  misc_feature 286: n=a, g, c or t
  misc_feature 287: b=c or g or t
  UNSURE 34: Xaa=Leu or Trp
  UNSURE 36: Xaa=Ala or Gly
  UNSURE 39: Xaa=Cys or Arg or Ser
  UNSURE 41: Xaa=Leu or Met
  UNSURE 53: Xaa=Ile or Val
  UNSURE 88: Xaa=Ala or Asp or Glu or Gly or Ile or Lys or Met or Asn or Arg or Ser or Thr or Val
aatatttaaaagagwtagcagtgatgaacaaacccggcgcgttcactgcggaattttcgagacaaccctccggtactagaatgcgacagccgctgcggatattttttggcacaaaraacaaatkggtggsagtgcaahgccccwtggctaaaactactcaaaagaggcataagggtagcrttaatcgctcaagtcttttactgcatggagtactgttgtccatatttttaaaactaaaagtacccgttagtaacatttgttgtatgcccataaagatggggttgrnbcggggggcgggggaagaa

SEQ ID NO: 3184 - DNA, 255 bp, Homo sapiens
  CDS 103..255
agtaacagatgagctgcttttggggagagcttgagtactcagtcggtcagtagtacagtagcaggctcacatgtacggattgttcttgtgaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcaac

SEQ ID NO: 3185 - DNA, 243 bp, Homo sapiens
  CDS 42..242
  misc_feature 16: w=a or t
  misc_feature 17: w=a or t
cacgatacctaaaagwwtaccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagcctta

SEQ ID NO: 3186 - DNA, 367 bp, Homo sapiens
  CDS 61..366
  misc_feature 15: s=g or c
  misc_feature 16: s=g or c
  misc_feature 29: r=a or g
  misc_feature 30: s=g or c
  misc_feature 81: m=a or c
  misc_feature 114: m=a or c
  misc_feature 140: m=a or c
  misc_feature 144: y=c or t
  misc_feature 154: m=a or c
  misc_feature 155: r=a or g
  misc_feature 166: r=a or g
  misc_feature 182: r=a or g
  misc_feature 228: d=a or g or t
  misc_feature 296: m=a or c
  misc_feature 308: r=a or g
  misc_feature 312: y=c or t
  misc_feature 326: m=a or c
  misc_feature 333: r=a or g
  UNSURE 27: Xaa=Ala or Asp
  UNSURE 32: Xaa=His or Asn or Arg or Ser
  UNSURE 36: Xaa=Asp or Asn
  UNSURE 41: Xaa=Asp or Gly
  UNSURE 79: Xaa=Lys or Thr
  UNSURE 83: Xaa=Lys or Arg
  UNSURE 89: Xaa=Ser or Tyr
aactccctcgcccgsscggcgctcgcagrscgacaccaggggggctctcgatgtagcaccatgacaggcatcgccgccgcmtccttcttctccaatacctgccgattcgggggmtgcggactccacttccccaccctggmcgayctcatcgagmrcatcgaggacraccacatcgatacagrtccacgggttttagaaaaacaagaattacagcagccaacctatgtdgccctgagttacataaatagattcatgacagatgctgcccgccgagagcaggagtccctaaagaagamgattcagccgargctytcgctgactctgtmcagctcragtgtctcgagggaatgtgtccactcccccacgc

SEQ ID NO: 3187 - DNA, 357 bp, Homo sapiens
  CDS 105..356
  misc_feature 150: s=g or c
  UNSURE 16: Xaa=Gly or Arg
attctgaacgctgccatggctcagaccgtgcagaatgttacattgtcgctcactctgcccatcacgtgccacatttgcttggggaaggtacgtcagcctgtcatatgcatcaacaaccatgtattttgttcgattttgttattgatttgsggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagccac

SEQ ID NO: 3188 - DNA, 319 bp, Homo sapiens
  CDS 146..319
  misc_feature 87: r=a or g
  misc_feature 92: r=a or g
  misc_feature 103: m=a or c
  misc_feature 104: s=g or c
  misc_feature 130: y=c or t
  misc_feature 154: m=a or c
  misc_feature 155: m=a or c
  misc_feature 205: w=a or t
  misc_feature 206: r=a or g
  misc_feature 225: r=a or g
  misc_feature 257: s=g or c
  misc_feature 258: s=g or c
  misc_feature 269: m=a or c
  misc_feature 287: r=a or g
  misc_feature 297: m=a or c
  UNSURE 3: Xaa=Lys or Asn
  UNSURE 4: Xaa=Pro or Thr
  UNSURE 20: Xaa=Asp or Glu
  UNSURE 21: Xaa=Gly or Arg
  UNSURE 27: Xaa=Asp or Gly
  UNSURE 38: Xaa=Ala or Gly or Pro or Arg
  UNSURE 42: Xaa=His or Asn
  UNSURE 48: Xaa=Ile or Val
  UNSURE 51: Xaa=Lys or Thr
ttactagggataaaaggagaaaatggattattgttcacggttctgcacattcatttctaagaagcaataactgtcatgtggggagargttaragctattgagmsgatagcaggcaaactacaaagatctycatggaaaattagccatgtggaammcatcagaggcctctaaaaatcacccattaattcaggaaggccaaggagawrggccttatagagacgttgrtatgttggatgtgcctaggctttcagagccassctttccacaamacccctccctgcaaagtrtttatttcamatctgcactgtctggcacagat

SEQ ID NO: 3189 - DNA, 304 bp, Homo sapiens
  CDS 17..304
  misc_feature 37: n=a, g, c or t
  misc_feature 50: w=a or t
  misc_feature 63: d=a or g or t
  misc_feature 64: w=a or t
  misc_feature 133: w=a or t
  misc_feature 151: m=a or c
  misc_feature 230: w=a or t
  misc_feature 253: w=a or t
  misc_feature 254: w=a or t
  UNSURE 12: Xaa=Cys or Ser
  UNSURE 16: Xaa=Ile or Lys or Asn or Arg or Ser
  UNSURE 39: Xaa= *  or Tyr
  UNSURE 45: Xaa=His or Gln
  UNSURE 72: Xaa=Ser or Thr
  UNSURE 79: Xaa=Arg or Ser
  UNSURE 80: Xaa= *  or Arg
cttaacaatgtaaagaatgtgcaaatgtcctcagacnagatgcacacctwgctcattagtgadwtcatttcaggcagccagctcttcctcacccactacatcaccaagtcctgtggatatatctgctaaatawttttggaattttatccamttcttttggttccccagtccaaaacacagtcatttcacctggactatttcaatcattacacaggtgtccaaccttttgwcttccctgggccacattggaagwwgaaaaattgtcttgtgccacacatacaatacactaacattaacaatagct

SEQ ID NO: 3190 - DNA, 245 bp, Homo sapiens
  CDS 53..244
  misc_feature 144: d=a or g or t
  UNSURE 31: Xaa=Cys or Phe or Tyr
agctgaaccttatgctgcagatgaaggttctggggaaggacataaatggttgatggtgcatgttgataaaagaattactctggcagctttcaaacaacatttagagccctttgttggagttttgtcctctcacttcaaggtctdtcgagtgtatgccagcaatcaagagtttgagagcgtccggctgaatgagacactttcatcattttctgatgacaataagattacaattagaccggggaggt

SEQ ID NO: 3191 - DNA, 404 bp, Homo sapiens
  CDS 158..403
  misc_feature 386: w=a or t
  UNSURE 77: Xaa=Phe or Ile
aaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtawttgagggttttctgagca

SEQ ID NO: 3192 - DNA, 250 bp, Homo sapiens
  CDS 82..249
  misc_feature 27: r=a or g
  misc_feature 28: s=g or c
  misc_feature 29: r=a or g
  misc_feature 54: w=a or t
  misc_feature 95: r=a or g
  misc_feature 102: w=a or t
  misc_feature 108: w=a or t
  misc_feature 112: b=c or g or t
  misc_feature 114: d=a or g or t
  misc_feature 118: w=a or t
  misc_feature 126: v=a or c or g
  misc_feature 129: d=a or g or t
  misc_feature 175: w=a or t
  misc_feature 219: h=a or c or t
  UNSURE 5: Xaa=His or Arg
  UNSURE 7: Xaa=His or Gln
  UNSURE 9: Xaa=His or Gln
  UNSURE 11: Xaa= *  or Asp or Glu or His or Gln or Tyr
  UNSURE 13: Xaa=Cys or Ser
  UNSURE 16: Xaa=Lys or Asn
  UNSURE 32: Xaa= *  or Lys
  UNSURE 46: Xaa= *  or Cys
tttacactatagtaatttgcattcccrsrtaagtttgagtgttacgaaaacatwcctttaaagggatctgtgctacacaatatgccaggacctcrcagacawagccawtgcbadaaawgtcattcvaadgaatcagatctggaaacaggctgccataaccacttttccttcttgwagactcagctcacctgtatatttaaactgttcttggcatcttghaacacctatttctactcaggtactcaattgt

SEQ ID NO: 3193 - DNA, 191 bp, Homo sapiens
  CDS 37..189
attgtggattgagctcgcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggccgc

SEQ ID NO: 3194 - DNA, 287 bp, Homo sapiens
  CDS 72..287
  misc_feature 108: m=a or c
  misc_feature 133: r=a or g
  misc_feature 165: m=a or c
  UNSURE 13: Xaa=Pro or Thr
  UNSURE 21: Xaa=Lys or Arg
  UNSURE 32: Xaa=Leu or Met
aacatttcttttttatgtgaggcttcccaagcattgctgaacactgagcgtccctagcttctgactactaaatgccactagcatcttccagtcttgttacaaacacamcaacattcccacaccacatttgcaratattcctcctgtggctggcaattctgcccamtgaaggaaagcatgagtgtagtatttggtaaaggacacatttctaaaaattccaaagtgagggccagacccataactttagaaatattagtacatgaaggactgttctattccccaactgcc

SEQ ID NO: 3195 - DNA, 399 bp, Homo sapiens
  CDS 94..399
  misc_feature 118: m=a or c
  misc_feature 275: h=a or c or t
  misc_feature 277: n=a, g, c or t
  misc_feature 294: v=a or c or g
  misc_feature 307: m=a or c
  UNSURE 9: Xaa=Pro or Thr
  UNSURE 61: Xaa=Ala or Glu or Val
  UNSURE 62: Xaa=Phe or Ile or Leu or Val
  UNSURE 67: Xaa=His or Gln
  UNSURE 72: Xaa=Lys or Gln
ttgttttattctagaaaacagctccttgaacacagtgagctggcttttcacacattgcagttgttagtgtttactgcccttgccattttaattatgaggctaaagatgtttttgacamcgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggaghanttaataatttgcctcavgaagaacttttamagtggatcaaatacagtaccacatcagatgctgtctttgcaggtgccatgcctacaatggcaagcatcaagctgtctacacttcatcccatt

SEQ ID NO: 3196 - DNA, 179 bp, Homo sapiens
  CDS 5..178
cgggatgccggagccctcgggccttggagatgaaggcaggcccctgctcctgccaggagggagggaggcagtgggctcatgggtcggtgcctttgcagccgacagcacgccttgcggccctggggatctttctgtgccccggcgagaccctttcggcctcactgcattggaaccccatt

SEQ ID NO: 3197 - DNA, 223 bp, Homo sapiens
  CDS 12..221
ctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccgct

SEQ ID NO: 3198 - DNA, 198 bp, Homo sapiens
  CDS 46..198
aatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcga

SEQ ID NO: 3199 - DNA, 294 bp, Homo sapiens
  CDS 77..292
  misc_feature 261: k=g or t
  misc_feature 270: k=g or t
  misc_feature 274: k=g or t
  UNSURE 62: Xaa=Cys or Phe
  UNSURE 65: Xaa=Cys or Phe
agttttggttttttaaatctttggaattgaacagagtctagatatttctatatatgatgactttcactcattttgcatggatcacagaactttaaatctgcaaattcaagtcttccctctacctaccagaagcggttttttaaaaatcatgtcttggattattgcttccatttcaaattttctggtgtcaggatcatccatgattctcacactagacctctgtatctcttatgtttgtcatgttttaaaaataattttttkctcttcttkttcktctcatttatctccaacaca

SEQ ID NO: 3200 - DNA, 213 bp, Homo sapiens
  CDS 7..213
  misc_feature 35: r=a or g
  misc_feature 36: s=g or c
  UNSURE 10: Xaa=Asp or Glu or Gly
tttttcatgagatgcagagcctggagaggagcggrscggcaggagcagcatgttgcagccgctattctaggggcgctgggtgaagtgggctgccctctgccaccctctcccaggtgccaggaggaggtggctgactctatcactcagggcctcaccgaaccatgcccagctggggcccgcaccagccacaccttcccagctgcgctgcccccc

SEQ ID NO: 3201 - DNA, 369 bp, Homo sapiens
  CDS 43..369
  misc_feature 11: s=g or c
  misc_feature 243: r=a or g
ctataagcagsgggatggagttgaaatgcctgctcatcttttatgtgtttctctttaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtratgagtcagagaggcacagcttctgggggagaacatgaaggaagcctgcggatgaagacagagttactggtgcagatggatgggctggcacgctcagaagatctcgtatttgtcttagcagcttct

SEQ ID NO: 3202 - DNA, 341 bp, Homo sapiens
  CDS 26..340
cattagcagtgccacagtagctcgtatgaatagtcaagattcaaatacttccgtacttgaagtagtttctgagaagccattatcagaaagactaaaggtggttcctggagaaacaatagatcccattccccaccagctattgagaaagtacattggctatgctcggcagtatgtgtacccaaggctatccacagaagctgctcgagttcttcaagatttttaccttgagctccggaaacagagccagaggttaaatagctcaccaatcactaccaggcagctggaatctttgattcgtctgacagaggcacgagcaaggttggaattgagagaggaagcaa

SEQ ID NO: 3203 - DNA, 297 bp, Homo sapiens
  CDS 49..297
cctctacacacaggtcccaaacaggaaacggttaacgacttctggagaatggtctgggagcaaaagtctgcgaccatcgtcatgttaacaaacttgaaagaaaggaaagaggtgagttccagcatctggccccggtatcacttcctttcagctgctgctgccgggctggggatgttcttaccacttccttttcctacttccctcccttcctcccactatcactgcagaaaaaaacccaaacacatgcagtggcttacagcattttcttcacgaaacaaatcccctgtgtcccctcgc

SEQ ID NO: 3204 - DNA, 360 bp, Homo sapiens
  CDS 20..358
  misc_feature 115: r=a or g
attatagcaaaggcatttgatgcagctggtttataaaaaccctaaagaatgttttttgatacaaccaaaggaaagaaaagagaataccaccaagaccaggaaaagaagaaagaarattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgct

SEQ ID NO: 3205 - DNA, 368 bp, Homo sapiens
  CDS 154..366
  misc_feature 2: w=a or t
  misc_feature 16: k=g or t
  misc_feature 45: k=g or t
  misc_feature 103: r=a or g
  misc_feature 111: k=g or t
  misc_feature 129: y=c or t
  misc_feature 296: w=a or t
  UNSURE 48: Xaa=Asp or Val
awaaaaggcaaaagakttgtgttttttatacaccatatgcagtakttcctgcccttttcatcaaggctacctgaacgtgtctggtgaaccagggctggaaggraccgctgktgccgcctgaagtgcaayactctgtatttccacaaggatcacatggacctgcgaacccatgtgaacgccatcgccctgcaaggctgtgaggtggccccgggctttgggccccgacacccatttgccttcaggatcctgcgcaaccggcaggaggtggccatcttggaggcaagctgttcagaggwcatgggtcgctggctcgggctgctgctggtggagatgggctccagagtcactccggaggcgctgcactatga

SEQ ID NO: 3206 - DNA, 385 bp, Homo sapiens
  CDS 189..383
  misc_feature 194: d=a or g or t
  misc_feature 310: r=a or g
  misc_feature 324: k=g or t
  UNSURE 41: Xaa=Lys or Arg
  UNSURE 46: Xaa=Cys or Gly
aggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaagtaggaccagatcaagaaggtggacaggttcctgtatcacatgcgdctctccgatgacacccttttggacatcatgaggcggttccgggctgagatggagaagggcctggcaaaggacaccaaccccacggctgcagtgaagatgttgcccaccttcgtcarggccattcccgatkgttccgaaaatggggagttcctttccctggatctcggagggtccaagttccgagtgctgaa

SEQ ID NO: 3207 - DNA, 331 bp, Homo sapiens
  CDS 19..330
caaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcgtgggtaggaagaatcaatatcgtgaaaatggccatactgcccaaggtaatttacagattcaatgccatccccatcaagctaccaatgactttcttcacagaattggaaaaaaactactttaaagttcatatggaatcaaaaaagagcccacatcgcc

SEQ ID NO: 3208 - DNA, 213 bp, Homo sapiens
  CDS 2..211
catgtgccctagtctggaagaggctcccagtgtcaaggggactctgccctgctcaggacaacagcagcctttcccgtttggagcctcaaacatcccactactcctgggcaggagcagaaaggtggctcgaggtgcaccggtcctgtggccatttctcacttggataaaccctgcactgtccatctgtgaccccttaggatcctgcggatggca

SEQ ID NO: 3209 - DNA, 301 bp, Homo sapiens
  CDS 144..299
cttttcatttagtagatattcataagtcacatgtcagaattgaaattatagtatattttaccttgtagagttctttttaacagaatcctaaaaataagaattatttagtatgtcaagagttaaaaaaaatcactactcatttaatgtctaatctaaaatacaacaggctaacatctagctcagggatcagcaaaccttttttgtggctttgtgggccacgtacagtctctgtctcattcttttgtttttgcatgtgtatttatgtttataaactctttaaaaatgtaagaaacagccagat

SEQ ID NO: 3210 - DNA, 345 bp, Homo sapiens
  CDS 168..344
  misc_feature 327: r=a or g
  UNSURE 54: Xaa=Ala or Thr
caacaacaaaaaaaactggtaccgctccacaaccccttctgaatatcggcaggcaagtatttatcctacaactgcattgggttggagcagtggagagtgggctggagaagctgacccagagctcctaattcaagagacttcatgtggcagaggtttgggtatagcggatgctgaaaacaaggagaataactgaaagtctagaacatttcctgtatccagatgagccaagtacaagccatctggcatccacttcccatccaggtgatcagaggatacgtctctgcagaaaccaccaaggtctcagaaaaaaaagcctgcacaatctgrcatttaggagtccccagc

SEQ ID NO: 3211 - DNA, 198 bp, Homo sapiens
  CDS 38..196
  misc_feature 102: r=a or g
  UNSURE 22: Xaa=Gln or Arg
aagtaatttaacaacagatttgctaattaaaaaaaaaatgaaaaaaaaaatcttaccagcagtttgtaaaggtctggaatcacagttggcatcctttattcrggtctcttctctccaacgtacacttaaaattggtgccgagcagggatataacctgcagttaagtgaaaagaaaatccagcctccccctccaaaaaa

SEQ ID NO: 3212 - DNA, 405 bp, Homo sapiens
  CDS 199..405
  misc_feature 58: y=c or t
  misc_feature 373: k=g or t
  UNSURE 59: Xaa=Ala or Ser
tgtttgctaaatgaatgaatgaatgacaaacaaataagtaaacatctttttaaaaaayagaattaaaaggaagtcaaataatttccaacgagatagatgcttagaaattaaagtattttacattgatatatgtcctgctttttgaactaattgttaaggggcctttgtgtatttcagcagggagttcaataccttgaaatgtatcttgaccatggataccttgatttgagaaagtcctctagtttgagtggaagtgattattgccattatagtttatcacacctagatttcaaagtaggtcaggtgaaaagatgtaagggcagtgtgactgtaactgggagagcagagtctaaaatctcaccttttactttckccttaatgcagtgtctcagaaatgaacacttt

SEQ ID NO: 3213 - DNA, 385 bp, Homo sapiens
  CDS 88..384
  misc_feature 79: s=g or c
  misc_feature 92: r=a or g
  UNSURE 2: Xaa=Asp or Gly
tcaaagcaatttcttaatcagtttctggagcaggaaactcatctcttcagcgccattaacagccatttgctgactgcgsaaccttggatggrcgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcatt

SEQ ID NO: 3214 - DNA, 410 bp, Homo sapiens
  CDS 64..408
gaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattga

SEQ ID NO: 3215 - DNA, 268 bp, Homo sapiens
  CDS 66..266
catgaccaaaaacgttacataaggtacctgtctgaccttcatgcgtctggtgaccctgcttggcaatgcattggagcccaacacaagtggatcttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacag

SEQ ID NO: 3216 - DNA, 202 bp, Homo sapiens
  CDS 41..202
aatagttctttgtaacctgtttcataaaatatgcaaatgcatgagacattctatatgttgctctgactatatatttttaccgtttatagatttcatgatcctttggctgcatggagaaaatgggacagggcctgctaagttcaacatacctcacagtgttacacttgattcagctggtcgggtgtgggttgctgaccgagat

SEQ ID NO: 3217 - DNA, 255 bp, Homo sapiens
  CDS 7..255
agcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctct

SEQ ID NO: 3218 - DNA, 422 bp, Homo sapiens
  CDS 258..422
  misc_feature 35: w=a or t
  misc_feature 348: m=a or c
  misc_feature 349: h=a or c or t
  misc_feature 352: k=g or t
  misc_feature 405: y=c or t
  UNSURE 31: Xaa=Lys or Leu or Met or Pro or Gln or Thr
  UNSURE 32: Xaa=Leu or Trp
  UNSURE 50: Xaa=Pro or Ser
ttttcttgtaggcaaaaaatcagtgagtcttgcawttttacccattgagccaccccatgtcttttgattagagagtttagtccatttacattcagtgttattattgataaataagcacttactccttccactttgttatttattttctggttgttttgtggtcttcttttccttctttctttccttcctgtcttcttttttttgtaaaggtgcttttctctgatgatatagtttcttgtggccaggtgtggtggctcatggccataatcccagcattttgggaggccgaggcaggcggatcacctgaggtcaggagttcgggactggcctggccaacatggagaaacmhgtkgtctctgctggaaatgcaaaaattggctggacgtggtggtgggcacctgtggyccagctacttgggaggc

SEQ ID NO: 3219 - DNA, 365 bp, Homo sapiens
  CDS 137..364
  misc_feature 92: m=a or c
  misc_feature 325: m=a or c
  misc_feature 326: b=c or g or t
  UNSURE 63: Xaa=Arg or Ser
  UNSURE 64: Xaa=Phe or Leu or Val
tacagtaaaaagtgttttgttatttgctgttgatgggttcaatacagcctgctttctgaagtgtaatttaatttttcttttatccgcccctmctgccatctgcttttatcctcatacctcacccagagtttgttccatgggcacaggtttctttgagacggaccgtgttaaagcctgtatccagtcaggatgtgtggcagttcagatgggtattttccattcacccgcccctgccgccagccctcaccctgagctcagcccctcctgcccactgctcagacagcttccttcaccacacccagggccctggggcacggagcagagmbtcacaactgactcacttgctgccttctcaccaaacgcac

SEQ ID NO: 3220 - DNA, 369 bp, Homo sapiens
  CDS 36..368
  misc_feature 322: k=g or t
  misc_feature 331: r=a or g
  misc_feature 333: m=a or c
  UNSURE 96: Xaa=Cys or Phe
  UNSURE 99: Xaa=Lys or Arg
  UNSURE 100: Xaa=His or Asn
ataccggaagtagagtcacggagaggtattaagaaatggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttctkctttgagaramacctgaaagatgtctcattcagacttggttccttca

SEQ ID NO: 3221 - DNA, 281 bp, Homo sapiens
  CDS 24..281
gtttagcccgaggctggtcttagatgcagcgactgtttcagagtgactcagaagaaaaagaagctgaggaagctgttggggggctgaggatgggattctcgcttcttcatttcaggttactcgttcctcagcaagttggcaaaacagatatcatgctggcaattgaaaagctgcaggccggtgctcttgcaactgacgcagtcactgcagcactggtggaacttgaggtgtacacacacagttatgcttcatggagttgcatccaaccaagtatccatgtt

SEQ ID NO: 3222 - DNA, 370 bp, Homo sapiens
  CDS 81..368
acgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagccacagac

SEQ ID NO: 3223 - DNA, 346 bp, Homo sapiens
  CDS 45..344
ttgtttgtttgtttgtttaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttggtaagtcatgctcagacatggatctcacgttattgttcatatatct

SEQ ID NO: 3224 - DNA, 255 bp, Homo sapiens
  CDS 59..253
  misc_feature 176: k=g or t
  misc_feature 178: w=a or t
  misc_feature 179: m=a or c
  misc_feature 184: y=c or t
  UNSURE 40: Xaa= *  or Asp or Glu or Tyr
  UNSURE 41: Xaa=Pro or Thr
cccagcgggcgatgatgagatctcatttgaccctgatgacatcatcaccaacatcgagatgattgacgacggctggtggcgcggggtgttgcaagggccggtacgggctcttcccagccaactatgtggagctgcggcagtagggcccccagcccccccccggagctgcgccctgkawmctcayactacagatcaggccttctttggttcttgggtggttttgggttttttctgttttttttttttttttttttt

SEQ ID NO: 3225 - DNA, 322 bp, Homo sapiens
  CDS 75..320
  misc_feature 86: r=a or g
  UNSURE 4: Xaa= *  or Trp
tatggatgcagaatatgccaactactatactagagaagtgatgttaatccttattcgagaattccagtctcctgatgaggaaatgraaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagcccaaca

SEQ ID NO: 3226 - DNA, 386 bp, Homo sapiens
  CDS 51..386
  misc_feature 84: r=a or g
  misc_feature 90: r=a or g
  misc_feature 336: r=a or g
  UNSURE 12: Xaa=Asp or Asn
  UNSURE 14: Xaa=Ala or Thr
  UNSURE 96: Xaa=Ala or Thr
caaattctcagaataaaataagtaatccctcacagcagacagctttgtcgatggtaatgcacaattatgagtcttcaggtataratatarcaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactarctcagaaggaaaagcagaatgagtcaactaatggtaattcagaagtcaca

SEQ ID NO: 3227 - DNA, 402 bp, Homo sapiens
  CDS 106..402
gttgagggaagggaagcccgcccggtggcggctggggtcggctgctgggaggaggtggtgggctggttcggacgtgggtcgacgctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggattt

SEQ ID NO: 3228 - DNA, 264 bp, Homo sapiens
  CDS 65..262
  misc_feature 143: w=a or t
  misc_feature 144: w=a or t
  UNSURE 27: Xaa= *  or Ile or Lys or Leu
cccattactgggtatatacccaaagaattataaatcatgctactataaagacacatgcacacgtatgtttattgcggcagtattcacaatagcaaagacttggaaccaacccaaatgcccatcgatgatagactggataaagwwaatgtggcatatatataccatggaatactctgcagccataaaaaaggatgagttcatgtccttggcagggacatggatgaagctggaaaccgtcattctcagcaaactaacacaggacca

SEQ ID NO: 3229 - DNA, 283 bp, Homo sapiens
  CDS 12..281
aagtgtcagttatgggtggtgacaatcctgaagtgggcaagaaagctagaaactcaagcaaatttgagctgaggaaaagcccagttttcagtgatgaggattctgaccttgactttgatatcagcaaattggaacagcagagcaagtcaggtaaaagttccagaaatgtgaacaacaaagatttttttgatccagttgaaagtgatgaagacatagcaagtgatcatgatgatgagctgggttcaaacaagatgatgaaattgctgaagaagaagcagagaga

SEQ ID NO: 3230 - DNA, 300 bp, Homo sapiens
  CDS 33..299
aaaactatattattacattagggagactcgtcatgttttattttatttccagaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagaggag

SEQ ID NO: 3231 - DNA, 409 bp, Homo sapiens
  CDS 124..408
agttctgcagccactcggtacggcgctaacgccgcgaggtagctcggtgcgtctcgcagtaccagtgcgaacctttgggctctccaggtccgagatcctagtctcctgtcggctctgaggaggatggatccttctgcggatacatgggacctctcctcacctttaatatcattatggataaacaggttttacatttatctgggctttgctgttagcattagcctttggatttgtgtccagattgtcatcgagatgcagggatttgcaacagttcttgctgaagcagttacgtccctggatctgcctgtggccattattaatctaaaagaatatgatccagatgatcatctgatagaagaggtgactagtaaaaatgtctgtgtcttcctggttgcgacatacactggac

SEQ ID NO: 3232 - DNA, 318 bp, Homo sapiens
  CDS 110..316
  misc_feature 55: h=a or c or t
  misc_feature 56: y=c or t
  misc_feature 203: k=g or t
  misc_feature 205: d=a or g or t
  misc_feature 206: n=a, g, c or t
  misc_feature 246: w=a or t
  misc_feature 247: k=g or t
  UNSURE 32: Xaa= *  or Asp or Glu or Tyr
  UNSURE 33: Xaa=Leu or Met or Val
  UNSURE 46: Xaa=Asp or Glu or Val
ccttcgctttcgctcttttccgtcgaggccgacccctgagttgtgagtctgggghytggttggtgaaaaagagcccttgaaaggctggaagacgggagaggacaaaagcatgtcttcccttcctgggtgcattggtttggatgcagcaacagctacagtggagtctgaagagattgcagagctgcaacaggcagtggttgagkadntgggtatctctatggaggaacttcggcatttcatcgatgwkgaactggagaagatggattgtgtacagcaacgcaagaagcagctagcagagttagagacatgggtaataca

SEQ ID NO: 3233 - DNA, 295 bp, Homo sapiens
  CDS 54..293
agacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcca

SEQ ID NO: 3234 - DNA, 215 bp, Homo sapiens
  CDS 13..213
  misc_feature 109: d=a or g or t
  misc_feature 135: k=g or t
  UNSURE 33: Xaa= *  or Gly or Arg
  UNSURE 41: Xaa=Cys or Trp
ggcctcttcaatatggcggggcctttgtctcctagcttccgggcagctctgtgccgcaacctcgagtctccctcctccagattgtgtgggggtgttgggagtgtcatadgacgggaattctcatttagggtctgkagttcctccgtggaagaagcagtgggccgtggggtccctagtccctcctttctccttttaaaaataaaatcatggccacc

SEQ ID NO: 3235 - DNA, 292 bp, Homo sapiens
  CDS 54..290
aacacaatgaggaacttcttaaaaggtgccaactacattataaagaactaaagatgaaaataagaaaaaatatttctgaaattcgggaacttgagaacatagaagaacaccagtctgtagatattgcaactttggaagatgaagctcaggaaaataaaagcaaaatgaaaatggttgaggaacatatggagcaacaaaaagaaaatatggagcatcttaaaagtctgaaaatagaagcagaaaataagtatgatgcaattaaattcaaaattaatcaactatcggagccagc

SEQ ID NO: 3236 - DNA, 308 bp, Homo sapiens
  CDS 28..306
  misc_feature 163: w=a or t
  misc_feature 168: k=g or t
  misc_feature 169: m=a or c
  UNSURE 46: Xaa= *  or Arg
  UNSURE 47: Xaa=His or Gln
  UNSURE 48: Xaa=His or Asn
gaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccawgacakmataaatccaagtccgaaattactgacatggttcgctcctccactatcacagtgtcggacaaggctcatattttatccatgcagaagtttggactgcgagatacaattgtgaaatcacatctactacagaaagaagagga

SEQ ID NO: 3237 - DNA, 340 bp, Homo sapiens
  CDS 153..338
  misc_feature 201: w=a or t
  misc_feature 212: m=a or c
  UNSURE 17: Xaa=Cys or Ser
tgttaaatatagatagagaagtaaacagagatgtacatgtatgtcgtatgtatatatgtttatgtgtgtcctggctttgtttgctgagaaggtgtaagagcatcaacagcccagctgttgaaagtatcactatctactaaaaggaaccagggatgcttggagaaatggtggactccagggatggggcagtgaaaccacacwgtaagcctggmccatctgattgcactgaagtgaagaagtgcttgaagaatgatgacaacatgtcacaaggacacataagtgagcttgaagatgttcccactggccaaacctgggacaactggagtatcaaagtcaatat

SEQ ID NO: 3238 - DNA, 366 bp, Homo sapiens
  CDS 73..366
  misc_feature 309: m=a or c
  UNSURE 79: Xaa=His or Gln
agtttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccamcccgacactggggagaagatgaatgtcatcgggcgcatgtctttccagcttcctggc

SEQ ID NO: 3239 - DNA, 271 bp, Homo sapiens
  CDS 18..269
agggcacaccccagtacatggagaacatggagcaggtgtttgagcagtgccagcagttcgaggagaaacgccttcgcttcttccgggaggttctgctggaggttcagaagcacctagacctgtccaatgtggctggctacaaagccatttaccatgacctggagcagagcatcagagcagctgatgcagtggaggacctgaggtggttccgagccaatcacgggccgggcatggccatgaactggccgcagtttgaggtaagaggagggga

SEQ ID NO: 3240 - DNA, 301 bp, Homo sapiens
  CDS 15..299
  misc_feature 45: s=g or c
  UNSURE 11: Xaa=Ala or Pro
caaatgttggtgagatgaagcattacttgtgtggctgctgtgcascttcaacaatgtcgcaatcacatttcccattcagaaggtccctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagc

SEQ ID NO: 3241 - DNA, 404 bp, Homo sapiens
  CDS 143..403
  misc_feature 363: r=a or g
  UNSURE 74: Xaa=Asn or Ser
cagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcarcagggcagcgtggagcagggccagccctctggcacttgtgt

SEQ ID NO: 3242 - DNA, 439 bp, Homo sapiens
  CDS 278..439
  misc_feature 272: b=c or g or t
ctagttgttgtgaaatgtgctatatgcactcactgcctcaaatgaggaaaatggagaaataaggaaataagaacaattccccaacaatgttttaaagtcttcattttctattatctttgttttatgtaaactttactcatttcgtataaatttcattcatttttgaggtcctgctttctgtcaggttttgtgttgggcactagagtaagacttgggcatcttgtcaggaagctgctctgtgattaaagagatagatgtatgaacaagcaatbataatatggttagtaagtcctacagtaaaggtactctctacagtagagggcctgggaaactgcctttttttttctttgagacagggtctccatcacccagacctcatgggctcaagcgatcctcccacctcagcctcctgagtagcttggactacaggcatgcacca

SEQ ID NO: 3243 - DNA, 297 bp, Homo sapiens
  CDS 141..296
gttttccccaatgttaatatcttgcctaactagaggacaatataaaaaccaagaaattggcattagtacaatgcatatccatagagctaatttagattgaccagttatgcaggtactcatttgtgtgtgtatatgtgtgcatgtgtagctctacgcaattttatcataagtgtagcttcatgaaaccacaaccactatcaagatacttcactgtcccatcatcagagactccctcatgctacccctgtagagtcaacacctattccctaccccattctgaacaactagccaccacta

SEQ ID NO: 3244 - DNA, 311 bp, Homo sapiens
  CDS 23..310
  misc_feature 8: y=c or t
  misc_feature 81: s=g or c
  misc_feature 243: n=a, g, c or t
  misc_feature 244: y=c or t
  misc_feature 311: s=g or c
  UNSURE 20: Xaa=Arg or Thr
  UNSURE 74: Xaa=Ala or Asp or Gly or Val
tatatgtyttgaattaggttatatgttctgcatttacaagcacatacaggattcttacttccagcaacttggcagtaaaasaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggnycaagtgaccctcccacctcagcctcccaagttgctgggacttaggcacccgccaccacgccccgtas

SEQ ID NO: 3245 - DNA, 279 bp, Homo sapiens
  CDS 36..278
tgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagt

SEQ ID NO: 3246 - DNA, 390 bp, Homo sapiens
  CDS 95..388
  misc_feature 180: w=a or t
  UNSURE 29: Xaa=Asp or Val
cagatacttctttcttgcacagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgwccctgcagacatcatccatgacttccagcggggtctgactgcgtaccatgatatctccctggacaagtgctatgtcatcgaactcaacaccaccattgtgcccccctcgcaacttctgggagctcctcatgaacgtgaagagggggactacctgccgcagacgtacatcatccaggaggagatggtggtcacggagcatgtcagtgacaa

SEQ ID NO: 3247 - DNA, 302 bp, Homo sapiens
  CDS 100..300
catttccttaccaattgcctttttttgttttgttttgtttttgagacagggttttgctctttcacccaggctgtagtgcagtggtgcaatctgctccctatggcctcaacctccctggcccatgctatcctcttaggcgggtgccaccatggctggctagattttactttttattttgtagagacagggtatccctgtgttgcccaggctggtctcaaactcctgtcctcaagtgatcctcctgccttggccacccatagtgctgggattacaggtgtgggccacctcactcagtgccaccc

SEQ ID NO: 3248 - DNA, 308 bp, Homo sapiens
  CDS 42..308
ctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagct

SEQ ID NO: 3249 - DNA, 318 bp, Homo sapiens
  CDS 29..316
  misc_feature 133: k=g or t
  misc_feature 134: w=a or t
  UNSURE 35: Xaa=His or Gln
  UNSURE 36: Xaa=Asn or Tyr
agaacttaatttcgagaaaggagatgtaatggatgttattgaaaaacctgaaaatgacccagagtggtggaaatgcaggaagatcaatggtatggttggtctagtaccaaaaaactatgttaccgttatgcakwataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttc

SEQ ID NO: 3250 - DNA, 394 bp, Homo sapiens
  CDS 178..393
aacataggaacagtttgctatctttgtgacaaataatgaagacctatctagaataccaacttattggtactaaagaaatcagtcaatatttacatgtatgcatagtatattaattcagattgtaatatatgtgtagcctgctagtagcttttcaatggaaaaagtgaaaagagcttcatgttaacttttttaattttaataggttgcttcttcaagtggaagaagtatttgactgggggtcagaagacctgggttggaatcctagttccatctttctgtaataatgtaggtctgctctgcccatcctctgccctcctccctcagaaaaatctctgcaaacccatgatgtccaacagacatagctcatattggtcacagctaacggagttaacta

SEQ ID NO: 3251 - DNA, 393 bp, Homo sapiens
  CDS 32..391
agatggaactggtagtcagctggagagcagcatggaggcgtcctgggggagcttcaacgctgagcggggctggtatgtctctgtgcagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggact

SEQ ID NO: 3252 - DNA, 250 bp, Homo sapiens
  CDS 85..249
  misc_feature 6: r=a or g
  misc_feature 220: d=a or g or t
  UNSURE 46: Xaa=Ala or Ser or Thr
gtgtarcggctatgggcgctgtcttacaacaaagccaaggaatctcgctgctgagggcagttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagatdcagttgaattaccagaatcagttcttcact

SEQ ID NO: 3253 - DNA, 400 bp, Homo sapiens
  CDS 181..399
  misc_feature 34: s=g or c
  misc_feature 313: n=a, g, c or t
  misc_feature 314: b=c or g or t
  UNSURE 45: Xaa= *  or Ala or Gly or Ile or Leu or Pro or Arg or Ser or Thr or Val
gaaaaagcggcgcggctcgttcaagatggcggastcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgatttttttctgatgaagatgataggcaaataaatacaaggtcacctaaaagaaaccagagggttgcaatggttccacagaaatttacagcaacaatgtcaacanbagataagaaagcttcacagaagattggttttcgattacgtaatctgctcaagcttcctaaagcacataaatggtgtatatacgagt

SEQ ID NO: 3254 - DNA, 398 bp, Homo sapiens
  CDS 25..396
agtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctct

SEQ ID NO: 3255 - DNA, 386 bp, Homo sapiens
  CDS 92..385
  misc_feature 81: k=g or t
  misc_feature 83: k=g or t
ttacatcgaaaccaagcttaacagagacttaaaagatgaccttataaagctgtttacggaacatgttgcagaaaagcacaktkacagcctaatgcctttacttttagaagcccagtcaacaccatttcaggtcacaccttcaactatggcaaatattgtgaaaggcctgtataccctcagaccagagtgggttcagatggctccaactctattttctaaatttattccaaacattctccctccggcggtggaatctgaactttctgaatatgctgctcaagatcagaaatttcaaagagacttatacagaatggttttacaaggggtgaccagtcccggaagagagctggggatgagttggcttataatagctcgtcagcatgtgc

SEQ ID NO: 3256 - DNA, 363 bp, Homo sapiens
  CDS 96..362
  misc_feature 18: h=a or c or t
  misc_feature 316: n=a, g, c or t
  UNSURE 74: Xaa=Ile or Asn or Ser or Thr
acatccagcaggctgaghagggcaaggagttggtgcacacctacaagggctgcatcaggtcccaggactgctactccggcgttatatccaccaccatgggccccaaggaccacatggtaaccagctccttctgctgccagagcgacggctgcaacagtgcctttttgtctgttcccttgaccaatcttactgagaatggcctgatgtgccccgcctgcactgcgagcttcagggacaaatgcatggggcccatgacccactgtactggaaaggaaaaccactgcgtctccttatctggacacgtgcaggctggtantttcaaacccagatttgctatgcggggctgtgctacagagagtatgt

SEQ ID NO: 3257 - DNA, 331 bp, Homo sapiens
  CDS 81..329
  misc_feature 91: y=c or t
  misc_feature 97: r=a or g
  misc_feature 130: n=a, g, c or t
  UNSURE 4: Xaa=Phe or Ser
  UNSURE 6: Xaa=Glu or Gly
  UNSURE 17: Xaa=Ile or Lys or Arg or Thr
gaggtccgcggcctatttacccaagttggaggtaggggcctgtggaaacatgaagagggtaaacagctgtgtggagagtgatgagcatgtycctggragagctggaaacagaaggggagaggcagctganaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacaga

SEQ ID NO: 3258 - DNA, 314 bp, Homo sapiens
  CDS 36..314
  misc_feature 77: s=g or c
  misc_feature 133: s=g or c
  misc_feature 145: k=g or t
  misc_feature 148: r=a or g
  misc_feature 153: k=g or t
  misc_feature 154: r=a or g
  misc_feature 157: r=a or g
  misc_feature 164: w=a or t
  misc_feature 165: r=a or g
  misc_feature 166: w=a or t
  misc_feature 219: k=g or t
  misc_feature 224: r=a or g
  misc_feature 234: k=g or t
  UNSURE 14: Xaa=Arg or Ser
  UNSURE 33: Xaa=Ala or Gly
  UNSURE 37: Xaa=Leu or Trp
  UNSURE 38: Xaa=Asp or Gly
  UNSURE 40: Xaa= *  or Glu or Gly or Trp
  UNSURE 41: Xaa=Glu or Gly
  UNSURE 43: Xaa= *  or Tyr
  UNSURE 44: Xaa=Asp or Ile or Asn or Val
  UNSURE 62: Xaa= *  or Glu
  UNSURE 67: Xaa=Leu or Val
ttttttttgcagtacctgctgcggccgctttcggcatggaggaaatttatgcgaagtttgtgtcccagaaaatcagsaaaacccgctggcgaccgctgcctccgggaagtttacagaccgcggagacgttcgstacaggatcttkggrcaatkrggraaattawrwttcactgtggtctattggagattttggaaacttggactctgatggagggtttkaaggrgaccatcagktattgtgtgatatcagacaccatggtgatgtaatggatttacagttttttgaccaggaaagaattgtcgctgcttcatca

SEQ ID NO: 3259 - DNA, 327 bp, Homo sapiens
  CDS 64..327
gcggattgggttacgtcgccggaagtggggcgggactctattgtggcgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagataagaccaac

SEQ ID NO: 3260 - DNA, 236 bp, Homo sapiens
  CDS 65..235
ttcaaaaatctaatcattcttggattataaagaagttgagaactgcctgaatataaaagctaccatgcttatgttattgtgggaaggagttctggaatcagatagacatggacctcaaatgggagagcagctgttaaagtctcaatcagctgacccatttttgaaccttgagatggatgctggcatctccaacatccagcgaagtcagagctggctcagcaacattggccccaccc

SEQ ID NO: 3261 - DNA, 195 bp, Homo sapiens
  CDS 12..194
caaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacaaa

SEQ ID NO: 3262 - DNA, 307 bp, Homo sapiens
  CDS 101..307
  misc_feature 132: n=a, g, c or t
  UNSURE 11: Xaa=Leu or Pro or Gln or Arg
atatgacttttgtgtaattttctctcttgaactctggtgctgtttttttgtttgtttgagacgaagtctcgctctgtcacccagggtggagtgcagtggcatgatctctgctcactacaacctccgcctccngggttccagcgattctcctgcctcagcctcccgagtggctgggactacaggcgtgcgccaccacgcctggctaattttttgtatttttggtagagacggggtttcgccatgttggtcaggctggtctcgaactcctgacctcgtggtctgccctcctcgacctcccaaagtgccg

SEQ ID NO: 3263 - DNA, 365 bp, Homo sapiens
  CDS 181..363
  misc_feature 116: n=a, g, c or t
  misc_feature 318: v=a or c or g
  misc_feature 319: n=a, g, c or t
  UNSURE 46: Xaa=Arg or Ser
  UNSURE 47: Xaa=Phe or Ile or Leu or Val
gaggttggagaagagagtgaaaagactgcttacccgatttaaaattggtgagatgttccttgggctggttggtctgaggacctgaggtcataggtggatctcctcacggagtgagngcaaggacagggggctggtctcccaaaggagtccccctgtcccgggtcttcggcaccaaatgtcatgcacgtccatttgaagagagtccaccaacaggctttgtgtgagcaacaaggctgtttatttcacctgggtgcaggttggctgagtctgaaaaaggagtcagcaaattttggtgggattatcattagttcttatagvnttgggataggtgggccaggggtggatctcacaaagtacattctcaa

SEQ ID NO: 3264 - DNA, 416 bp, Homo sapiens
  CDS 130..414
  misc_feature 152: w=a or t
  misc_feature 153: y=c or t
  UNSURE 8: Xaa=Phe or Tyr
atttcactctactgcctctggaagaagagtgttatctaaagtgcttccatcatgaataatgattgagaaactgcttttactctcccgactactgtactcccaggcagaaacccacggctgaagcccacgatgcccatgtgtaacttggtttwytacacacacgtttggagcccagtgtgcagacccgcagcgcagaggaggcggcggaacaccccgggttggtcgggtttccaagggctgacccgagctccagcactttttccgcgcctgatttttcaggtcattttcgaatgggctatctttgcttacattttgagcttggatcctctccagaaagcattactaccttctaaaaggaaaaacatctcgtatttgcagacagtgctgagggagcaaagttcattttctcggagctc

SEQ ID NO: 3265 - DNA, 364 bp, Homo sapiens
  CDS 73..363
  misc_feature 16: k=g or t
  misc_feature 17: k=g or t
gagggcagcggaggakkcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgt

SEQ ID NO: 3266 - DNA, 276 bp, Homo sapiens
  CDS 93..275
  misc_feature 50: s=g or c
cccttgttactgctacccatcctacctgcaccctgctttttccctcttgscacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcaa

SEQ ID NO: 3267 - DNA, 328 bp, Homo sapiens
  CDS 154..327
  misc_feature 31: m=a or c
  misc_feature 100: r=a or g
tgaaaatgtaaattagtgcagttattatggmagtcagtatggaacttcctcaaaaaactaacaataaaactcccatatgatccagcaatcctaccactgratatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattat

SEQ ID NO: 3268 - DNA, 334 bp, Homo sapiens
  CDS 157..333
  misc_feature 330: m=a or c
  UNSURE 58: Xaa=His or Gln
gagtacgactactacggggcttacgggagccgcgcgcacgaggactacgcctaccgcaggctgctggcagacgagtacaccttcgccttcccgccccaacacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccatgggggcaccgagagtgacctgactgtcagccgcctggcacccagccamcagt

SEQ ID NO: 3269 - DNA, 351 bp, Homo sapiens
  CDS 92..349
  misc_feature 152: k=g or t
  misc_feature 153: s=g or c
  misc_feature 156: s=g or c
  misc_feature 157: r=a or g
  misc_feature 270: r=a or g
  UNSURE 21: Xaa=Ala or Cys or Gly or Ser
  UNSURE 22: Xaa=Pro or Arg
  UNSURE 60: Xaa=Lys or Arg
tactctaccgttgcatgccctgggcagcaggtagaatggttaccctgttctcttctttcttggcagcaagaattcccttctgaaggatgccatggctccaggcaccccaaagtccctcctgttgtctgcttccatcaagagggaaggagagkstcsracggcatcaccccactcatctgccaccgatgacctccaccattcagacagataccagacctttctgcgagtacgagccaaccggcagacccgactgaatgctcggattgggaraatgaaacggaggaagcaagatgaagggcagagggaaggctcctgcatggctgaggatgatgctgtggacatcgagcatga

SEQ ID NO: 3270 - DNA, 168 bp, Homo sapiens
  CDS 8..166
  misc_feature 124: s=g or c
  UNSURE 39: Xaa=Asp or Glu
gggggaaatgcgggagagagggagagagcgaggcaacccggggctcaaaacagtcaaattcaaattaaaaggtcgagacacgaatcagggaatattccgggaaagaaagagggaacctgcggasctcggtcagtttggaggagtcacgtatcacacgggaaaccagca

SEQ ID NO: 3271 - DNA, 360 bp, Homo sapiens
  CDS 26..358
  misc_feature 321: m=a or c
  UNSURE 99: Xaa=Lys or Thr
aaatgaactagaaaatctagaagaaatggataaattcctggacagatacaccctcccaagactaaaccaggaaaaagttgaatccctgaatagaccaataacaggctctgaaattgaggcaataattaatagcctaccaactaaaaaaagcccaggaccagatggattcacagccaaattctaccagaggtacaaagatgggctggtaccattccttctgaaactattccaatcaatagaaaaagagggaatcctccctaactcattttttgaggccagtatcatcctgataccaaagccgggcagagacacaacaaaaamagagaattttagaccaatatccctgatgacatcgatgca

SEQ ID NO: 3272 - DNA, 270 bp, Homo sapiens
  CDS 67..270
aagcacagatggcagtccattcattgaagatggtttttttcaaggtgagtgttggtcttttgcacaatgcttgagatggaaatgacttggctgagactatgtgatgagtgctccagatggggcatggcatcggcatggggtaggggtggaaagcttcttggagctcaagtagcccttcatcctagaaactgcagcaaagctaagatcttcctgttcagtattttattaatgtctttaagaacttttcactgtaattatttcagaggcaat

SEQ ID NO: 3273 - DNA, 285 bp, Homo sapiens
  CDS 40..285
  misc_feature 140: s=g or c
  misc_feature 242: k=g or t
  misc_feature 255: k=g or t
  misc_feature 256: k=g or t
  UNSURE 34: Xaa=Ser or Thr
  UNSURE 68: Xaa=Cys or Phe
  UNSURE 73: Xaa=Leu or Val
acagctgctgagggaccactctgctcccccgcctaagccatgcacctctgtgggggcaatgggctgctgacccagacagaccccaaggagcaacaaaggcagctgaagaagcagaagaaccgggcagccgcccagcgaascggcagaagcacacagacaaggcagacgccctgcaccaggtgtggacaacccctaacccctttccttgtctctggctccacttactggcccagccacctctkctccatcccacckktgagcagacctcccccaaactcctgtaag

SEQ ID NO: 3274 - DNA, 280 bp, Homo sapiens
  CDS 111..278
caattaatttttcataaaccttctacagcttgtcttttaaccctccaaactttggcaagaaatccatattctcatgccttttaccaaaaagtacattctactttttttacatgaatccttttcacgacttacacagaccttctatgacatgcctggactttctgacttgtcctaaacatccctctttaaacaaccattcatttaactttagggcaagaatttaccatacaggatcctgtctcatacaaaattattattgctacatccttccctaccaaga

SEQ ID NO: 3275 - DNA, 231 bp, Homo sapiens
  CDS 72..230
  misc_feature 186: m=a or c
  misc_feature 192: r=a or g
  misc_feature 215: w=a or t
  UNSURE 39: Xaa=Pro or Thr
  UNSURE 41: Xaa=Gly or Ser
aattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggamctgaargctcttggcatgaaatagcagcwacatcaggtgctcatc

SEQ ID NO: 3276 - DNA, 329 bp, Homo sapiens
  CDS 28..327
  misc_feature 245: b=c or g or t
  misc_feature 292: m=a or c
  misc_feature 298: r=a or g
  misc_feature 312: h=a or c or t
  misc_feature 316: r=a or g
  UNSURE 73: Xaa=Ile or Ser or Thr
  UNSURE 89: Xaa=His or Asn
  UNSURE 91: Xaa=Ile or Val
  UNSURE 95: Xaa=Asp or Glu
  UNSURE 97: Xaa=Gly or Arg
catggatacaaagaatcaattattaaaatggctgtactgcccaaaggaatgtacagattcaatgttattcctatcaaactaccaatgagattcttcacagaactggaaaaatttattttacaatttatatggaaccaaaaaagagccctaatagttaaagtaatactaagtgaaaacaacagagctaacaaagctagaggaatcacattacccaacttcaaactatgttacagagctacagtgabcaatatagcatggtactggcataaaaacaggtacatacaccaatggmacagartagagatcccagahatarggcacacatttat

SEQ ID NO: 3277 - DNA, 311 bp, Homo sapiens
  CDS 39..311
  misc_feature 111: k=g or t
  UNSURE 25: Xaa=Cys or Gly
ctttcctattttaagaatcctcttattagtgctgtggcatgaatacttgtccatctgtctatccatctatccccgagcacctgcatccttctcagcaaaagccagaaccckgtcctcacagagctcccaagctgctgtcaaaaggtgaacagaggcttgatgcagccaggaaaacatccatgagtgcatgtcagggaaaggctcagcacagccacctgctccctcatcatggccctccctgctccaggcagggtgttccatccagaagaggagcctgcacgaaggcaagctgttcagggcgaagagcagtc

SEQ ID NO: 3278 - DNA, 271 bp, Homo sapiens
  CDS 27..269
agttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtaaa

SEQ ID NO: 3279 - DNA, 206 bp, Homo sapiens
  CDS 20..205
  misc_feature 57: s=g or c
  misc_feature 88: s=g or c
  misc_feature 100: s=g or c
  UNSURE 13: Xaa=Ser or Thr
atttattctgccccagctgatgtttgagccagcatgtcgcggaggaagcaagcgaasctcaacatttccaatccgaccccgaagtggsctcgctcccccsggcgagatggagacacagaaaagggtcaaccgagtcgccctactaagagcaaggatgcccacgtctgtggccggtgctgtgccgagttctttgaattatcagatct

SEQ ID NO: 3280 - DNA, 345 bp, Homo sapiens
  CDS 35..343
  misc_feature 92: s=g or c
  misc_feature 99: y=c or t
  UNSURE 20: Xaa=Gly or Arg
  UNSURE 22: Xaa=Phe or Ser
agccggaccctacaaagtgggctggccttgctttatggctttctcccagattttgactggaagaagatttatttcaggcaccagccaagtgsgctgttyctgctctggaagctgctattgcccggtaagaaaccagtatctggaaaaggagcagcgtcgtcagtacctcctacgtttgaaaaacagccagctggagaagacctacggggagatggccaagatcgtggatgtccccaccaagcagcttagagctgccaaccccatagactccatgctctgccacttctgccacaatgtcagctttccctgtaccagaaatggctgtgttgacatggagcacttcaa

SEQ ID NO: 3281 - DNA, 453 bp, Homo sapiens
  CDS 7..453
  misc_feature 428: s=g or c
  UNSURE 141: Xaa=Ser or Thr
cggaagatgagcaagtccctggggaatgtgctggacccaagagacatcatcagtggggtggagatgcagttgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagccggctgaggagctgtctccctcctccccgatggatgcctggatcctgagccgccttgccctggctgcccaggagtgtgagcggggcttcctcasccgagagctctcgctcgtcactcat

SEQ ID NO: 3282 - DNA, 262 bp, Homo sapiens
  CDS 69..260
  misc_feature 195: r=a or g
  misc_feature 196: h=a or c or t
  UNSURE 43: Xaa=Ala or Glu or Ile or Lys or Thr or Val
aaccggagggaaactcaatgcacagaccctgatttgcaacttgtaatgtaaatcaactcaactgcatcatgtacttaccagccaccttctcccaactgtggccggggccgagaagcagcatgttctgtccatctgtaaaaggccttctttctctcttaagacgtcacaactggttgttactgagaactttagaarhacgactagatcgtttggctctttctgggccttccacctacactccatgccctctctcctcccaaca

SEQ ID NO: 3283 - DNA, 294 bp, Homo sapiens
  CDS 65..292
  misc_feature 131: w=a or t
  misc_feature 132: k=g or t
  misc_feature 145: s=g or c
  misc_feature 268: m=a or c
  misc_feature 271: d=a or g or t
  misc_feature 272: k=g or t
  UNSURE 23: Xaa=Cys or Phe or Ile or Ser
  UNSURE 27: Xaa=Asp or Glu
  UNSURE 68: Xaa=His or Gln
  UNSURE 70: Xaa=Phe or Val
tatgaggagaagaaaaagaagactacaaccattgcagtggaagtgaagaaatcccaacacaagtatgtcattgggcccaagggcaattcattgcaggagatccttgagagaactggagttttccgttgagwkccaccctcaggasagcatctctgagactgtaatacttcgaggcgaacctgaaaagttaggtcaggcgttgactgaagtctatgccaaggccaatagcttcaccgtctcctctgtcgccgccccttcctggcttcamcgdktcatcattggcaagaaagggca

SEQ ID NO: 3284 - DNA, 350 bp, Homo sapiens
  CDS 115..348
gagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagc

SEQ ID NO: 3285 - DNA, 411 bp, Homo sapiens
  CDS 142..411
ccaggaacatccagctatttatgatagcatttgcttcattatgtcaagttcaacaaatgttgacttgctggtgaaggtgggggaggttgtggacaagctctttgatttggatgagaaactaatgttaagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccagccc

SEQ ID NO: 3286 - DNA, 412 bp, Homo sapiens
  CDS 209..412
  misc_feature 125: w=a or t
  misc_feature 128: m=a or c
  misc_feature 374: s=g or c
  misc_feature 389: r=a or g
  misc_feature 396: r=a or g
  UNSURE 56: Xaa=Ala or Pro
  UNSURE 61: Xaa=Ile or Val
  UNSURE 63: Xaa=Glu or Gly
catcttatatgggtgcaattcatgatatcccaaaacaattacaatagtaatatcaaagattactgaccacagatgaccataatagatataataataatgagaaagtttgaaatattgtggagaawtamccacaatgtgacagagacacaaagtgagcacaggctgttggaaaaatggtgctgatagtcttgcctaatgaaggattgctatgaaccttccattcgtaagcatcacagtatctgcaagatgcaataaggtgatgctcaataaaacatggtatctatatttgcatatggcttaccagttgagcatcactaatctaaaaatccaaaacttgaaatgctcccttgagcatttgagtatcatattgtcasccaaaagttttcagrttttagracattttgcattttca

SEQ ID NO: 3287 - DNA, 340 bp, Homo sapiens
  CDS 183..338
  misc_feature 156: s=g or c
  misc_feature 158: r=a or g
gactctcggagcgcgcacagtcggctcgcagcgcggcactacagcggccccggcgcaggcagttcagattaaagaagctaattgatcaagaaatcaagtctcaggaggagaaggagcaagaaaaggagaaaagggtcaccaccctgaaagaggagstrcccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagaggt

SEQ ID NO: 3288 - DNA, 247 bp, Homo sapiens
  CDS 32..247
ttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcaacat

SEQ ID NO: 3289 - DNA, 384 bp, Homo sapiens
  CDS 116..382
gcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagctggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgagga

SEQ ID NO: 3290 - DNA, 355 bp, Homo sapiens
  CDS 137..355
gtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagc

SEQ ID NO: 3291 - DNA, 205 bp, Homo sapiens
  CDS 48..203
aattcagccctgacgacagcagtggttggagccatcaaggtgagtggatggaaacttggaagggaacaactgagtcaaggaatggaaatccaaatattccatgggaggccgggtttgattttgtttgttggtggtggtgtaagaacgagggctgtgaccttttcagctcggcctgtgtgatcccatcttacttcttttttttttt

SEQ ID NO: 3292 - DNA, 410 bp, Homo sapiens
  CDS 125..409
cttaactgtcactgtggagaggagagagagaggacagagagcaagtcactcccggctgcctttttcacctctgacagagcccagacaccatgaacgcaagtgaattccgaagagagggaaggagatggtggattacgtggccaactacatggaaggcattgagggacgccaggtctaccctgacgtggagcccgggtacctgcggccgctgatccctgccgctgcccctcaggagccagacacgtttgaggacatcatcaacgacgttgagaagataatcatgcctggggtgacgcactggcacagcccctacttcttcgcctacttccccactgccagctcgtacccggccatgcttgcggacatgctgtgcggggccattggctgcatcggcttctcctggggctgct

SEQ ID NO: 3293 - DNA, 478 bp, Homo sapiens
  CDS 257..478
  misc_feature 160: k=g or t
gatggcagtattcctgagaactttgtgtagatgtccaaatgtatgaggaaagactaggaaaatatccagaaaataccacagtgatgaatgtggaataatttttgctcagaactctgtcctaattcagcatcagaaattcacactggtgaggaattcctakgaatgtaacaagtatgggaaagcctttactcaggagtgtaggcttcatgcaaataagataattcacactggagttagatatataaatgagaagaatatgggaaagctttcagtgcaaacactggactcattcatcgttaagagaatccatactggagagagaccctataataaatgtgacaagtgcaacaaagcctttggccagtggtcagtcctcaaccagcaccagaggcttcacaccagggagatatgttactaccagtgtaacaagtgtggtaagttcacagtcagaattcagctttttcatcatatcagaatc

SEQ ID NO: 3294 - DNA, 246 bp, Homo sapiens
  CDS 17..244
  misc_feature 140: s=g or c
  misc_feature 182: k=g or t
  misc_feature 183: k=g or t
  UNSURE 42: Xaa=Leu or Val
  UNSURE 56: Xaa= *  or Gly or Leu or Val
gcccagagccagagggatggtggtagtcacggggcgggagccagacagccgtcgtcaggacggtgccatgtccagctctgacgccgaagacgactttctggagccggccacgccgacggccacgcaggcggggcacgcgstgccccctgctgccacaggaagtttcctgaggttgttcccckkaacatcggaggggctcacttcactacacgcctgtccacactgcggtgctacgaagacaccatt

SEQ ID NO: 3295 - DNA, 363 bp, Homo sapiens
  CDS 160..363
  misc_feature 17: n=a, g, c or t
  misc_feature 18: w=a or t
  misc_feature 25: h=a or c or t
  misc_feature 293: d=a or g or t
  misc_feature 344: m=a or c
  misc_feature 346: v=a or c or g
  UNSURE 45: Xaa=Lys or Met or Arg
  UNSURE 62: Xaa=Ser or Tyr
  UNSURE 63: Xaa=Ala or Pro or Thr
ctcctcggtggctgggnwtacagghgcatgccaccacgcccggctaatttttgtatttttagtggagacagggtttcaccgtcttggccaggctggtgttgaactcctgacctcgtgatccaccggcttcagcctcccaaaagtgctgggattacaggcatgagccaccgtgcccggccacctcaattttttttttctgagtttcatgttacacagaacatacctttttgttttggagctagctacagggaagcacaggcttctctagagtggaatgtacaattcttatcaadgcaaaaagttaaagactacttgctttttaaaattagggagaatgaaaaatmtvcagcacttttccccagc

SEQ ID NO: 3296 - DNA, 324 bp, Homo sapiens
  CDS 128..322
agaaagtcaatattgtgtaaagttgagagaaaagtcttcacagcggaagaagaaatcacttttttgtcccgaatcagtgggtggaggcaaaacccttcagcaagaagagaagcaacttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctgga

SEQ ID NO: 3297 - DNA, 356 bp, Homo sapiens
  CDS 76..354
  misc_feature 178: y=c or t
  misc_feature 179: n=a, g, c or t
  UNSURE 35: Xaa=Cys or Phe or His or Leu or Pro or Arg or Ser or Tyr
gaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaatyntgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggt

SEQ ID NO: 3298 - DNA, 307 bp, Homo sapiens
  CDS 143..307
  misc_feature 123: r=a or g
  misc_feature 131: w=a or t
  misc_feature 134: r=a or g
  misc_feature 135: w=a or t
  misc_feature 138: w=a or t
  misc_feature 141: k=g or t
cactttctaccattgagttccagagagaagccctggagaactcacacaccaacactgaggtgttgaggaacatgggctttgcagcaaaagcgatgaaatctgttcatgaaaacatggatctgracaaaatwagrwtgwttkgatgcaagagatcacagagcaacaggatatcgcccaagaaatctcagaagcattttctcaacgggttggctttggtgatgactttgatgaggatgagttgatggcagaacttgaagaattggaacaggaggaattaaataagaagatgacaaatatccgccttccc

SEQ ID NO: 3299 - DNA, 445 bp, Homo sapiens
  CDS 261..443
  misc_feature 135: k=g or t
  misc_feature 333: r=a or g
  misc_feature 387: r=a or g
  UNSURE 25: Xaa=Ile or Val
  UNSURE 43: Xaa=Asp or Asn
aatcaaagccacaatgacaccagtcagcatgggtgttattaagaagtcagaaaatcacagatgctggcgaggttgtggagaaaaaggaatgcttatacgcagttggtgggagtgtaaattagttcaactgttgtkgaaagactgtgtggaaattcctcaaagatctaaagatagaaataccattcaacccataaatctcattagtgggtatataaccaaaggaatataaatcactctattataaagacacatgcacatgtatgttcattgcagcactcttcacggtagcagagacatggaatcagtctaaatgcctgtcaataatagactggrtaaagaaaatgtggtacatatataccatggaatactatgcagccattaaaaagracaagattatgtcctttgcggggacatggatgaaggtggaagctattatcctcagcaa

SEQ ID NO: 3300 - DNA, 302 bp, Homo sapiens
  CDS 53..301
  misc_feature 124: w=a or t
  UNSURE 24: Xaa=Lys or Asn
gacaactcgcgccagctacggggcctcagagaagccggacttcgcaagcaccatgcagtggataaggggcggatcgggaatgctgatcactggagattccatcgttagtgctgaggcagttaawtgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggagggat

SEQ ID NO: 3301 - DNA, 254 bp, Homo sapiens
  CDS 96..254
  misc_feature 132: m=a or c
  misc_feature 136: m=a or c
  misc_feature 152: k=g or t
  UNSURE 13: Xaa=Ile or Leu
  UNSURE 14: Xaa=Pro or Gln
atgggattgagaaataacaacatgtttttcatctttattttaaagcaacaaggaaaaattcaggatcagacaaccggaaatgatccctcggattaatgctgaactgttgtttcggccaactgctctttcaamttcmaagcttttcttctcckaaggaaagtgttccaagaagacatctttcagaaggaacaaattcttatgcgacaagacttctaaataatcatcaagttccacctcagtctgaacctgtgagc

SEQ ID NO: 3302 - DNA, 177 bp, Homo sapiens
  CDS 19..177
  misc_feature 104: s=g or c
  misc_feature 108: y=c or t
  misc_feature 146: r=a or g
  misc_feature 150: m=a or c
  misc_feature 151: y=c or t
  misc_feature 156: r=a or g
  UNSURE 29: Xaa=Ser or Thr
  UNSURE 43: Xaa=Glu or Gly
  UNSURE 44: Xaa=His or Gln
  UNSURE 45: Xaa=Phe or Leu
tagggatgtagtttcaccatgtcaccgaggctggtctcaaactcctgggcacaagcgatttcgcccacttcagcctcccaaaatattgggattacaggcgttascacyacactcggcccatatttggttttgaggataagttgggracamyttggraatcttttcagcagaggggtg

SEQ ID NO: 3303 - DNA, 350 bp, Homo sapiens
  CDS 13..348
  misc_feature 120: r=a or g
  misc_feature 127: s=g or c
  misc_feature 130: s=g or c
  misc_feature 132: m=a or c
  misc_feature 134: b=c or g or t
  misc_feature 137: w=a or t
  misc_feature 142: v=a or c or g
  misc_feature 146: k=g or t
  misc_feature 150: m=a or c
  UNSURE 39: Xaa=Glu or Gln
  UNSURE 40: Xaa=Asp or Glu or His or Gln
  UNSURE 41: Xaa=Cys or Phe or Ser
  UNSURE 42: Xaa=Glu or Val
  UNSURE 44: Xaa=Asp or His or Asn
  UNSURE 45: Xaa=Leu or Arg
agaagctcccacatggactgctcctgccagccggcgcctgctgtctctcctcccagcctctgtgctgaggcacagagatccacgctcccatcttcctgggtccttgggtgcatccaggarggcttgsagsamtbcgwaaacvatckgccmaaaggaggccgccctgggatgctccagactatagattcccagataggccacagcaagggaagcaggagagaagctcggtttccgacacagtgccttccaggagacccacgggtgagtccagctgtactgttaactcctggaggatgcaaacggtcgctctggggtgggaatgtttacctgagtggacggttgtttgctct

SEQ ID NO: 3304 - DNA, 364 bp, Homo sapiens
  CDS 177..362
  misc_feature 267: r=a or g
  UNSURE 31: Xaa=Glu or Lys
ttttatcatcttatatatttaaggggtaggactacaggtttcttacgtgcatatattgggtagtggtgaagtctgagcttttagagtacccattacccaaataatgagcattgtacccaataggtaatttttcaacccttatcctccttttatcctcccacctttggtactctccaatgtctattagtcaaaaaagtggatttttaaatggctgctttgctcaagggctcatgcagactaacaaaatgagcaatttacatttaagaraaatctacaacacaaacatacttagtttctatttgtatacaagagaacgaatgcatgaactcatttactcatttaacaaacgtttgttgacccccta

SEQ ID NO: 3305 - DNA, 374 bp, Homo sapiens
  CDS 156..374
  misc_feature 132: s=g or c
  misc_feature 272: n=a, g, c or t
  UNSURE 39: Xaa=His or Gln
gaggagcttgagtccagccactgtctgggtactgccagccatcgggcccaggtctctggggttgtcttaccgcagtgagtaccacgcggtactacagagaccggctgcccgtgtgcccggcaggtgggagcsgcccgcatcagcggcctcggggaatggaagcggagaacgcgggcagctattcccttcagcaagctcaagctttttatacgtttccatttcaacaactgatggctgaagctcctaatatggcagttgtgaatgaacagcanatgccagaagaagttccagccccagctcctgctcaggaaccagtgcaagaggctccaaaaggaagaaaaagaaaacccagaacaacagaaccaaaacaaccc

SEQ ID NO: 3306 - DNA, 237 bp, Homo sapiens
  CDS 48..236
  misc_feature 132: r=a or g
  misc_feature 164: k=g or t
  misc_feature 165: r=a or g
  misc_feature 207: s=g or c
  misc_feature 214: r=a or g
  UNSURE 29: Xaa=Gly or Ser
  UNSURE 39: Xaa=His or Gln
  UNSURE 40: Xaa=Ala or Thr
  UNSURE 54: Xaa=Ala or Pro
  UNSURE 56: Xaa=Lys or Arg
aaagagatgcacaggacaagaaacaggaccttgccctgtcactcaggatggagttcagtggtcctatcatggttcattatagcctcaaactcccaggctcaagcaatcctactatgtcagcctttcccagtrgctgggactacaggtctcacactgtcacccakrctggagtacagtggcacaacctctgctcactgcagcctccasctgccargctcaagcaattctcctgcctca

SEQ ID NO: 3307 - DNA, 182 bp, Homo sapiens
  CDS 2..181
  misc_feature 139: k=g or t
  misc_feature 148: y=c or t
  misc_feature 153: y=c or t
  UNSURE 51: Xaa=Phe or Ser
catgtttagcgcttccttcaggagctcttttagggcaggcctggtggtgacaaaatctctcagcatttgcttgtctgtaaagtattttatttctccttcacctatgaagcttagtttggctggatatgaaattctgggkttgaaaatyctttyctttaagaatattgaatattggccccaac

SEQ ID NO: 3308 - DNA, 248 bp, Homo sapiens
  CDS 36..248
  misc_feature 56: k=g or t
  misc_feature 136: k=g or t
  UNSURE 34: Xaa=Leu or Trp
gtgcggtcccgagggccctccgtgccgccggcgccatgggcaattgccacacggtkgggcccaacgaggcgctggtggtttcagggggctgttgtggttccgactataaacagtacgtgtttggcggctgggcctkgggcttggtggtgtatctccgacactcagaggatttccctagagattatgacgttgcagccccgctgcgaggacgtagagacggccgagggggtagctttaactgcgacggt

SEQ ID NO: 3309 - DNA, 335 bp, Homo sapiens
  CDS 25..333
  misc_feature 71: w=a or t
  misc_feature 278: m=a or c
  misc_feature 305: v=a or c or g
  misc_feature 306: r=a or g
  misc_feature 333: s=g or c
  misc_feature 334: m=a or c
  UNSURE 16: Xaa=Asp or Val
  UNSURE 85: Xaa=Asn or Thr
  UNSURE 94: Xaa=Pro or Gln or Arg
  UNSURE 103: Xaa=Asp or Glu
ggcggcgcccgctggcgctcaagcatggcggcggcggcattgggcagctcctcaggctcggcgtccccggwcgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaamcatctcatctttcctaaaaaagcttcvrtggagcagctgcaaaaaaattcgtgasmt

SEQ ID NO: 3310 - DNA, 406 bp, Homo sapiens
  CDS 254..406
  misc_feature 158: y=c or t
  misc_feature 339: m=a or c
  UNSURE 29: Xaa=Ala or Glu
actagtttttagaaataattttttatgattaaaaactgattctagatatttgacaggtttgtacgtgtgtctgctgttagaatataaaactagactctaagcgtgctcattttatttttccattgcctttgatatcatatgaatttagttatacagayggagcatccgaaatgcttgggatcagtaatgtttcagattttgggtttttttggattttggaatatttgcatatatacaatgagatatcttggggatgagaccgaatactaaacacgaaattgattcatgtgcacatagcctgaaggtagtttcatacagtattttaaattttgtgcacgmacaaagtttgtgtatattgactatcaaagggcaagggtgtcgacacaggtatgcagttttacactgc

SEQ ID NO: 3311 - DNA, 357 bp, Homo sapiens
  CDS 34..357
  misc_feature 127: v=a or c or g
  misc_feature 128: n=a, g, c or t
  UNSURE 32: Xaa=Ala or Glu or Gly or Ile or Lys or Leu or Pro or Gln or Arg or Thr or Val
gattatagcgctgtgcttttcccgtgctaggcaatggatcacttggagtcctttattgctgaatgtgatcggagaactgagctcgccaagaagcggctggcagaaacacaggaggaaatcagtgcgvnagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttca

SEQ ID NO: 3312 - DNA, 486 bp, Homo sapiens
  CDS 311..484
  misc_feature 429: h=a or c or t
  misc_feature 430: b=c or g or t
  UNSURE 40: Xaa=His or Leu or Pro or Gln
ccaccatcagaattgcagaaaggaggagcttttcagggtataggtaagaactgacccttaaaactcgcctttgctgaagagacaggcatttgtgggagctgtgttgttttgttgttgttgttgttgttgttgttgttgttttttcatgtgctggaaatatggcttgtaatgttctaatatttttctaatttagtctttttgctttagactcatttagacttccggtgactatcgcagagggtacaactttatggatctaaattatcaggagaatataaaagattagaaaaaaactttagtttttcaagttatggagtatcattcaagtctggttttgattaaggctaccagttttctaggaattgtggtttctgtcaaatgcatgcggaaggcactgattggggttctggttggagttctggtttccchbcagaaaactgcagaaacactctttgatgttatttgtgcaaatgcattaacatctca

SEQ ID NO: 3313 - DNA, 462 bp, Homo sapiens
  CDS 131..460
  misc_feature 144: n=a, g, c or t
  misc_feature 145: k=g or t
  misc_feature 258: r=a or g
  misc_feature 284: k=g or t
  misc_feature 285: w=a or t
  misc_feature 339: r=a or g
  misc_feature 364: v=a or c or g
  misc_feature 365: b=c or g or t
  misc_feature 372: r=a or g
  misc_feature 414: n=a, g, c or t
  UNSURE 5: Xaa=Ala or Asp or Glu or Gly or Val
  UNSURE 43: Xaa=Asp or Gly
  UNSURE 52: Xaa=Asp or Phe or Val or Tyr
  UNSURE 70: Xaa=Asn or Ser
  UNSURE 78: Xaa= *  or Tyr
  UNSURE 79: Xaa= *  or Glu or Gln
  UNSURE 81: Xaa=Glu or Gly
  UNSURE 95: Xaa=Ile or Asn or Ser or Thr
attttttttcttatgtggtaagaaggctagagaaggtagactagagatggtgtagcagttccatagggctagcaggggtggcagcttcttctttttccccccaaccatcctcaggctgggtttcttcctcatggtctcaaaagnkggttgcttgaccttgggaatgatgcctaccttccaggccagaaacggattggctggcttctcctatctgcttctgcatttggtgtgttttaatacgtatcagatttcctttgrcctcgctgagtacactgcggacgttkwcggagttggcactctacgacttctagatgcagttaagacttgtggccttatcarctctgtgaagttctaccaagcctavbaaagtgractttatgggaaagtgcaggaaataccccagaaggagaccanccctttctatcccggtcacctatggggcagcaaaactctatgcctatt

SEQ ID NO: 3314 - DNA, 366 bp, Homo sapiens
  CDS 212..364
  misc_feature 132: s=g or c
  misc_feature 133: s=g or c
  misc_feature 138: k=g or t
  misc_feature 275: n=a, g, c or t
  misc_feature 276: n=a, g, c or t
  misc_feature 280: w=a or t
  UNSURE 22: Xaa=Ala or Cys or Asp or Phe or Gly or His or Ile or Leu or Asn or Pro or Arg or Ser or Thr or Val or Tyr
ttatgtataatggataagcccaaaattgaaagtcagatctgatttgcttacggccttcaccaaacaatcccagtggctcaatgtctttcgcagatcgcagacctcggccttgcctcctttaagatgtggagssaaackgaataatgaagagcacaatgagctgagggaagtggacggcaccgctaagaagaatggcggcaccctctactacatggcgcccgagcacctgaatgacgtcaacgcaaagcccacagagaagtcggatgtgtacagcnntgcwgtagtactctgggcgatatttgcaaataaggagccatatgaaagtaaggcattacttactttccactgccgtcccctcagcatacc

SEQ ID NO: 3315 - DNA, 414 bp, Homo sapiens
  CDS 172..414
attacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagcttaatgcttttaaaaaagtgatccagtatcaacatgcagaatatgtaactcatacatccttcaatttgtcaccaaggtggacaagaacgttgtcaacaggctatatctgtcttttgttctttata

SEQ ID NO: 3316 - DNA, 211 bp, Homo sapiens
  CDS 21..209
acttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagc

SEQ ID NO: 3317 - DNA, 295 bp, Homo sapiens
  CDS 13..294
gtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggac

SEQ ID NO: 3318 - DNA, 201 bp, Homo sapiens
  CDS 1..201
atgttattcataaggcttaggtttcttttatttatttattttaattttttattttttcattattatactttaagttttagggtacatgtgcacaatgtgcaggttagtgacatatgtatacatgtgacatgctggtgcactgcacccactaactcgtcatctagcattaggtatatctcccaatgctatccctcccccctc

SEQ ID NO: 3319 - DNA, 265 bp, Homo sapiens
  CDS 94..264
caagatgtcaacttatagttcatttatggtctctgctttgtagaacttcaaaatttctctacaatcacagttatatattttttctgggttcatatgttgcttagaacacttccctatacgaaaaacatgaaaattttttttcatattttctttcataagtgtctatttacatataggttatttattactcttgcgttaattttgtggtatagtgacatagaggagtctacctttccccctctaatgaggtattgtcccaacactt

SEQ ID NO: 3320 - DNA, 475 bp, Homo sapiens
  CDS 81..473
  misc_feature 132: k=g or t
  misc_feature 136: w=a or t
  misc_feature 323: w=a or t
  misc_feature 324: w=a or t
  UNSURE 18: Xaa= *  or Gly
  UNSURE 19: Xaa=His or Leu
  UNSURE 81: Xaa=Arg or Ser
  UNSURE 82: Xaa=Phe or Ile
agattgcttcttagcctcagacgcaggacgtccttctcttaaacgcgctgccctgcgtggtgggtgggattggggttctgatgaaggtagctggggcctgccctggccagtgggtcccagctgaggctgctkgacwtactctccgagcctcggcagtattccctagccgagactttttttgtggttgttattctgctgattgtagatatctttgctttgctgacatcctgttttgtttttggtttttacatcccatttgtttctttttatcacagaaacgcttcgttaagggactcaggcagtacgggaagaacttcttcagwwttagaaaggagctgcttcccaataaggaaacaggggagctgatcaccttctattactattggaagaagacccccgaagcagccagctcccgagcccatcgtaggcaccgcagcaggccgtgttcaggaggattaagactcgcaccgcgtcc

SEQ ID NO: 3321 - DNA, 318 bp, Homo sapiens
  CDS 158..316
attatccggggataactacagccaacatgccagggcatctggggcagaatacggaaagcgggagggacaaattgccaatgtttggagtctggtttccaggttgccgtttttgggggctttgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccggcacgg

SEQ ID NO: 3322 - DNA, 182 bp, Homo sapiens
  CDS 24..182
atcatcgtgaggaattggcagcaatgaaacagattctcgttaagatgcatagtaaacattctgagaacagcttacttctcactaaaacagaaccaaaacatgtgacagaaaatcagaaatcaaagactttgaatgtgcctaaagagcatgaagacaatatatttacacctaaaccaacacca

SEQ ID NO: 3323 - DNA, 303 bp, Homo sapiens
  CDS 142..303
  misc_feature 114: r=a or g
  misc_feature 115: m=a or c
  misc_feature 120: m=a or c
  misc_feature 124: y=c or t
  misc_feature 147: n=a, g, c or t
  UNSURE 2: Xaa=Arg or Ser
gtgccgctgcagctgggccaccgcagggctgctccaagtgagaatcgtgagggtggccaagtccagtttggacctctgacccttgggcagcacctcccgacagccggctcgggrmccaamttcytgcgaagccaggtgaaaatgagntcttcagtaagaagaaaaggcaagccaggcaaaggaggtggaaaagggtcttctagaggaggaagaggaggcaggagtcacgccagtaaatctcatgggagtggtggcggtggcggtggtggtggtggtggaggtggcggcaacagaaaggcctct

SEQ ID NO: 3324 - DNA, 287 bp, Homo sapiens
  CDS 63..287
  misc_feature 147: n=a, g, c or t
  misc_feature 167: h=a or c or t
  misc_feature 265: k=g or t
  UNSURE 29: Xaa=Ile or Leu or Val
  UNSURE 35: Xaa=Asp or Glu
  UNSURE 68: Xaa=Met or Arg
ctgggtttttcatcacatggtagacagtgtcatttgttgtgatgttctagttggcacagtgcatgtgggctgctgagcagaaccaagtattgtcattgtggcagttacagtttttatttaacaaacatatagaaaatttaagcagtntacatattaaaccatttgahctcataacatctttatgtgggaggtactgtagtagtcccatctttggccgggcgcagtggctcatgcctgtagtcccagcactttggaaggcagggakggtggatcacttgaggctggga

SEQ ID NO: 3325 - DNA, 485 bp, Homo sapiens
  CDS 41..484
  misc_feature 127: w=a or t
  misc_feature 390: r=a or g
  misc_feature 484: w=a or t
  UNSURE 29: Xaa= *  or Tyr
  UNSURE 117: Xaa=Glu or Gly
aaatattttagctattcaaaacttgaaagagatactcggtatgtatcttcccgatgtagatcagaaagagagcgacggcggagcagatctcactctaggtctgagagaggctctagaactaatttawtcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggraagaagaggcaagtattcttcaaaactagaaagagaatctaaaaggacttcagaaaatgaagcaattaaaagatgttgttctcctcctgggggwc

SEQ ID NO: 3326 - DNA, 239 bp, Homo sapiens
  CDS 20..238
taccaaacagactactgtaatgtccacaagcacattcatctcacccgctcagctgaaagagagctgtaacactgcaacttcaagtgcatggcccatctgctcagtgagaacacgcccaggagcgagagtggggcaggaaagtgaacctgctgtcaactccctacccatccaacgggatcccagtgttcaagggcctgtgttccactcacagcccagccccgaaagctgtgccggccaac

SEQ ID NO: 3327 - DNA, 414 bp, Homo sapiens
  CDS 242..412
  misc_feature 396: s=g or c
  UNSURE 52: Xaa=Ala or Gly
gtttttcgtagagacggggtttcagcatgttggtcaggctggtcttgaactcctgacctcatgatccgcccgccttggcctcccaaagtgctgggattactggcatgagccaccaagcccggccttaaaatagtatttttaataacagaagcattcacagaaactccagttcatttaatttgcttattgttcttccactctggggacagtaaccattgttctctttattttgcacttacacatgagccaacgtacaagatccttatttatggatgcacaccttacgtgtgaaaaacctaccccttgtctccaaatgaaagactgcatctctttcatcctgcttcctactggtgactccctcccacttactcctttcctcttgctgcctgctgtggscttttatttcttctcagt

SEQ ID NO: 3328 - DNA, 354 bp, Homo sapiens
  CDS 72..353
  misc_feature 125: m=a or c
  misc_feature 338: d=a or g or t
  misc_feature 339: d=a or g or t
  UNSURE 89: Xaa=Lys or Asn
  UNSURE 90: Xaa=Ala or Ser or Thr
tgaaattataatagaaattataaaacaacaacaagaacaataaaataaaaacactttacatttgagaaagaatgacaatatcagtaggtaaaaccaacatcaacagttacaagaccatccttccmagcccaagtaaggcagtcaaaagaggtgtagatctggtagcagaaactgggtccataattatcaaagtggaagttcacagagcaattataactgagaagataaaaactcatgtaacttccattcagtactgcaatttaaaaatagatttttttcacaataactatatacagataatatatttaacacataaaacaaaagagaaaaataacaaddctttctcatcacaac

SEQ ID NO: 3329 - DNA, 465 bp, Homo sapiens
  CDS 290..463
  misc_feature 465: r=a or g
gaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtccgcagaacactcctatgccaccttcaccagctgtacaagtgcagggccagcctaacaggtctcar

SEQ ID NO: 3330 - DNA, 370 bp, Homo sapiens
  CDS 24..368
  misc_feature 97: r=a or g
  misc_feature 101: k=g or t
  misc_feature 352: r=a or g
  misc_feature 364: s=g or c
  UNSURE 25: Xaa=Glu or Gly
  UNSURE 26: Xaa=Arg or Ser
  UNSURE 110: Xaa=Glu or Gly
  UNSURE 114: Xaa=Ala or Gly
cgggctgccgtcgcctcgtcgctatggcgcccaccatccagacccaggcccagcgggaggatggccacaggcccaattcccaccggactctgcctgrgagktctggagtggtctgccgagtcaagtactgcaatagcctccctgatatccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagrggagattcaggscccctc

SEQ ID NO: 3331 - DNA, 384 bp, Homo sapiens
  CDS 67..384
  misc_feature 294: n=a, g, c or t
  misc_feature 327: b=c or g or t
  misc_feature 328: w=a or t
  misc_feature 329: k=g or t
  UNSURE 88: Xaa=Cys or Phe or Ile or Ser
catgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgcnccagtcacccatgtgtccgtcacattagatggbwktcctgaagtgatggaaacacagcaggtgcaagaaaaatatgcagactcaccggga

SEQ ID NO: 3332 - DNA, 463 bp, Homo sapiens
  CDS 230..463
  misc_feature 150: b=c or g or t
  misc_feature 450: r=a or g
  UNSURE 74: Xaa=Asp or Gly
agtaacagcctgctgaccatggcacaggcagtctcctgaagtcatgcagctgaaatttggtgcatggttctgttcaggataaagctgccttagagagttcccagagatctcttgggctgggcacaatggctcacagcctgtaatcccagbactttgggaggctgagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggrcaaacttggtgtc

SEQ ID NO: 3333 - DNA, 241 bp, Homo sapiens
  CDS 67..240
  misc_feature 141: r=a or g
gaaaaggaaacgccaagacatagaaaaccacgcttttcccgtaggaagaaccgatgatgagccctgatgaaagaaggaagaagacccgctgtctgcgaaggcctaaaggttagaaatacagcaatttttctcatgccgaargaaaaggcaaaatggtctaagaaactgcaagagtgtgatacaagttttcctcaacagcgagctgggactggcgacaatttcttaactcacagcctccaca

SEQ ID NO: 3334 - DNA, 330 bp, Homo sapiens
  CDS 12..329
  misc_feature 116: s=g or c
  misc_feature 144: n=a, g, c or t
  UNSURE 45: Xaa=Ala or Pro or Ser or Thr
ttgaggggactatgcgtaaaaagctgagtttggatgaggaatcttctctctttaaacaaaaagcccaacagaagcgggtatttgataccgtcaggattgccaatgacacacggggscgctctatctcattcccagctctgttanccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatc

SEQ ID NO: 3335 - DNA, 182 bp, Homo sapiens
  CDS 11..181
  misc_feature 5: s=g or c
  misc_feature 15: y=c or t
  misc_feature 81: r=a or g
  misc_feature 94: r=a or g
  misc_feature 140: s=g or c
  misc_feature 146: k=g or t
  misc_feature 148: m=a or c
  misc_feature 150: s=g or c
  misc_feature 152: w=a or t
  misc_feature 157: s=g or c
  misc_feature 178: s=g or c
  UNSURE 2: Xaa=Phe or Ser
  UNSURE 24: Xaa=Glu or Gly
  UNSURE 44: Xaa=Gly or Arg
  UNSURE 46: Xaa=Ala or Ser
  UNSURE 47: Xaa=Arg or Thr
  UNSURE 48: Xaa=Arg or Trp
  UNSURE 56: Xaa=Lys or Asn
atatsaccctatgtytcctaatgattatgagaaagtagtgaagcgccaaagagaggaacgacagagacagcgggagctggraagacaaaaggaratagaagaaagggaaaaaaggcgtaaagacagacatgaagcaagtsggtttkcmasgwggccsaagatccagattctgatgaasatgc

SEQ ID NO: 3336 - DNA, 408 bp, Homo sapiens
  CDS 12..407
  misc_feature 138: m=a or c
  misc_feature 321: r=a or g
  misc_feature 322: w=a or t
  misc_feature 323: b=c or g or t
  UNSURE 43: Xaa=Pro or Thr
  UNSURE 104: Xaa=Asp or Glu or Ile or Lys or Met or Asn or Val
gcaggtcccagatgtccagttccagatgcctggacccagagtgtgggggaaatatctctggagaagccctcactccaaaggctgtccaggcgcaatgtggtggctgcttctctggggagtcctccaggcttggccaamcccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctrwbacaatctcattcgtcggttcggatccaagccagttctgtggtcagcaaggctcccctctgggcaggccccctggtcagagggagt

SEQ ID NO: 3337 - DNA, 250 bp, Homo sapiens
  CDS 46..249
  misc_feature 2: d=a or g or t
  misc_feature 35: r=a or g
  misc_feature 130: r=a or g
  misc_feature 131: r=a or g
  misc_feature 133: s=g or c
  misc_feature 140: k=g or t
  misc_feature 143: n=a, g, c or t
  misc_feature 145: s=g or c
  misc_feature 156: k=g or t
  misc_feature 186: n=a, g, c or t
  misc_feature 207: r=a or g
  misc_feature 234: s=g or c
  UNSURE 29: Xaa=Asp or Gly or Asn or Ser
  UNSURE 30: Xaa=Asp or His
  UNSURE 32: Xaa=Cys or Phe
  UNSURE 33: Xaa= *  or Leu or Ser or Trp
  UNSURE 34: Xaa=Ala or Pro
  UNSURE 37: Xaa=Arg or Ser
tdccgccctggagcaagccggggcctggtcggcarctgggccgccatggagtccacgctgggcgcgggcatcgtgatagccgaggcgctacagaaccagctagcctggctggagaacgtgtggctctggrrtsacctttkctngscgatcccaagkatcctctttctgttctacttccccgcggcntactacgcctcccgccgtgtrggcatcgcggtgctctggatcagcctsatcaccgagtggctca

SEQ ID NO: 3338 - DNA, 418 bp, Homo sapiens
  CDS 231..416
  misc_feature 137: n=a, g, c or t
  misc_feature 264: r=a or g
  misc_feature 270: d=a or g or t
  misc_feature 271: k=g or t
  misc_feature 272: v=a or c or g
  misc_feature 405: r=a or g
  UNSURE 12: Xaa=Glu or Lys
  UNSURE 14: Xaa= *  or Cys or Phe or Gly or Ile or Leu or Met or Arg or Ser or Val or Trp
  UNSURE 59: Xaa=Ala or Thr
aggtgcggaagtgcgagggcccaggtggctgaaggggccgttaggaacatccaagcggtggggcacaggcagatccccgacctgacctggaccacccttctcctcttggcccgccccttcaactcgcctccggcttnaggtctggattggccccgccccctgacctgagcctggtccttcttcaggcactgacccttgacctccggtggctcccccatctctcaggcgcgatggctacgggcgcggatgtacgggacattctaraactcdkvggtccagaaggggatgcagcctctgggaccatcagcaagaaggacattatcaacccggacaagaaaaaatccaagaagtcctctgagacactgactttcaagaggccgagggcatgcaccgggaagtctatgrcttgctctactct

SEQ ID NO: 3339 - DNA, 390 bp, Homo sapiens
  CDS 31..390
  misc_feature 323: r=a or g
  UNSURE 98: Xaa=Asn or Ser
aaaaagagctgcgcgccgcggcggcggaagatggctgcggccgaggtggcggacactcagctgatgcttggagtcgggctgatcgaaaaggacacaaatggagaagttctgtgggtgtggtgttatccttccacgacagccacattaaggaacctgctgctgagaaaatgctgccttacagatgaaaacaaacttctccatccctttgtctttggtcagtacagaagaacatggttttatatcacaacaattgaagttccagattcttccattttgaaaaaggtgactcatttttctattgtcctgaccgccaaagattttarcccagagaagtatgctgccttcactaggatattgtgtagaatgtacctgaaacatgggagcccagta

SEQ ID NO: 3340 - DNA, 425 bp, Homo sapiens
  CDS 59..424
  misc_feature 369: b=c or g or t
  UNSURE 104: Xaa=Ile or Arg or Thr
acaataaaatatcagatgcaccagagacacaaggcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattabagtccaatggtatgctggagagttactctgcaaagttctcagttatctaaagcttt

SEQ ID NO: 3341 - DNA, 478 bp, Homo sapiens
  CDS 95..478
  misc_feature 152: k=g or t
  misc_feature 153: n=a, g, c or t
  misc_feature 157: k=g or t
  misc_feature 476: r=a or g
  misc_feature 477: w=a or t
  UNSURE 20: Xaa=Ala or Cys or Asp or Phe or Gly or Ser or Val or Tyr
  UNSURE 128: Xaa=Asp or Ile or Asn or Val
cgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgkncctkcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagarwc

SEQ ID NO: 3342 - DNA, 484 bp, Homo sapiens
  CDS 178..483
  misc_feature 131: s=g or c
  misc_feature 302: s=g or c
  misc_feature 303: h=a or c or t
  misc_feature 381: n=a, g, c or t
  misc_feature 382: n=a, g, c or t
  misc_feature 413: y=c or t
  misc_feature 414: w=a or t
  misc_feature 444: r=a or g
  misc_feature 445: n=a, g, c or t
  misc_feature 461: v=a or c or g
  misc_feature 462: d=a or g or t
  UNSURE 42: Xaa=Pro or Arg
  UNSURE 68: Xaa=Ile or Met
  UNSURE 69: Xaa=Ala or Pro or Ser or Thr
  UNSURE 79: Xaa=Leu or Pro
  UNSURE 90: Xaa= *  or Glu or Lys or Gln
  UNSURE 95: Xaa=Lys or Asn or Arg or Ser or Thr
cagttggagggagcgcttggtgagactgagtgtttacgttgcaggtcttctcccctgtctgcctcccggagctaggactgcagaggggcctatcatggtgcttgcaggccccctggctgtctcgctgttgstggccagcctcacaactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcshagctggctttggacccctccgggaaccagctcatcgtgggagccaggaactacctcttcagactcagccttgccaatnnctctcttcttcaggccacagagtgggcctcywgtgaggacacgcgccgctcctgccaaagcrnagggaagactgaggavdagtgtcagaactacgtgcgagt

SEQ ID NO: 3343 - DNA, 263 bp, Homo sapiens
  CDS 84..263
tctgcgtagaaatttcttccaccaaataccctaaatcatctctctcaagttcaaagtttcacagatctctagggcagggtcaaatgctgccagtctcattgctaaagcataacaggagtcacttttactccatttttcccaacaagttcctcatctccatcagagaccacctcagcctggactttattgtccatatcattatcagcattttggtcaaagccattcaacaattctctaggaagttccaaactttcccacatcag

SEQ ID NO: 3344 - DNA, 426 bp, Homo sapiens
  CDS 209..424
  misc_feature 132: h=a or c or t
  misc_feature 306: k=g or t
  UNSURE 33: Xaa=Leu or Arg
atttttcctttttgtttttgttgttgatgtgaccgcgtgtccacaaccctgggattccctcgccctcagattccagaatccaatttcttggatttcagtgtttttaaggtgggaggtctcgctatgcttcchaggctggactaaaattcctgggctcaagtgattcccccgcctcagcctcctgagtagctgggactacagatatggcatgtcagtctggtggtctagccagaggaagactcctggagctggtgaactgtgcatggatatgcagtcacgggcagcccacctcctactcctcaccckccctgtgcctgtgagggtctgcactcaccctacggagtcttgctctgtggcccaggctggagtgcagtggcatgatcttggctcactgcaacctctgcctcctgagttcacgccattctc

SEQ ID NO: 3345 - DNA, 201 bp, Homo sapiens
  CDS 15..200
tatcgtttctgataatgaggagaatttggtggcccatttggagcctacttaatggtaactatagtgcctcaccaatatctttcttgcgctattccaatttatcaatcattattggacccaatatcctgaattacagtctgattatttttcaccaatcttttatctttcatttacccacactgaaattcttgagcccaactt

SEQ ID NO: 3346 - DNA, 455 bp, Homo sapiens
  CDS 195..455
  misc_feature 150: m=a or c
  misc_feature 151: r=a or g
  misc_feature 163: y=c or t
  misc_feature 178: m=a or c
attcagcccctcgtgttccgctaccgcgcgtgcgggattccggcgccgctctccgagctcgatccgctgctaacacgggagccagctgggtgttatttctcaaactctgaggctgcggagttcacacattgaaatctgtcatctttttcmrgagagaaacttycggtaatgtatgtamccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggagtcttgtggggcacagattta

SEQ ID NO: 3347 - DNA, 351 bp, Homo sapiens
  CDS 10..351
  misc_feature 14: m=a or c
  misc_feature 72: m=a or c
  misc_feature 76: m=a or c
  misc_feature 117: s=g or c
  misc_feature 118: m=a or c
  misc_feature 140: w=a or t
  misc_feature 150: y=c or t
  misc_feature 166: y=c or t
  misc_feature 181: s=g or c
  misc_feature 235: m=a or c
  misc_feature 281: m=a or c
  misc_feature 343: m=a or c
  UNSURE 2: Xaa=Ala or Glu
  UNSURE 21: Xaa=Arg or Ser
  UNSURE 23: Xaa=Leu or Met
  UNSURE 36: Xaa=Ile or Met
  UNSURE 37: Xaa=His or Asn
  UNSURE 44: Xaa=Ile or Asn
  UNSURE 53: Xaa=Pro or Ser
  UNSURE 58: Xaa=Ala or Pro
  UNSURE 76: Xaa=His or Asn
  UNSURE 91: Xaa=Ala or Asp
  UNSURE 112: Xaa=Lys or Gln
aaatattaaatggmaaaaaatcacagaaataaaaaatccatacattttccactgtgcaccattccaagtagmatgmtgaaatcttgtactctcccacttcagcgcacctgggacatsmatccttcctttgtccattggawccaagcccgyctacaatccccaccgyctagtcacttagtasccctctcggtgatcagatcgactctcgtgctatcccagtgcttgtgttcaaggmacccttattttagtgcaatgatgaccccaaagtgcaagagtattgmtgctggcaattcaggtatgccaaagagaaactgtaaagtgcttccttcaagtgaaaagatgmaagttcac

SEQ ID NO: 3348 - DNA, 257 bp, Homo sapiens
  CDS 51..257
  misc_feature 142: s=g or c
  misc_feature 145: r=a or g
  misc_feature 149: y=c or t
  UNSURE 31: Xaa=Ala or Gly
  UNSURE 32: Xaa=Glu or Gly
atgtcaggacccgtgtctatgccgagactggagcctggtgtcgttctataatggaaggacaaaggctgatgggggcagatgtcaaacaggccagaggcccagtgggctggtgtaggcagctagctcagcagagctctggagscgrattycgtggtgtcttataccaagtgttccatgataccatttgtgagaaagaagctcccaagtcatcattactcagaaagcagacccagccccctaagaagcagagttctcct

SEQ ID NO: 3349 - DNA, 454 bp, Homo sapiens
  CDS 50..454
  misc_feature 238: w=a or t
  misc_feature 410: m=a or c
  misc_feature 412: r=a or g
ggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacwgaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggmgrgcaatgctggattcgggaatttaccccctggctcccaggtat

SEQ ID NO: 3350 - DNA, 312 bp, Homo sapiens
  CDS 11..310
  misc_feature 2: k=g or t
  misc_feature 49: b=c or g or t
  misc_feature 153: k=g or t
  UNSURE 48: Xaa=Leu or Arg
cktttcaggaatgaatggtgaccttgaagaggaaggaggtagggaggcbacagatgcccctgagcaagtcgaggagattctggatcacagtgagcagcaggcacgccctgctcgtgtaaatggaggcaccgatgaggagaatggtgaggagckgcagcaggttaataatgagcgtcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaacc

SEQ ID NO: 3351 - DNA, 358 bp, Homo sapiens
  CDS 162..356
  misc_feature 323: r=a or g
gaggctttgcggtggctgcttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggcgctgaggggtctccgaagctggcagtctacgccacgaggaagacccgtagcgtcaggagccaggaggaccagtggtacttgggctaccgggggaccagtggtcctcgggcttctcctacagctggtggraaaatagcgtcggcagcgagacaagcacggcgaga

SEQ ID NO: 3352 - DNA, 425 bp, Homo sapiens
  CDS 125..424
  misc_feature 143: r=a or g
  misc_feature 153: s=g or c
  misc_feature 388: s=g or c
  UNSURE 7: Xaa=Glu or Lys
  UNSURE 10: Xaa=Ser or Trp
agaaaataaaacttcttcctggacacctgaatcaaagaccagtagaaagagtttgctaaaatctgaaaaagaaaaaaaaatttcagaagaatggggctttaaggatatttctactgctcagcaaatgttgaagagggcacagraaatgaaatsgaagaaactaaagaaaaaaatagattccactgtgcgtctagccttattcaaaaacaatgaaaataaagtgtctcttccaaaatcaccaaagatggtacagcccagaagagatggttactttgaaggtatagaagaagaccctatccacaaagataccactgcaaatgaaaaattagaacggaatagagaatatacataccaatggcttcacacacaggttggggttcatgaaacsgctagttccagaaatatgaaatgcaatcactttttgc

SEQ ID NO: 3353 - DNA, 346 bp, Homo sapiens
  CDS 142..345
  misc_feature 161: d=a or g or t
  misc_feature 162: h=a or c or t
  misc_feature 323: w=a or t
  misc_feature 324: n=a, g, c or t
  misc_feature 325: n=a, g, c or t
  misc_feature 326: s=g or c
  UNSURE 7: Xaa=His or Leu or Gln or Arg
  UNSURE 61: Xaa= *  or Phe or Leu or Tyr
  UNSURE 62: Xaa= *  or Ala or Gly or Pro or Arg or Ser or Thr
tcaagttaagagatacccacacagggctgctgggtgcccaggagtcacaggccaggaaacagaccggtaatccggggagaagagctgcacagagggctagactctcgagatgggctggggacctcagtgctgaggtgggaaatgaccagaaaggactggcdhtgtgcggatctgggagtcagggtgtcaggcagagggcatagcaagtgcagaggccctgaggcaggaaccagcttgggacagaacctggcaggccagcagcaggagccaggtcgcgtggaaacatctgccctcaggctaggatggaacattcaggttttatwnnsaatgcagtgggacaccgatt

SEQ ID NO: 3354 - DNA, 195 bp, Homo sapiens
  CDS 21..194
  misc_feature 135: w=a or t
  UNSURE 39: Xaa=Leu or Met
tcgtgtgttatcgtgcatttatgcatttttctttcacctctttcttttggaatgccctttttgcagaaagctacgggtttatgaggaacacacacgcaggcacacacacacaacgtgctgacaaaaggcatccawtgtcaataaggtcatccaactcaattaaaaacattataaagaaatcaaccccttcacact

SEQ ID NO: 3355 - DNA, 427 bp, Homo sapiens
  CDS 231..425
  misc_feature 133: y=c or t
  misc_feature 140: m=a or c
  misc_feature 156: r=a or g
atttgagaagtgccctcctatacttagagaaaaggaatatccatatctctgaagacacagggacacagagagaatctgaacacacagccttggtaggattccttccgtttatcatcattagatcataaccccytttgtcmagtcctatttctccargactgcctccttcttcattaaaccttgcataaaaactcacaaatttaaccatttatttggattcttatttccttatgaaaattcctgtgtggcataaaacgtgctttttaaaatctgaaagtttttctcctgataatttatctgttagtttgccttgtagacctagccaggtaccctcacaggggcaaggaaaatcttttctcctcctacaacttatacatgaggataaagccatccagaatgaagctattttccagccttctctgcagct

SEQ ID NO: 3356 - DNA, 437 bp, Homo sapiens
  CDS 19..435
accgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggactccagagacttcctttaataagtgttgcgctggttcaaggttgggcattgggtggaggagcagc

SEQ ID NO: 3357 - DNA, 246 bp, Homo sapiens
  CDS 72..245
  misc_feature 144: s=g or c
  UNSURE 25: Xaa=Leu or Val
tttcgtgacccaggaatgatcagtgtgtggcttcctgttccggttcttagccttggaggcccttagcttgcatgcccatcagcagtggtgggagtgtttgtcgtgtgcgggtcgcatgttgctttgcaaacatggttttcaacsttcacaatcctaagagcttcctttgttgtccccattttaaaaacaaggaagtgagatatggagagttggcacttggcctaaaccacatttcacatacagcag

SEQ ID NO: 3358 - DNA, 417 bp, Homo sapiens
  CDS 168..416
  misc_feature 151: k=g or t
  misc_feature 152: k=g or t
  misc_feature 387: s=g or c
  UNSURE 74: Xaa=Glu or Gln
gaaaaactcctgccttaaagccctaaatggcggcttcaatatcagtcccactgagcatgaaattcatttacttaaataaaatctgaatctcagcccaaacctgggagattcaaaacctgagagcggtcttaccaaagacgcccgtatgtckkggtgaagtcagttggatgcaagcagtttgtgctggtaccagggccccagctactgatgaagtggcaggagtccacagaagcctacttcgaagttcccggggcttccaggggagattgacgagattcctggggaggcgattcatgacagctgagttccttttggaggatccgtcttcaggcagtctgatcccccaggaaagcagctggaaaacaagagcatgtgaaggaagcgcasagctcctcgccagccagacagccagccgac

SEQ ID NO: 3359 - DNA, 364 bp, Homo sapiens
  CDS 163..363
aagatggttaaaaaccaaaaccggaggaggcagagtactcttggtggggctggtagtggggggaatggatgattttccaaaagagaaaacacttgacctgggtctgaaaggctgggtatgatttaaggcaggcactattgttcacttgttagccccagggccatgctactccacttccttcaaggaaacagagggaagccggcaagtggctgcctggggtgtgtgtccacacaccatatagaggcagttcttcagctctgtcagccatggccaaagcaggcagtatttgaaccaccttggaccactcctgaggggcagcatcagacaccaggcatcctttcagacaccattcttggagtctctt

SEQ ID NO: 3360 - DNA, 277 bp, Homo sapiens
  CDS 92..277
caaaaggtagtctattgtggaaaatgtagcagattgaagatgtgttttcttatactacaaaccaaaaaaagacagtttataaaaactataaatgcggctgggtgcggtggcacacgcctgtaatcccagcactttgggaggccaagacgggcgaatcacgagccaggagttcaagaccagcctgaccaacatgaggaaacccttgtctctactggaaatgcaaagaattggctgggcatggtggtgggcacctgtgatcccagctactcgaaaggct

SEQ ID NO: 3361 - DNA, 177 bp, Homo sapiens
  CDS 16..177
  misc_feature 71: n=a, g, c or t
  misc_feature 72: n=a, g, c or t
  misc_feature 122: s=g or c
  misc_feature 162: m=a or c
  misc_feature 172: r=a or g
  misc_feature 173: y=c or t
  misc_feature 176: r=a or g
  UNSURE 19: Xaa=Ala or Asp or Glu or Gly or Val
  UNSURE 36: Xaa=Arg or Thr
  UNSURE 53: Xaa=Ala or Ile or Thr or Val
  UNSURE 54: Xaa=Asp or Gly
ggttcgggatgagcgatggcatcggtcaaggtggccgtgagggtccggcccatgaatcgcagggaaaaggnnttggaggccaagttcattattcagatggagaaaagcaaaacgacaatcasaaacttaaagataccagaaggaggcactggggactcaggmagagaacggrycgrc

SEQ ID NO: 3362 - DNA, 296 bp, Homo sapiens
  CDS 143..295
  misc_feature 153: w=a or t
  misc_feature 160: r=a or g
  UNSURE 4: Xaa= *  or Leu
cctagaatatgagtcaagaataaactccttccctctcagcttcttttccatctaaaccactattttcattcattatatcaccaccccaaatcttttcccttgttttaactggccaaattgcacttcagataagctagttagaatgtctctttwaatagartcagctctggctcacacaaccaggaagaaaaacacctggccagtggcatctgagcctcacatcccaggagattcacgcttctctctaaggaaacccttccggatgatgggtatccatcatcaacttcgtgtggcgt

SEQ ID NO: 3363 - DNA, 361 bp, Homo sapiens
  CDS 188..361
acttaacggtggtggctggttctgcgccggatccgggagaggggcgggcgccattgtgcttcgctgccgactgcatttcctcagtcacgggcctagaactccaaggagaaaggcggcggtgcgtgttgctgcgagtgggacgcgcactggtcggtgccggctcaggagccgggaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcaacc

SEQ ID NO: 3364 - DNA, 298 bp, Homo sapiens
  CDS 113..298
ggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacct

SEQ ID NO: 3365 - DNA, 378 bp, Homo sapiens
  CDS 17..376
  misc_feature 71: h=a or c or t
  misc_feature 72: n=a, g, c or t
  misc_feature 129: r=a or g
  misc_feature 134: r=a or g
  misc_feature 144: s=g or c
  misc_feature 155: v=a or c or g
  misc_feature 281: r=a or g
  misc_feature 299: n=a, g, c or t
  misc_feature 300: n=a, g, c or t
  misc_feature 303: y=c or t
  misc_feature 311: r=a or g
  misc_feature 328: n=a, g, c or t
  misc_feature 335: w=a or t
  misc_feature 340: v=a or c or g
  misc_feature 341: k=g or t
  misc_feature 359: d=a or g or t
  UNSURE 19: Xaa= *  or Ile or Lys or Leu or Pro or Gln or Arg or Ser or Thr
  UNSURE 38: Xaa=Gln or Arg
  UNSURE 40: Xaa=Ala or Thr
  UNSURE 43: Xaa=Pro or Arg
  UNSURE 47: Xaa=Gly or Arg
  UNSURE 89: Xaa=Ala or Thr
  UNSURE 95: Xaa= *  or Ala or Glu or Gly or Lys or Leu or Met or Pro or Gln or Arg or Ser or Thr or Val or Trp
  UNSURE 96: Xaa=Leu or Pro
  UNSURE 99: Xaa=Asp or Asn
  UNSURE 107: Xaa= *  or Arg
  UNSURE 109: Xaa= *  or Glu
  UNSURE 115: Xaa=Cys or Gly or Ser
atatcattggtgaggaatggccacccactgccctctttactgtgtaggagcagatctgatgatgaacagahnaggtgagcacgtgtggagtgagagcgaggactgcctgcctttcttgcagctagcacrgattrcatctcctcstgcggcaagavgacgctccacgaagtcctggaaaaagtcttcaagtctttcagacctttactggggcttccggatgcagatgacgatgcgtttgaagagtacagtgctgacgtggaagaagaggagccagaggcggrccacccccagatgggggnngcyagcagtaratctgggggctcccctnagaaggwgagtvkagccccacagtaacctadgtggggtcactgcccctcc

SEQ ID NO: 3366 - DNA, 427 bp, Homo sapiens
  CDS 232..426
  misc_feature 104: m=a or c
  misc_feature 105: y=c or t
  misc_feature 111: r=a or g
  misc_feature 113: w=a or t
  misc_feature 116: w=a or t
  misc_feature 121: w=a or t
  misc_feature 125: m=a or c
  misc_feature 127: v=a or c or g
  misc_feature 132: k=g or t
  misc_feature 143: m=a or c
  misc_feature 345: m=a or c
  misc_feature 391: d=a or g or t
  UNSURE 38: Xaa=His or Gln
  UNSURE 54: Xaa=Ala or Ser or Thr
aatcgcggtcgcgagccatggaggaggaggcatcgtccccggggctgggctgcagcaagccgcacctggagaagctgaccctgggcatcacgcgcatcctaggmytgtgargwtgwtgagwtacmavacctkgattaaggtamattaaaatggcaaaagcaagattatccagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcamatcattccactgggaagcatggcaattaacagcatctcaaaactgdctcagctcacccagtcttccatgtattcacttccta

SEQ ID NO: 3367 - DNA, 299 bp, Homo sapiens
  CDS 28..297
  misc_feature 141: m=a or c
  misc_feature 142: w=a or t
  misc_feature 143: n=a, g, c or t
  misc_feature 144: n=a, g, c or t
  misc_feature 160: r=a or g
  UNSURE 38: Xaa=Asp or Glu
  UNSURE 39: Xaa= *  or Cys or Phe or Ile or Lys or Leu or Met or Asn or Arg or Ser or Thr or Trp or Tyr
  UNSURE 45: Xaa=Ile or Val
gagcgaggcggggccgccggggccgccatggagcccgactcggtgattgaggacaagaccatcgagctcatgataagtaatggaacatcatctgtgatcgtctccagaaagaggccatcagaaggaaactatcaaaaagamwnngacttgtgtattaaartattcagcactttgagaggccaaggcagcagagcccttgctagaagccagtggcatgctcttgaacttcccagcctgcagaactatgagctaaaattctccactttagcaatacttacaggatctgggacacacagacc

SEQ ID NO: 3368 - DNA, 205 bp, Homo sapiens
  CDS 10..204
cctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcaga

SEQ ID NO: 3369 - DNA, 354 bp, Homo sapiens
  CDS 26..352
  misc_feature 135: b=c or g or t
  misc_feature 136: n=a, g, c or t
  UNSURE 37: Xaa=Ile or Met or Arg or Ser or Thr
attctggtctcagagcctgaggctgatggcctgtggggaaatttcaggggagcacagagaggaagaaaggagaacggaaacccgtccaggggccccagccggccctttgcaaacagaggcagggtcaggcgaaabngagggccaggtcgcagatgaaggctggagtctgagccctctggtctcagcggagagcaggggacatgtccccccaggacgggctcctgcttgctcccgaggggcgccttggcagggcggacattggaagctgaatgcggaggaagcatccggaagcggcgctcttggcctcagccctcctgtcctgggatggagttttgccatgttgcgcaggctggt

SEQ ID NO: 3370 - DNA, 256 bp, Homo sapiens
  CDS 54..254
  misc_feature 132: y=c or t
  UNSURE 27: Xaa=Phe or Leu
ctcatgcctcctcctgtccccattgtacttcctgaaagagcagcccatccctgatggggccacctcctcacatggcagctgcactcagcgccagctcagagcattccagtgctccagctgtttggaactctytctgctgtaacagcccttcaaggtctcctaattgccagagcccctgctttcccctcagtcctaactcccccttgaggccccctgctctggcccagagcttcctcactcactcctctgctgccaa

SEQ ID NO: 3371 - DNA, 251 bp, Homo sapiens
  CDS 90..251
  misc_feature 133: r=a or g
  misc_feature 191: n=a, g, c or t
  misc_feature 192: d=a or g or t
  UNSURE 15: Xaa=Cys or Tyr
  UNSURE 35: Xaa= *  or Gly or Arg
aatagttcccatggtttcctttgctcccagcggttgcgcgggctgggtttttggagcaaaggcaacggatactgctgaggctcctgagaatgtcccgttttcgaggctgcagtagctccggtgtccggttctrcagtgcccgagagggaggcctcgggctccgggcgggggaatgtgttgcagtttgtccndgagccccaagcccagcaaagccgcccgttccccgctggggcgcaactctcactggaact

SEQ ID NO: 3372 - DNA, 242 bp, Homo sapiens
  CDS 45..242
  misc_feature 96: r=a or g
  misc_feature 117: w=a or t
  misc_feature 120: y=c or t
  misc_feature 123: k=g or t
  misc_feature 160: r=a or g
  misc_feature 213: b=c or g or t
  UNSURE 18: Xaa=Ala or Thr
  UNSURE 25: Xaa=Phe or Ile
  UNSURE 26: Xaa=Pro or Ser
  UNSURE 27: Xaa= *  or Glu
  UNSURE 39: Xaa=Asn or Ser
  UNSURE 57: Xaa=Ala or Pro or Ser
tagtacaggttgagcatctcaaatttggaagttcaaagtctgaaatgctccagatcagaaactttttgagcactgatatgatgctcaaaggaaatrctcattggagcattttgggawttycakaatctgtggatttgagatgctcaaccagtaagtatartagagctattcccaagatccgaaaaaattctgaaatcagaagcacttctggtbccaggcattttggagaagggatgctcaac

SEQ ID NO: 3373 - DNA, 215 bp, Homo sapiens
  CDS 11..214
  misc_feature 107: k=g or t
  misc_feature 142: k=g or t
  UNSURE 33: Xaa=Leu or Val
  UNSURE 44: Xaa=Phe or Leu
atacactattatgtgtcaatatattaattatatattaattacatttatagaggttaggtatatatggcagatcatatctgagcgtgaattacattctccaatatttktatttgtcatgatttattgcagggttcacttattkgatctaccccaacttaagacacatttccaagaaaatatccatcacactagaaagaaagaaagaggaaggaagg

SEQ ID NO: 3374 - DNA, 214 bp, Homo sapiens
  CDS 62..214
  misc_feature 87: w=a or t
  misc_feature 90: s=g or c
  misc_feature 119: v=a or c or g
  misc_feature 122: m=a or c
  misc_feature 138: k=g or t
  misc_feature 156: k=g or t
  misc_feature 164: s=g or c
  misc_feature 180: s=g or c
  misc_feature 193: m=a or c
  misc_feature 194: k=g or t
  misc_feature 195: n=a, g, c or t
  UNSURE 9: Xaa=Glu or Val
  UNSURE 10: Xaa=Ala or Gly
  UNSURE 20: Xaa=Ala or Pro or Thr
  UNSURE 21: Xaa=Ile or Leu
  UNSURE 26: Xaa=Gly or Val
  UNSURE 32: Xaa=Cys or Phe
  UNSURE 35: Xaa=Ala or Pro
  UNSURE 40: Xaa=Arg or Thr
  UNSURE 44: Xaa= *  or Cys
  UNSURE 45: Xaa=Ala or Cys or Asp or Phe or Gly or Ser or Val or Tyr
agaccccgccccccttaagaagagaagccgcggcccctgcaggacgggggcctgtgtcgctatgggttcccccgccgccccggaggwagsgctgggctacgtccgcgagttcactcgcvcamtcctccgacgtgctgkgcaacctcaaacgagctkcgcctgcscgggatcctcactgasgtcacgctgctgmkntggcgggcaacccctcaga

SEQ ID NO: 3375 - DNA, 287 bp, Homo sapiens
  CDS 110..286
  misc_feature 177: s=g or c
  misc_feature 233: r=a or g
  misc_feature 244: r=a or g
  UNSURE 23: Xaa=Arg or Thr
  UNSURE 42: Xaa=Ala or Thr
caatggaacagaacagagccctcagaaataacgccgcttatctacagctatctgatctttgacaaacctgagaaaaacaagcaatggggaaagattccctatttaataaatggtgctgggaaactggttagccatatgtagaaagctgaaactggatcccttccttacaccttatasaaaaatcaattcaagatggattaaagacttaaacgttagacctaaaaccataaaarccctagaagaraacctaggcattaccattcaggacataggcatgggcaaggact

SEQ ID NO: 3376 - DNA, 304 bp, Homo sapiens
  CDS 150..302
  misc_feature 17: w=a or t
  misc_feature 138: w=a or t
  misc_feature 173: w=a or t
  misc_feature 194: w=a or t
  misc_feature 195: r=a or g
  misc_feature 235: m=a or c
  misc_feature 266: w=a or t
  misc_feature 268: m=a or c
  misc_feature 275: r=a or g
  UNSURE 16: Xaa=Glu or Lys
  UNSURE 29: Xaa=Ala or Asp
  UNSURE 39: Xaa= *  or Cys
  UNSURE 40: Xaa=Lys or Thr
cttgcttccaatttatwtgctactacaaaatgattaaaatgagtgacttgtaaaaaaaccaaataaatatgttgaaattaaatcaaagtttgaacagatcttgagaggtacctagtaattgaataggggtggaataawactaatcacatatgtgcaggaaacagcacatagtwcagtttgggtttgggcaaggwragagtaggagccaaggctggaaaggtgagttaaagatggmttgtgggccaggcgtggtggctcgtgcctgwamatgccarcactttgggaggcagaggcggccaatcac

SEQ ID NO: 3377 - DNA, 207 bp, Homo sapiens
  CDS 23..205
  misc_feature 138: w=a or t
  UNSURE 39: Xaa=Glu or Val
ctatggtccacaaaggcggaagatgatgtttatgggatttatccgtctgggagtgtggtacaacttcttccgagcctggaacggaggcttctctggaaacctggaaggagaaggcttcatccttgggggagttttcgwggtgggatcaggaaagcagggcattcttcttgagcaccgagaaaaagaatttggagacaaagtaaacct

SEQ ID NO: 3378 - DNA, 226 bp, Homo sapiens
  CDS 38..226
  misc_feature 25: d=a or g or t
  misc_feature 118: m=a or c
  misc_feature 120: s=g or c
  UNSURE 27: Xaa=His or Gln
  UNSURE 28: Xaa=Pro or Arg
aggatctcagggtgagtctggtaadaagccttctgaaatgttagaccagagaattatctggagagggaggaaatgcagggcaagttcctgcaaagcctcacactcatgttggtctcamcsgatgtttatcagggagaaacagcctgtactcccagggcagccgtttgaacgggcagagcccactttgttcctcgattctgtttctttccatgcaatccgcccttcc

SEQ ID NO: 3379 - DNA, 424 bp, Homo sapiens
  CDS 134..424
  misc_feature 63: r=a or g
  misc_feature 74: n=a, g, c or t
  misc_feature 75: n=a, g, c or t
  misc_feature 113: w=a or t
  misc_feature 119: w=a or t
  misc_feature 318: y=c or t
  misc_feature 319: w=a or t
  UNSURE 62: Xaa=Ile or Thr
atacgatgtactttttttaatgccgttgaaacagagttaatttcctttagcacacaagtcttrgagacaaaatnnaaaaaggtctgcaacatgaaaagtcacaggcatcacawtcctcwtttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcaywgagctctatttgattgagaacaaggttactatcttacataataacggttttggtaacctctccagtctagaaattttaaatatctgtagaaactccatctatgtt

SEQ ID NO: 3380 - DNA, 393 bp, Homo sapiens
  CDS 198..392
atttttatcagtgcagtattggacaggatagagaaattttcagtgcagggtctggctaaagcatgttttgggtcagtgtctcaacctctggtctgggagtccctggacctagaacatttacttaattaactgttgttgggacatttgagtattgccatcaaagtcactaatagccatggttcttggatttttggattatggatccctttgaaaagcatttgaaagttatgtgccatcttccctcaaaggcacataaacggaactttatgtacagtttcagggtggtaaggaacccctgcaatctatttatggatcataggttaataattcctgctatgggaactgaagataccaagatagagaagtctagtattttaggaatgtataataaat

SEQ ID NO: 3381 - DNA, 368 bp, Homo sapiens
  CDS 195..368
atcccgggggccagtcgcggccgggacatcgggcgctgcggccggggacccgctgctgagatagacagaatatggcagagctttatgagccagagggaccagtagattggaaggaacgatgtgtagctctggagtcccaactcatgaaatttagagttcaagcaagcaagatacgagagcttttagcatagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagat

SEQ ID NO: 3382 - DNA, 400 bp, Homo sapiens
  CDS 8..400
  misc_feature 374: s=g or c
  UNSURE 123: Xaa=Ala or Pro
caaaacaatgcatctgcagagagatggggaggagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagscctcctacagtgatattgccgccaaa

SEQ ID NO: 3383 - DNA, 313 bp, Homo sapiens
  CDS 96..311
aaatagggagaaatggcgacggagcctggctgtgggcccatctttggaaaaaagatctgggaatgattgtctagcctccagcctcaacttacttgatgcttgagagactcaaagccccgtggtcagctgccctgcaaagaaagtattttgaccttggcatttggacagctcccatctctcccatggccctgacaatgctgaatgggctcctgattaaggactcaagcccacctatgctgctgcaccaggttaacaagactgcccagttagataccttcaactaccagagctgctttatgcaaagtgtctttga

SEQ ID NO: 3384 - DNA, 417 bp, Homo sapiens
  CDS 245..415
tagcactaaatcccacatcaaaaagttaggaagaactcaaattaataacctaacatcacaactgaaagaactagagaagcaagacaaaaccccaaagctagaggaagacaagaaataactgaaaatctgagctgaactgaaagaaaccgagacatgaaaaaaagaaattcaaaagatctatgaattccgggtaggtttcttgaaaatattaataagaaagtctgctagcagactaatacagaggatgattgaaagaaacacaattagaaatgacaaagggaatgttaccactgaccccacagaaatagaaacagccatcagaaactactgcaaacacttctatgcatacaaactagaaaacttcaaagagatggataaattcatggagaaatacaccctcccacaactgagccatga

SEQ ID NO: 3385 - DNA, 456 bp, Homo sapiens
  CDS 101..454
  misc_feature 181: m=a or c
  misc_feature 338: d=a or g or t
  misc_feature 339: b=c or g or t
  misc_feature 340: n=a, g, c or t
  misc_feature 378: m=a or c
  UNSURE 80: Xaa= *  or Ala or Cys or Phe or Gly or Ile or Leu or Met or Arg or Ser or Thr or Val or Trp
  UNSURE 93: Xaa=Pro or Gln
aaccccggggttccgcggtggaggggtgctatactgggatgcaggcgcggcggggactggcagcaatcatgccctgggagctaacgtagagctttggataatgcttttgcaagttgtacgagaagggaagttctcggggtttcttgaccctcctgcagcctcctcttgcctcgggctgccmagatcttggcggctgaggctggcttaccttcgagccgttccttcatgggatttgctgctcccttcaccaacaagcgaaaggcttactcggagcgtagaatcatggggtaagcattctctgccttgcatccttgcacctcccttttccctccaaatadbnctgtccaggcaagaatgtcagggtatcatcggtgggcmagattcatccctagccatccccctccccagctacaatactgatcctcagtcctcccctgccactcttccgaccttaat

SEQ ID NO: 3386 - DNA, 445 bp, Homo sapiens
  CDS 55..444
  misc_feature 133: w=a or t
  UNSURE 27: Xaa= *  or Lys
ctctttggttacgctcgtcagccggtcggccgccgcctccagccgtgtgccgctatgggagtcccggcgttcttccgctggctcagccgcaagtacccgtccatcatagtcaactgcgtggaagagaagccawaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcaagggcatcaaaagaaggcatggaagcagcagtc

SEQ ID NO: 3387 - DNA, 180 bp, Homo sapiens
  CDS 12..179
  misc_feature 147: w=a or t
  misc_feature 159: y=c or t
  misc_feature 179: w=a or t
  UNSURE 46: Xaa=Cys or Ser
  UNSURE 50: Xaa=His or Tyr
tcaaccagtgcatgatatctttccccatggtggtcttcctctatcccttcctcaaatggtggagagacccctgccgccgtgagctacccaccttccactggttcctcctggagctggccatcttcacgctgatcgaggaaggtcctwgttctactattyacaccggctccttcacccgwc

SEQ ID NO: 3388 - DNA, 211 bp, Homo sapiens
  CDS 53..211
  misc_feature 132: w=a or t
  misc_feature 147: r=a or g
  misc_feature 184: k=g or t
  misc_feature 186: n=a, g, c or t
  misc_feature 187: d=a or g or t
  misc_feature 192: w=a or t
  UNSURE 27: Xaa=Phe or Tyr
  UNSURE 32: Xaa=Glu or Gly
  UNSURE 45: Xaa=Ala or Asp or Glu or Gly or Val
  UNSURE 47: Xaa=Ile or Lys
acactcatgcctgaagttgacgagaactatcctcctccagttaaggaggaggatgctgcttctgtttagaccaaaatctcccttatacagggaagctccctgtagtgcaagcctgacaagggcactctcatwcatgctgggggctgrggggaagcttctggactcaatgtctcggacacctctkgndcccawacaagtcaaaggaagagca

SEQ ID NO: 3389 - DNA, 234 bp, Homo sapiens
  CDS 2..232
gatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccgaa

SEQ ID NO: 3390 - DNA, 367 bp, Homo sapiens
  CDS 157..366
  misc_feature 220: r=a or g
  UNSURE 22: Xaa=Ile or Val
tttgtccctgtgcttgtacatcttccttttatttgtgtgttatagttctattccatttgagaaggcagttggtaagaactagattgcatgtacaaagacaggtttactaagtgctgtacagtggtcctgaggttacagttgaattagaaaaacgaaatgtacttacaggaaataagaaagcaaacctttcaaatgagagtgatgatttctttaaaaaaartcagtttttttctctcaaataatgttctttatttcacgaaatcgtcaatcttaagcatgagcagggataaacaactcctagaaggaactcaattcattcttcctggattttctctgttgttaaatcacaaaaatgatagtccccaaa

SEQ ID NO: 3391 - DNA, 382 bp, Homo sapiens
  CDS 138..380
acattcagagaaacttggttgctgtctttgctgtcaggaaagaggaagactacctagacatgttgctccagagcagaatttccagcagtagattgaaccttcggaggccgagtcccagcccagtgtaaactgagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgac

SEQ ID NO: 3392 - DNA, 338 bp, Homo sapiens
  CDS 116..337
  misc_feature 269: r=a or g
  UNSURE 52: Xaa=Gly or Arg
tttgtacagggtaggggcaagtagcagaaaaatcaattaattcacataaaggaacattttcattctaaattaatattgccactgcaattaaatttatctagtatttttaacatgtatggataacacactttcctgtgtacaccttggatacctgggaccgttatatgtgatcaactatcatcttagttttttagcttggttaacacttgacccctccccccacctcaaaatcagtaaaatgctgtggattctgctttttaaaaaaatcrggccaaaatctcagcattctccatggctcccagtgcttctcggcagttttttttttttttttttttttt

SEQ ID NO: 3393 - DNA, 261 bp, Homo sapiens
  CDS 55..261
  misc_feature 43: s=g or c
tttttttttctttccctttcaacccacagtgtgccatgcggastgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagcgc

SEQ ID NO: 3394 - DNA, 213 bp, Homo sapiens
  CDS 52..213
aacctgatgccttaaggaaaaggttaagatgagagggggcttccagagtcaatgaacgtcacccttcagccgacggataccgggagcgcttgggcaaaacagcagagaaagaaagactgtggtcggggaagtggaatgcttcgatgcaggccagagttcaaggctctggggctggcctcacaagaggcttcttccacggggcttgacaccaga

SEQ ID NO: 3395 - DNA, 241 bp, Homo sapiens
  CDS 83..241
  misc_feature 40: m=a or c
  misc_feature 140: r=a or g
  misc_feature 199: w=a or t
  UNSURE 20: Xaa=Ala or Thr
cgatatgcaaaacccattggacgaccgaaaaataaattamagcaacgattgttgtctgtaaccagtgatgaaggatccatgaatgcattcacaggaagggggtcacctggtaggggtcaaaaagactaaagtctgtaccrcaccttcatctggtcatgctgcatctgggaaggactcaagcagcagattggctgttacwgaccccactcggcctggtgccaccaccaaaatcaccaagccc

SEQ ID NO: 3396 - DNA, 291 bp, Homo sapiens
  CDS 41..289
  misc_feature 49: v=a or c or g
  misc_feature 73: d=a or g or t
  misc_feature 74: r=a or g
  misc_feature 99: m=a or c
  misc_feature 117: m=a or c
  misc_feature 147: w=a or t
  misc_feature 175: m=a or c
  UNSURE 3: Xaa=Asp or Glu
  UNSURE 11: Xaa=Asp or Glu
  UNSURE 12: Xaa=Glu or Lys
  UNSURE 20: Xaa=Lys or Thr
  UNSURE 26: Xaa=Ala or Glu
  UNSURE 36: Xaa=Glu or Val
  UNSURE 45: Xaa=Arg or Ser
ttcctcgggtcagactaccggcggcgacgaccacgggagcatggcggavaccgacctgttcatggaatgtgadraggaggagttggagccatggcagamaatcagtgatgtcattgmggactctgtagttgaagattataattcagwggataaaactaccacagtttctgtgagmcagcagccagtctcggctccagtgcccatcgctgcccatgcttctgttgctgggcacctctctacatccaccaccgttagtagcagcggggcacagaacagcgacagtacaaagaa

SEQ ID NO: 3397 - DNA, 376 bp, Homo sapiens
  CDS 204..374
  misc_feature 169: s=g or c
tgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgsacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtc

SEQ ID NO: 3398 - DNA, 381 bp, Homo sapiens
  CDS 2..379
  misc_feature 246: r=a or g
  misc_feature 247: s=g or c
  misc_feature 273: k=g or t
  misc_feature 274: h=a or c or t
  UNSURE 82: Xaa=His or Gln or Arg
  UNSURE 91: Xaa=Ile or Arg or Ser
aatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccrscgaatgggtcctaatctgcagctgakhgagggagatgcaaagcagctggctggaatgatcacctttacctgcaacctggctgagaatgtgtccagcaaagttcgtcagcttgacctggccaagaaacactcaac

SEQ ID NO: 3399 - DNA, 240 bp, Homo sapiens
  CDS 72..239
aaaatttcagaaccatttggggttaaatttattccatttctcaacagtagggattggtttaaatcactttgatgccacacaaaaaggaaaattacaaggcaggactagtagggagtttttcacatttgttatgtgatgattatgctggcagcacaaaggtcaaactcagcttaactacttctaggtcggttatttcctctgttataaagttggcattaagtttcagacttgggggtaggg

SEQ ID NO: 3400 - DNA, 182 bp, Homo sapiens
  CDS 17..181
atataagactattaaaatggccataaggaaccatacagaactttttgaaattaaaatctggaggaatggatttaaaagcagatctgagaaagctgaagagacaattagtgaattggaaaatatatctgaagaaattttgcagaatgcaacagagagagaaaataaaatggagcacacctcga

SEQ ID NO: 3401 - DNA, 423 bp, Homo sapiens
  CDS 254..421
  misc_feature 312: s=g or c
  misc_feature 378: v=a or c or g
  misc_feature 379: b=c or g or t
  misc_feature 380: y=c or t
  misc_feature 381: r=a or g
  UNSURE 20: Xaa=Pro or Arg
  UNSURE 42: Xaa=His or Pro or Gln or Arg
  UNSURE 43: Xaa= *  or Gln or Arg
gctccatcttagctcacactccttaccacactgttctgaaagtatcttgactgtcccttctcctcaactggctaacttctagagagcagaaactgactgattggaaaggtcattaaatattcatatcctgaacatttcttaatcttgaggatatgaatcagtaactcttaaaagcaaaatgttatttatcattaaatgttaacaatataatcacatcttcttgcatctctggcaagtttcctggtacaacaacatgaagcgacaaagacaccccagattgcgcccccagtcagcccagtcttctttccctcsctcccctggtccttctcctgatgtgcaactggcaactctggctcagagagtcaaggaagttttgcvbyratgtgccattgggtgtcatccagagagacctggccaagactt

SEQ ID NO: 3402 - DNA, 287 bp, Homo sapiens
  CDS 63..287
taaagattaaaaacatacagtaagatagaaggaataaattcaatgattgatagcagagcaggatgactatacttaacaaagatgtattgtatcttgataatggacaccctgaatacactgacttgattgctacacactgtatatgtgtaaaaaaattctcatgtaccacatacactttcacaaaaagcactggctttccacttccctttcccaggactgatatttacatgaactacaaggtggggcccagtgcctttctctggagtttgaagacacaccgccacata

SEQ ID NO: 3403 - DNA, 358 bp, Homo sapiens
  CDS 187..357
tggaattctcaacaaggcatcgatcgaaaattggcaaatcaaattagtgatttaagacagtctgttatttggcttggagatcaggtagtgagtctcgagcatcacatgcaaatgcagtacaattggaacacttgagatttctgcatcaccccgtattcctataacgagactgatcattcatgggaaatggtcaaaagacatcttctgggtagggaagataatttatcactggacataactaaattaaagagacaaatttttgaagcctctcaagctcacttatccattgtgcctggagctgaggcgttagatcaggtggcagaaaatctttctggattaaaccccaggacttggatta

SEQ ID NO: 3404 - DNA, 295 bp, Homo sapiens
  CDS 124..294
agtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaa

SEQ ID NO: 3405 - DNA, 251 bp, Homo sapiens
  CDS 99..251
  misc_feature 91: m=a or c
  misc_feature 104: m=a or c
  misc_feature 106: y=c or t
  misc_feature 114: r=a or g
  misc_feature 124: s=g or c
  misc_feature 133: m=a or c
  misc_feature 136: m=a or c
  misc_feature 215: k=g or t
  UNSURE 2: Xaa=Asp or Glu
  UNSURE 3: Xaa=Phe or Ser
  UNSURE 6: Xaa=Glu or Lys
  UNSURE 9: Xaa=Pro or Arg
  UNSURE 12: Xaa=Ala or Glu
  UNSURE 13: Xaa=His or Pro
actccacccctcccccgtttctgaggtttgaaaagaaagaagtagaggtcaagagagcctcccctccccaccattcccagaaaaggaggamggggctgatggamtyctctgggraaccccctcscctccctgmgcmccgtcatcaagaagaaaattcgaagaaaaggtttagcagggacagagaagcgacctgtcccggaaaccccttaaagcckgcgggtaacatgtttgctccctcctcccccactccg

SEQ ID NO: 3406 - DNA, 255 bp, Homo sapiens
  CDS 69..254
acattaagttaggacttactgtattattatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctca

SEQ ID NO: 3407 - DNA, 289 bp, Homo sapiens
  CDS 48..287
catcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgccgccg

SEQ ID NO: 3408 - DNA, 390 bp, Homo sapiens
  CDS 164..388
  misc_feature 36: s=g or c
  misc_feature 69: s=g or c
  misc_feature 204: y=c or t
  misc_feature 205: w=a or t
  UNSURE 14: Xaa=Leu or Pro
cacagtcagggaagggcgctgagaggcgagcgtgasccagcgacaggagagtgagctcaccacgcgcasccatgaccagcaagggtcccgaggaaggagcacccatcggtgacgctcttccgccagtacctgcgtatccgcactgtccagcccaagcctgactatggtggcacctggctatgtggtgaccgtgttgacctggcywggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggct

SEQ ID NO: 3409 - DNA, 361 bp, Homo sapiens
  CDS 59..361
aagaaaaagaagctgttgcgtgcagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggatggg

SEQ ID NO: 3410 - DNA, 402 bp, Homo sapiens
  CDS 104..400
  misc_feature 281: n=a, g, c or t
  misc_feature 282: n=a, g, c or t
  misc_feature 360: r=a or g
  UNSURE 60: Xaa=Ala or Cys or Asp or Phe or Gly or His or Ile or Leu or Asn or Pro or Arg or Ser or Thr or Val or Tyr
  UNSURE 86: Xaa=Lys or Arg
aacaaaggagggaagggttagagtgaggtactcacccagagaagagctgtcccggcctgggggtcccattcgtcccttctctttcttgccaaagagacggcctatggatgacttgatgctcttcttcttgggggctttgtgcagagaatctggggtgccctcactgggaaagcaggagagaatgagagcatatgctgctgagatgccccctctcctcccaagtccttgtccacccccttctcatcttcccaagccagcttctccctgtccctatcccttgnncctgctgaccttccccgtgggggtcccccatcttccagggacccgcctgcagtgccaaggcctgggtcattctctcaracgggcagagcggggagtgggtggtggggtgtctcctgggat

SEQ ID NO: 3411 - DNA, 284 bp, Homo sapiens
  CDS 37..282
aatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgtcc

SEQ ID NO: 3412 - DNA, 438 bp, Homo sapiens
  CDS 87..437
  misc_feature 404: m=a or c
  misc_feature 432: m=a or c
  UNSURE 106: Xaa=Asp or Glu
  UNSURE 116: Xaa=Pro or Thr
tataactcagttttctgttgtctttagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctgtaagacttcaatctgtttttaaaggagggtttgamattttaagaacattatacttacattcamcgggac

SEQ ID NO: 3413 - DNA, 354 bp, Homo sapiens
  CDS 199..354
  misc_feature 173: m=a or c
  misc_feature 174: n=a, g, c or t
agtctaactctggctgggaaagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaamncagcttagaagcactgttgtaaaaatgactgaagagcccattaaggagatcctgggagccccaaaggctcacatggcagcgacgatggagaagagccccaagagtgaagttgtgatcaccacagtccctctggtcagtgagattcagttgatggctgctacagggggtacgagctctcct

SEQ ID NO: 3414 - DNA, 419 bp, Homo sapiens
  CDS 133..417
  misc_feature 342: n=a, g, c or t
  misc_feature 343: s=g or c
  misc_feature 346: v=a or c or g
  misc_feature 360: n=a, g, c or t
  misc_feature 381: r=a or g
  misc_feature 390: s=g or c
  UNSURE 71: Xaa=Asp or His
  UNSURE 72: Xaa=Gly or Arg
ttctatggttgtctttgggatgtttttgtgcctcacccctatctctccttccgtccttggctccttttcttctctcaggagattgggagtctgaacttggaagccaatgtgacagcagatagagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatgggagcnsatvgaggagaggcaccnacagaccctgcacttgatggrccagctggsaccacccagatcaataaactggcttattt

SEQ ID NO: 3415 - DNA, 222 bp, Homo sapiens
  CDS 4..222
  misc_feature 120: w=a or t
  misc_feature 214: s=g or c
  UNSURE 71: Xaa=Asp or His
cagatgctgtttttttgtttttttaaatttttatatttttttgagacagagtctgctctgttgcccaggctggagtgcagtggcgcgatcttggctcactgcagcctccatctcccgggwtcaagcgattctcctgcctcggccacccgaatagctgggattactggtgtgtgccaccatacccagctaaattttttttgtatttttagtagasacggagtt

SEQ ID NO: 3416 - DNA, 353 bp, Homo sapiens
  CDS 77..352
atgtaccagctgcgtcctctgggccacgctccacttgcccgcttccacccggaaagccccccaggctgagtgcggcatgatctccatcaccgaatggcagaagattggtgtggggatcaccggtttcggcatcttcttcatcctctttggaacactcctgtactttgattccgtgctcctggcctttggaaacctgctgttcctgacgggcctgtccctcatcattggcctgaggaagaccttttggttcttcttccaacggcacaaactcaagggaaccagcttcctcctggggggtgtggttatcgtgctcctacgctggcccctcctcggcatgttcctggaactacgga

SEQ ID NO: 3417 - DNA, 319 bp, Homo sapiens
  CDS 22..318
gtgccgctcgtgtcagtcaacatggaggcagaggaatcggagaaggccgcaacggagcaagagccgctggaagggacagaacagacactagatgcggaggaggagcaggaggaatccgaagaagcggcctgtggcagcaagaagcgggtagtgccaggtattgtgtacctgggccatatcccgccgcgcttccggcccctgcacgtccgcaaccttctcagcgcctatggcgaggtcggacgcgtcttctttcaggctgaggaccggttcgtgagacgcaagaagaaggcagcagcagctgccggagggaaaaagcggt

SEQ ID NO: 3418 - DNA, 344 bp, Homo sapiens
  CDS 156..344
agattccccatagacgctggagaaagactgaattcttactcttaaagaaaaatatcaaaagaggaggatgatgttcaagctatcaccgattggcctgctcttcatgtttgttaacattccggggacaaacttcaacatcaacaacctcaaattctatggcagtatccaatcctgcgtcaagcctgaatcccgggaccagacctaatcccaggaagagcaccaatcccagaatgaaccccaatcctgggataagcccagatctcaaaatgacctcgagtcccaagatgactccaaattccaagacaagtctgaatagagcagtgaccccaaagagccacaacgat

SEQ ID NO: 3419 - DNA, 279 bp, Homo sapiens
  CDS 10..279
ttacagaaaatgtttgtgttgtgggcatttgaagatggttggttgatcgtcctaaactttgcaaattttcacatttttatttttattttcgtgagacagagtcttgctgtgttgcccaggctggagtgcagtggtgtgatctcggttcactgcaacctcctcctcctgggttcaagtgagtttcagcttgaagcagcctcagcctccagagtagctagtattacaggcatgagccaccatacccgactaatttttgtatttttagtagagacagggcct

SEQ ID NO: 3420 - DNA, 306 bp, Homo sapiens
  CDS 44..304
  misc_feature 94: s=g or c
aaaacttcagcgtcacagctgaggactggcttcgtggtccctgatgggagagcatgaacaggtgaagcccttggagaccagctcttccaaagtsaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccagaggccgccagggagagaagga

SEQ ID NO: 3421 - DNA, 336 bp, Homo sapiens
  CDS 122..334
  misc_feature 285: m=a or c
  misc_feature 319: m=a or c
  UNSURE 55: Xaa=Ala or Glu
atctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgmagcagagaaggcctttaccagaagcattaaccgmgacaagcacttggcagt

SEQ ID NO: 3422 - DNA, 358 bp, Homo sapiens
  CDS 185..358
gcggcgggcgccaggtctcgcggctgagaccagggaggaggcgtgggcacgggacgcctgaggggttcagctcagacgaggtcgtggggccaagagaggagtttggtgacagtcccaagtttgggctgcggagaatcgctgtttctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcggggaccagccccga

SEQ ID NO: 3423 - DNA, 238 bp, Homo sapiens
  CDS 84..236
catagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcttc

SEQ ID NO: 3424 - DNA, 335 bp, Homo sapiens
  CDS 2..334
aatgttaataagagctaatggaacccatcacaagatattaccaatgttccctctttacagagagcccacaaagccaggccttgagccaagtgtatgccaggcacctctctctgcattttcagctccatctcacagaggagtaactcaagttcacacagctaggcatgtcccagctttaccattcatggcaccaaaccctcaggctccccaatcttttcctgagacagctgagactccctcatgtgttccctccccggtgcggccctgtcatgctcctgctcaaacaccctccgtggctcccacgtactcatcaaacctagactgggaacggacca

SEQ ID NO: 3425 - DNA, 324 bp, Homo sapiens
  CDS 134..322
  misc_feature 324: n=a, g, c or t
ttttgtcctgaacttattgtttttatgatttgtccatgttgccctagatgcccttatacctatacatcactgtgaattgtgctctgtgtattttacccatctccacgtattttacccatctgctccctggctgatgggtttggagatggcgtctaacaccctgcctccacaaataatgctgctccagatatcttcctggatggtctcaccagatgatttctacccaggagcagaattgctggccacagggcatactttgagtactacaagactggtttcctcaatgactgacatcctccattctcttccacctactcccatccn

SEQ ID NO: 3426 - DNA, 303 bp, Homo sapiens
  CDS 109..303
agtggcaccgcaattccggctgctgcggggaagtttagttggcccagggacgccgtgtcaccgaaagacacttggattgcgacattcggacccagtgacaacgttttcatgtatcttaaatccttcaaggagcggattgcaagttgcttcttctcgaggcaacctctccacccagcgccaaggagtccctccaggccaccgatcagtgagcaaacaagtctccaaaatttcctttgggactcaagtttacccaccgcgaattctcttttcacttcctttctatggttcaaaccaacagcacac

SEQ ID NO: 3427 - DNA, 296 bp, Homo sapiens
  CDS 124..294
tggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgt

SEQ ID NO: 3428 - DNA, 344 bp, Homo sapiens
  CDS 87..344
  misc_feature 176: k=g or t
  misc_feature 251: k=g or t
  misc_feature 252: s=g or c
  misc_feature 279: r=a or g
  UNSURE 55: Xaa=Phe or Leu
  UNSURE 56: Xaa=Ala or Pro
  UNSURE 65: Xaa=Glu or Lys
gctcttttgttctcttttccttagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtktttgatggacatggaggaattcgagcctcaaaatttgctgcacagaatttgcatcaaaacttaatcagaaaattksctaaaggggatgtaatcagtgtagagraaaccgtgaagagatgccttttggacactttcaagcatactgatgaagagtccttaaacaagctg

SEQ ID NO: 3429 - DNA, 341 bp, Homo sapiens
  CDS 45..341
  misc_feature 40: m=a or c
gcatcgagccttccgcatcgctgatccagtggttctgggmggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagcagcct

SEQ ID NO: 3430 - DNA, 200 bp, Homo sapiens
  CDS 8..199
ctgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctatcccctacta

SEQ ID NO: 3431 - DNA, 230 bp, Homo sapiens
  CDS 78..230
gttatgtactgtccattgtgtcagggctatgggctgattttatcaaaactcatcttgggactgaaaaattgtttggaatgccagaaataagaaagttgttctccagagctggaaacccatctttcgtttgtagtgtcactgttgtggctccaagctcagtgataggaaaggacggtggttacacaccagccttcagaacccaaggcccccagtattgttgtcagctgcct

SEQ ID NO: 3432 - DNA, 411 bp, Homo sapiens
  CDS 50..409
  misc_feature 274: r=a or g
  misc_feature 275: m=a or c
  misc_feature 276: s=g or c
  misc_feature 280: v=a or c or g
  misc_feature 288: m=a or c
  UNSURE 75: Xaa= *  or Trp
  UNSURE 76: Xaa=Pro or Arg or Thr
  UNSURE 80: Xaa=Ala or Asp
taagcctgtggttgatggaaattcacaaagtgaggcattatcactggaaatgagaaaggatccgagcggggctggcctctggcttcacagtggcggcccagtgcttccatatgtgagagaatcagtaagaagaaatccagcctcagcagccactccgagcacagccgtgggtttgttccctgctccaacagagtgttttgctcgggtgtcctgcagtggtgttgaagctctggggcggcgagactggctgggaggagggcccagggcccactgrmsggcvacagaggmcagtgccccaaaggagagcctcgggtgtcacgactgccacgccatcaaaaagtgccggaaatgggaagttttcaggatgacccaccaagtgcttttcccaagggtctgggctctgagttggaa

SEQ ID NO: 3433 - DNA, 242 bp, Homo sapiens
  CDS 84..242
  misc_feature 50: s=g or c
  misc_feature 51: s=g or c
  misc_feature 83: r=a or g
  misc_feature 89: s=g or c
  misc_feature 139: r=a or g
  UNSURE 19: Xaa=Glu or Gly
ctcccaacgacgcagcccggttctgcagccggtgaagaaacgcggctggsscaagggcaagaagcggaagaagattctgccgratgggscccaaggcaccggtcacgggctacgtgcgcttcctgaacgagcggcgcgrgcagatccgcacgcgccacccggatctgccctttcccgagatcaccaagatgctgggcgccgagtggagcaagctgcagccaacggaaaagcagcggtaccaa

SEQ ID NO: 3434 - DNA, 292 bp, Homo sapiens
  CDS 116..292
  misc_feature 74: b=c or g or t
  misc_feature 101: d=a or g or t
  misc_feature 140: r=a or g
  misc_feature 160: k=g or t
  misc_feature 161: r=a or g
  misc_feature 169: s=g or c
  misc_feature 170: r=a or g
  misc_feature 264: r=a or g
  misc_feature 265: r=a or g
  UNSURE 9: Xaa=Asp or Asn
  UNSURE 15: Xaa=Ile or Met
  UNSURE 16: Xaa=Asp or Asn
  UNSURE 18: Xaa=Phe or Leu
  UNSURE 19: Xaa=Asp or Asn
  UNSURE 50: Xaa=Lys or Arg
atcttctctttatcaaacctttattaatgtaattttttcttattagggaagtcaaggagaaagtggtcgaccabgtcctcctgggccatctggtccccgadgtcagcctggtgtcatgggcttccccggtcctaaaggaratgatgtgagttccttcatkratttcttsrataaatatttgactggaaggcttttattttccatatggagtaaagaaatggtcaaaactcagtctcctcttcaaagcatggaggagtatatgarratcaaattgcatgtaggaagggagctc

SEQ ID NO: 3435 - DNA, 338 bp, Homo sapiens
  CDS 58..336
  misc_feature 38: k=g or t
  misc_feature 64: r=a or g
  misc_feature 65: r=a or g
  misc_feature 87: w=a or t
  misc_feature 95: r=a or g
  misc_feature 96: d=a or g or t
  misc_feature 105: k=g or t
  misc_feature 114: r=a or g
  misc_feature 126: r=a or g
  misc_feature 299: b=c or g or t
  misc_feature 327: y=c or t
  UNSURE 3: Xaa=Glu or Gly or Lys or Arg
  UNSURE 10: Xaa= *  or Cys
  UNSURE 13: Xaa=Lys or Asn or Arg or Ser
  UNSURE 16: Xaa=Asp or Glu
  UNSURE 81: Xaa=Ile or Ser or Thr
caaatatcaatgatgtttatgaatctagtgtgaaagtkttaatcacatcacaaggctatgaacrratatgcaagtccattcaactgwcaattgardtatttggakttgagcagrttcgagtgtgtrcatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcabtggtaatgcatctgccatcacggtggcyccccaagtggt

SEQ ID NO: 3436 - DNA, 302 bp, Homo sapiens
  CDS 37..300
ctggttttggtatcaaaataatactgtcctcatagaatgagtttggcagtattccttccttctgttttttggaatagtttgagtaggatttgggtattagttctctttaaatgtttggtagaatttagcagtaaagccatggggtcctggactttttcgttactgggtgtattagtctgttttcacactgctgataaagacataccccagactgagactgggcaatttacaaaagaaagaggtttaattggacttaacagttccacatggctggggaaactcacaataatggtggaaggcaa

SEQ ID NO: 3437 - DNA, 403 bp, Homo sapiens
  CDS 223..402
  misc_feature 302: m=a or c
  UNSURE 27: Xaa=Pro or Gln
gcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcmgttgctgattaaagctgttcaaaacgaagatgttgacctggtccagcaattgctggaaggtggagccaatgttaatttccaggaagagaagggggctggga

SEQ ID NO: 3438 - DNA, 243 bp, Homo sapiens
  CDS 68..241
gcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctg

SEQ ID NO: 3439 - DNA, 223 bp, Homo sapiens
  CDS 8..223
  misc_feature 195: d=a or g or t
  UNSURE 63: Xaa= *  or Leu or Trp
ttttgagatggagtctcgctctgtcacccaggctggagtgcagtggtgcatctccgcttactgcaagctccgcctcccgggttcacgccattctcctgcctcagcctcccacgtagctgggactacaggcgcccgccaccatgcccggctaattttttgtactttttttagtatagacggggtttcaccatgttdgccaggatggtctcgatctcctgacctc

SEQ ID NO: 3440 - DNA, 270 bp, Homo sapiens
  CDS 76..270
aaaaaaattcctgtctcctcttcttgaaagcagctcactgctagctgagcaaggttcgaaggaaggacctcagaaatgttctgccagcgcaaagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagct

SEQ ID NO: 3441 - DNA, 267 bp, Homo sapiens
  CDS 29..265
aggctcccctttcggcctctcgttctttatgcgacttgaatctcccgacgaaaattttgcggtagttcaggaacatgccattcatcacatcgatggcccgctccgcagattcctgcttttggaagtgcacgaacccgtagcccttgggccccttttcgtcacaggccactttgcaggagaggatgttgccgaacgccgagaagatgttgtacagcgccttgttgtcgatggtcttgcccaggttcttgatgaagacgttgcccaccc

SEQ ID NO: 3442 - DNA, 235 bp, Homo sapiens
  CDS 72..233
agtcatattactgtatgtatttttctgcctttttcctacattctgtatttgtttccatttacatataagatatgcttatctttctttctttctttctttttgatatggagtctcgctctcttgcccaggctggactgcagtggcacaatctcggctcactgcaacctttgcctcctggattcaagcgattctcctgcctcagcctcccaagtagctgggactacaggcgcgcacc

SEQ ID NO: 3443 - DNA, 166 bp, Homo sapiens
  CDS 4..165
agaatgtatcttaaatgcttagtgcctgacacacagggaacgctctgtaaatggtccgattcttattcgagtgggagttctgtggattccgggaagccaagtaaggtgatcatggggggtggccggaaatacatgtaccccaagaataaaactgatgtggagtacg

SEQ ID NO: 3444 - DNA, 188 bp, Homo sapiens
  CDS 2..187
catgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagctc

SEQ ID NO: 3445 - DNA, 218 bp, Homo sapiens
  CDS 55..216
agtctcttcctggcctccccacagtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccgga

SEQ ID NO: 3446 - DNA, 373 bp, Homo sapiens
  CDS 86..373
  misc_feature 43: b=c or g or t
aaatgtatctgatcctgctttgaataaatgcaacttgaaagcbttggaattttaccagatcgaatctgggccaaatagaaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacacactgact

SEQ ID NO: 3447 - DNA, 323 bp, Homo sapiens
  CDS 147..323
  misc_feature 278: r=a or g
  misc_feature 279: w=a or t
  UNSURE 45: Xaa=Ser or Thr
taaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaarwcaatcctaagccaaaaggacaaagctggaggcatcacactacca

SEQ ID NO: 3448 - DNA, 230 bp, Homo sapiens
  CDS 51..230
tttggggcactttcccaatactaaaggactctccaaaagtccccattttgatgcctgtgcctattccagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctaccgccac

SEQ ID NO: 3449 - DNA, 270 bp, Homo sapiens
  CDS 95..268
  misc_feature 18: r=a or g
  misc_feature 99: r=a or g
  UNSURE 2: Xaa=Lys or Arg
atttgagtggctaaagaratctgaagtcttgtactacactgtagagaagaaggggaatataagttcccagcttaaacactataacccttggagcatgaratgtcaccagcaacagttacagagaatgaaggagaatgcaaagcatcggaaccagtacaaatttatcttactggaaaacctgacttcccgctacgaggtgccttgtgtccttgacctcaagatgggcacacgacaacatggtgatgatgcttcagaggagaaggcagccct

SEQ ID NO: 3450 - DNA, 214 bp, Homo sapiens
  CDS 33..212
aggaatgcagataccctgaagggaacacaacaatggtccaagggggtttcccagaaaaaatcagacaaagatatgcagatctgcctggagaactgcacattattgaacttgaaaaagataagaatggacttggactcagccttgctggtaataaagaccgatcacgcatgagcatatttgtggtgggaattaacccggaaggacctactgccgc

SEQ ID NO: 3451 - DNA, 188 bp, Homo sapiens
  CDS 35..187
cccaagttttaccattctctatttgtgccctacaatggctccaccctttgaaataacgcctggtctaaatgttactttttctagtgggccttccttgattatccatcccactgtgattccttttcctgcccatagcctctccgacaagccttgcattctcattcatatgaccttgtttgccaatgcct

SEQ ID NO: 3452 - DNA, 420 bp, Homo sapiens
  CDS 7..420
  misc_feature 54: k=g or t
  misc_feature 55: r=a or g
  misc_feature 56: k=g or t
  misc_feature 93: n=a, g, c or t
  misc_feature 94: h=a or c or t
  misc_feature 100: n=a, g, c or t
  misc_feature 101: w=a or t
  misc_feature 123: d=a or g or t
  misc_feature 131: r=a or g
  misc_feature 137: n=a, g, c or t
  misc_feature 138: n=a, g, c or t
  misc_feature 227: k=g or t
  UNSURE 16: Xaa=Lys or Asn
  UNSURE 17: Xaa=Gly or Ile or Ser or Val
  UNSURE 29: Xaa=Lys or Asn
  UNSURE 30: Xaa=Ile or Leu
  UNSURE 32: Xaa=Asp or Phe or His or Ile or Leu or Asn or Val or Tyr
  UNSURE 39: Xaa=Arg or Ser
  UNSURE 42: Xaa=Lys or Arg
  UNSURE 44: Xaa=Ile or Lys or Met or Asn or Arg or Ser or Thr
  UNSURE 74: Xaa=Ile or Ser
taagtgatgaagctgaaattatacctatgtatattaggtccctggggctgcaakrkcaaagtaccactaattgggtttcttaaaagaataaanhtatatnwtctcacagttctgaaacctagdagtctgaratcaanntcagcagggttggttccttctgaggactctaaaaaagaatctgtttcatgcctctctcctaggttctggtggtggctgggaagcctgaktgttacttggcttatacatgcatcactccagtctctgtctcctttttctcatgccattttctcatgtgtctctgtgttttcctttgcttataaggataccagtcatattgaattagggcctgctctaataacctcatctcaattacctctgcaaggaaccaatttccaaataatgtcacactcacatgtagca

SEQ ID NO: 3453 - DNA, 341 bp, Homo sapiens
  CDS 121..339
  misc_feature 80: s=g or c
  misc_feature 87: s=g or c
  misc_feature 88: r=a or g
  misc_feature 103: r=a or g
  misc_feature 118: k=g or t
  misc_feature 125: n=a, g, c or t
  misc_feature 199: m=a or c
  misc_feature 261: v=a or c or g
  UNSURE 2: Xaa=Lys or Met or Arg or Thr
  UNSURE 27: Xaa=Pro or Thr
  UNSURE 47: Xaa=Asp or Glu
agcggaccaagatggcggcgccctgtgagggacaagcgtttgccgtaggggttgaaaagaattggggtgcagtagttcgstccccasragggaccccccagaraatccggcagctgakagatganggggattgccccggaagagggaggcgtggacgcgaaggacacgtctgccacatcccagtcagttaatggatcamcccaagcggaacaaccttcattggaatctacaagcaaagaagccttctttagcagagtggavacattttcttctttgaaatgggcaggtaagccctttgagctgtctccactcgtctgtgcaaaatatggctgggtcacagt

SEQ ID NO: 3454 - DNA, 389 bp, Homo sapiens
  CDS 136..387
  misc_feature 8: k=g or t
  misc_feature 46: k=g or t
aaaaacakcaggtaatgatcacaacagtctccttcactttcatagkaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattct

SEQ ID NO: 3455 - DNA, 415 bp, Homo sapiens
  CDS 256..414
  misc_feature 409: v=a or c or g
  UNSURE 52: Xaa=Ala or Pro or Thr
tatcctctgtgcaatgattccaactccagggatcagtgtctgaagtgaagctacagattgtctggtggataaataatccaagaaggaacgggggatgttatgactttttgagagaaggctaacatgtcatccttgacagataaactttaaaaaattataataatggaaatgaagaaagaaaacaacagaagatgagaatagcaaaagagctagacatttccgacagggtctcaagagcacgctcaagtcattcacatgtttccatcaaatacagacacagatcagggaagattaaaccctactaatttctcgtcggatgcctcacaacaaggtgccttccaagaactaatggccaaaatatccacccacaacacaaataagcttagaaaatctcttcttacaatcctgvcacaat

SEQ ID NO: 3456 - DNA, 391 bp, Homo sapiens
  CDS 237..389
ccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccg

SEQ ID NO: 3457 - DNA, 359 bp, Homo sapiens
  CDS 62..358
  misc_feature 17: r=a or g
  misc_feature 18: r=a or g
  misc_feature 130: w=a or t
  misc_feature 142: m=a or c
  misc_feature 144: w=a or t
  misc_feature 348: w=a or t
  UNSURE 23: Xaa=Asp or Glu
  UNSURE 27: Xaa=Lys or Asn
  UNSURE 28: Xaa=Leu or Gln
  UNSURE 96: Xaa= *  or Leu
aagacctaaaactatarraaccctagaagaaaacctaggcaataccattcaggacataggcatgggcaaagacttcattactaaaacaccaaaagcaatggtaacaaaaaccaaaattgacaaatgggawctaaaatggaamcwaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacattwatgcaaccaac

SEQ ID NO: 3458 - DNA, 377 bp, Homo sapiens
  CDS 130..375
tagaaactttatattgggaataaaggtttccccttgttataattaacaccaactagtgatgtctcctcctccctcccccctgtgcttcccctgtctgaacaactactcgatttaagaaggggacttaggatgaggaaggatgtggtttccttcccacttggcaagcactccgtgtcagaatggaagacttgtgtctgggcctggcacggttccgtcaggccctcttaccagcccagtcgtgtctgtgaccagagcacgtgggaggtgcacatccgtgtagaaaaacctcccactggctgccagctctggatttttgaaataattcctaatgaatgcagtcttgcccaggccaaacctcttacaggaatgatgaccac

SEQ ID NO: 3459 - DNA, 188 bp, Homo sapiens
  CDS 27..188
  misc_feature 10: k=g or t
  misc_feature 11: w=a or t
  misc_feature 137: m=a or c
  UNSURE 37: Xaa= *  or Cys
agccagaggkwcgagctagcccgacgatggcccaggggacattgatccgtgtgaccccagagcagcccacccatgccgtgtgtgtgctgggcaccttgactcagcttgacatctgcagctctgcccctgaggactgmacgtccttcaagcatcaacgcctccccaggggtggtcgtggatattgccca

SEQ ID NO: 3460 - DNA, 221 bp, Homo sapiens
  CDS 65..220
  misc_feature 99: n=a, g, c or t
  UNSURE 12: Xaa=Cys or Phe or Ser or Tyr
gcggttctaggggagcgtgcgggcgccggggtccggcggcgagaggccaccttctggccttgcgatgaatcctcggtttccccttctcagatggggttntcgtgagggtacaacgtcggcattagacattccaggtgacgcccgtacgcggtgggcggttcgggccggagctctggaacgctggccctggaggcgtcgacccctcgttactgatgcagggc

SEQ ID NO: 3461 - DNA, 300 bp, Homo sapiens
  CDS 126..299
  misc_feature 207: b=c or g or t
  misc_feature 208: k=g or t
  misc_feature 254: y=c or t
  misc_feature 255: k=g or t
  UNSURE 28: Xaa= *  or Gly or Leu or Arg or Val
  UNSURE 44: Xaa=Ala or Ser
atttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaabkaaggagaaagcttgagtctttaaggctagagcccagctgtgctgcykccatcttctcaggaatggcagtgcgtattttctggctgaaaagta

SEQ ID NO: 3462 - DNA, 412 bp, Homo sapiens
  CDS 91..411
  misc_feature 236: w=a or t
  misc_feature 393: s=g or c
  UNSURE 49: Xaa=Glu or Val
  UNSURE 101: Xaa= *  or Tyr
cccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgwggagcgcaaggctaagcctgctccttcaaaaacccaggccagacctgttggagtcaaaatccccacttgtaagatcactcttaaggaaaccttcctgacgtcaccagaggagctctatagagtgtttaccacccaaggagctggtgcagggctttasccatgctcctgcaacatta

SEQ ID NO: 3463 - DNA, 339 bp, Homo sapiens
  CDS 153..338
  misc_feature 36: r=a or g
  misc_feature 315: s=g or c
  UNSURE 55: Xaa=Leu or Val
cagttctcttttgctgcaaccacccatctcaaactractatcaatcatttatttagctcataattcttcagatcagcctggaagtcttttggtcttgggtgactttgctggttgatgatgggctgggctgggtcccaggggcctctattcacatgacctctcatcccccagcagctatgctgcactttatcacagggtggcagggtttcaaagagcagcgatgggggcaagccccaatgcacgagcatctttcaagcctttgcttgtatcacctttgctcacttcccatggaccaaagcaagtcacacagcggasttcaagtcaatgagaaggcacgca

SEQ ID NO: 3464 - DNA, 302 bp, Homo sapiens
  CDS 52..300
  misc_feature 101: m=a or c
  UNSURE 17: Xaa=Ala or Asp
aaaagctgtgtgaggaggaggaggaagtgagaggaggaggccccgggcaccatggcccaggccctgggggaggacctggtgcagcctcccgagctgcaggmtgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaa

SEQ ID NO: 3465 - DNA, 352 bp, Homo sapiens
  CDS 8..352
  misc_feature 7: m=a or c
  misc_feature 286: m=a or c
  misc_feature 329: m=a or c
  UNSURE 108: Xaa=His or Asn
atctggmatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggmattacagtgacagttcacatgccaaaagttgtgctgaacctgmacctgacacccacacaaagcagc

SEQ ID NO: 3466 - DNA, 407 bp, Homo sapiens
  CDS 193..405
cattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacacggagcgt

SEQ ID NO: 3467 - DNA, 321 bp, Homo sapiens
  CDS 61..321
  misc_feature 166: w=a or t
  misc_feature 237: s=g or c
  misc_feature 239: n=a, g, c or t
  misc_feature 266: r=a or g
  misc_feature 267: n=a, g, c or t
  UNSURE 36: Xaa=Ser or Thr
  UNSURE 59: Xaa=Asp or Glu
  UNSURE 60: Xaa=Ala or Asp or Gly or Val
  UNSURE 69: Xaa=His or Gln or Arg
agtatcactatattccagctgtggaaactgtatcactgtcataatgcacttgaacttcctatgaaaggatttcttagcggacatgctgagaatttacttcgaggtgtgtacgaaacatgtactacgatgacgatgagccttctgaagtgggttcggcagactcctwcacctagccgtccatccgattccgatgtatctctggaggaggaccgggaggcagtgcgcagagaagcggasgncaggcccaggcacagttggaaaaagcrnagacaaagcccgttgcatttgcggttcggacaaatgtcagctacagtgcggccc

SEQ ID NO: 3468 - DNA, 338 bp, Homo sapiens
  CDS 66..338
aagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggta

SEQ ID NO: 3469 - DNA, 314 bp, Homo sapiens
  CDS 131..313
tttgaagaagataaataaggtgacatttttaagggtcaaagaaaatgtcaaaaactagaatgatgtctttacatagggtttaaaaactttccaaattaacagggaaaataattctttaccttgaaaataaatgtttgctagtgaaagcaaatacaatctttttactaaatgttttattaaattttttttacttgtagacacagggtcctactgtattacccaggctggtcttgaatgcctggcctcaagcaatcctcctacctcagtcttccaaagtgctgggactacagacatgagccatcacactgggtctc

SEQ ID NO: 3470 - DNA, 339 bp, Homo sapiens
  CDS 34..339
  misc_feature 88: r=a or g
  UNSURE 19: Xaa=Glu or Lys
aaaaactcttttctttatcctctttccagaaaaatgggccaattcacagctgcaatggttgggagaatttcctgtctgggagtctggraaactgccaagagtggaaagctgcagccagccagcgaggcctctgttgtcactggcccaaacaacaacaaaaacaaccgcaacaacaacaacaacaacaaaacatgccacgtgtgcactggcatatacaaacacgcccacagaaccaaaccaagcggacaaggcttcaaggagagcttctgggcggctcatccccgcggcgaggcatatcccttggcatggtgccactgcagcccagctcccagccccccc

SEQ ID NO: 3471 - DNA, 196 bp, Homo sapiens
  CDS 43..195
agacaggatctcactctgtcatccattctggagtgtggtggcatgtttatggcttacttcagcttcaacctccctgggctcaagcatttctcatacctcagatccccaagtagctgggactacaggcacacaccatcacacccggctaatttttgtatattttgtagagtcagagtttcaccattttccccaggct

SEQ ID NO: 3472 - DNA, 394 bp, Homo sapiens
  CDS 160..393
  misc_feature 305: h=a or c or t
  misc_feature 312: n=a, g, c or t
  misc_feature 313: w=a or t
  misc_feature 315: n=a, g, c or t
  misc_feature 345: m=a or c
  misc_feature 349: s=g or c
  misc_feature 353: s=g or c
  UNSURE 49: Xaa=Ala or Glu or Val
  UNSURE 51: Xaa=Lys or Asn
  UNSURE 52: Xaa= *  or Cys or Arg or Ser or Trp
  UNSURE 62: Xaa=His or Gln
  UNSURE 64: Xaa=Ala or Pro
  UNSURE 65: Xaa=Cys or Ser
gattaatgcctgtcagacagacaaggacgcagaggcacaggggccctgtcgtcacagctagctcattcccgcagctcccccagctccccggctggcccccgggtctgggtgctggtggaactgagccaagaccattgcccccgcctaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccagghggccaanwgncgcgggcattgcctgctctccatcacccamcggscctscctgtggaaatacacacacacttgctacagttcgatgggga

SEQ ID NO: 3473 - DNA, 300 bp, Homo sapiens
  CDS 128..298
  misc_feature 92: r=a or g
  misc_feature 116: k=g or t
  misc_feature 212: w=a or t
  UNSURE 29: Xaa= *  or Arg
aaccctgtctctactaaaaatacaaaaaaaattagctgggcgtggtggcgggcacctgtagtcccagctactcgggaggctgaggcaggagratggcttcaacccaggaggcggakcttgcagtgagatgagatcgcgccactgcactccagtctgggcgacagagcaagactctgtctcaaaaaaagaaatagacgtacactctgggacawgacagaaaaagtatcctcacacttgctgggtaatagtaactgtgctattcctatcaagaaaccctaaggtttctaggcttgttctgga

SEQ ID NO: 3474 - DNA, 212 bp, Homo sapiens
  CDS 12..212
ttctcaatcaaatgttgctattgaatgaaaacctcaaagcagaaattcaaaagaatgaagctcaaggcagctgtatcttgtttctgttttgctttgagagtcagaatatgcgatcaaaatctatcttccccttccttatccttcatttttttccccagcagataagaaaaaaaatagtggtgcttcttttaggacttaattctcagaaggca

SEQ ID NO: 3475 - DNA, 351 bp, Homo sapiens
  CDS 46..351
  misc_feature 283: m=a or c
  misc_feature 284: r=a or g
  UNSURE 80: Xaa=His or Asn or Arg or Ser
caattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctmrtatggagaaaacttgcagcaagctggactctatctcaggaaatcttcagaggatcaaggaagggctc

SEQ ID NO: 3476 - DNA, 260 bp, Homo sapiens
  CDS 64..258
  misc_feature 98: y=c or t
  misc_feature 99: w=a or t
  misc_feature 102: m=a or c
  misc_feature 112: k=g or t
  misc_feature 119: k=g or t
  UNSURE 12: Xaa=Leu or Pro
  UNSURE 13: Xaa=Lys or Asn
  UNSURE 17: Xaa=Phe or Val
  UNSURE 19: Xaa=Cys or Phe
ttatggaagatactctctatactttgctgcccctgtacctttgctcatagtattcttatcttgatgcctttcttcctcatgattcccatcattgtccywaamaatttttttkttaattktttttattatactttaagttctagggtacatgtgcacaacatgcaggtttgttacatatgtgtacatgtgccatgttggtgtgctgcacccattaacttgtcatttacattaggtatatctcctaatgctatcccatcccc

SEQ ID NO: 3477 - DNA, 184 bp, Homo sapiens
  CDS 18..182
tagctgggattgcaggcatgtgccaccacgcccggctaatttttgtatttttagtagagatgggatttctccatgttggtcagacttgtctcggactcccaacctctggtgatctgcccgcctcggcttcccaaagtgctgggattacgggcatgagccaccgtgcgtgtcctttttttttttt

SEQ ID NO: 3478 - DNA, 277 bp, Homo sapiens
  CDS 113..277
tttttgtttcttggcgccatttaggtgtaagaacggtaatgtcctgaatgacgatccttttcatttaccaaacggttctaatgctgccaacccccaatgaacataaaggagcatgaagtgcctcgtttgtatcaatacattatggagaataaatagaatacagttctttagagaaagatactttcagattcatgtgatccttagggcattaaatacgatgcactccattgtttttttgttattctgtttcaaagaaaatgactgtcttgacccagtt

SEQ ID NO: 3479 - DNA, 404 bp, Homo sapiens
  CDS 142..402
tcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccacccac

SEQ ID NO: 3480 - DNA, 285 bp, Homo sapiens
  CDS 116..283
  misc_feature 73: r=a or g
  misc_feature 74: n=a, g, c or t
  misc_feature 119: s=g or c
  misc_feature 120: y=c or t
  misc_feature 121: k=g or t
  misc_feature 124: m=a or c
  misc_feature 203: y=c or t
  UNSURE 2: Xaa=Ala or Leu or Pro or Val
  UNSURE 3: Xaa=Asp or Glu
  UNSURE 30: Xaa=His or Tyr
aagaagcctgtgtgagagcagctcggcgctccggcacagcagagagcgctgggagccggaggggagcgcagcrnggttttggccagtggtcgtgcagtccaaggggctggatggcatgsykgamcccaagctcagctcagcgtccggacccaataacagttttaccaagggagcagctttctatcctggccacactgaggtgyatagcgtaatgtccatgttgttctacactctgatcacagcttttctgatcggcatacaggcggaaccacactcagagagcga

SEQ ID NO: 3481 - DNA, 276 bp, Homo sapiens
  CDS 3..275
agatgacaccactgcactcctgcctgggcgacagagcgagacccggtctcaaaaataaaataaaaatatttttaaaaaatggaaatggtctaatgtttgcacgttacctgcaggtattttctagctttgctcatgaggtgtggatgcttgtgacgttccttgtgtgtgttttattcatttttttaagtttttcactttcgagacagggtttctgtatgttgcccaggctggtctcaggctcctggcctcaagtgatcctcccacctggcccccttt

SEQ ID NO: 3482 - DNA, 276 bp, Homo sapiens
  CDS 118..276
  misc_feature 87: s=g or c
aaccctggagaacctgccccggaaccaagagccgcagccagctcaagcctctcgagtggggcctttccagcccctgcaacagatccsgggatctgtagttgggcggaggggctcgttatgggaaaggggtgcgtgcgcgtttgtgctaaaacaagaaaggcaagaatctccgagaacaaaactctggtcctcgcctggccggggaccgcagaagacagtgggcggcagcgccaaggcgggtcaggggccggtccagccaagtttgctccggctgct

SEQ ID NO: 3483 - DNA, 296 bp, Homo sapiens
  CDS 143..295
  misc_feature 228: h=a or c or t
  UNSURE 29: Xaa=Leu or Pro or Gln
ccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttchacccctgccgaagatgactcccgtgactcaggttaagagtgaggttcaacagcctgtccatcccaagc

SEQ ID NO: 3484 - DNA, 241 bp, Homo sapiens
  CDS 48..239
  misc_feature 136: n=a, g, c or t
  misc_feature 137: n=a, g, c or t
  misc_feature 170: h=a or c or t
  misc_feature 225: v=a or c or g
  UNSURE 30: Xaa=Ile or Lys or Met or Asn or Arg or Ser or Thr
  UNSURE 60: Xaa=Ala or Pro or Thr
ccacctgaggtatacatacccccggttgaagagtgctgtgtgtccccatgaggttttctccagttcaacccctcctttcacctgtccataggttattgcagccgaagagaaatgaatgcatccagggctctgaaanngcctccatggtcatcactgaatctcctgcagchcttcagctccgatacctgcagacactgaccaccattgctgctgagaaaaactcavcaattgtcttccctct

SEQ ID NO: 3485 - DNA, 310 bp, Homo sapiens
  CDS 118..309
  misc_feature 72: w=a or t
  misc_feature 87: k=g or t
  misc_feature 92: m=a or c
  misc_feature 97: m=a or c
  misc_feature 99: k=g or t
  misc_feature 104: y=c or t
  misc_feature 126: r=a or g
  misc_feature 166: s=g or c
  misc_feature 167: n=a, g, c or t
  UNSURE 17: Xaa=Ala or Glu or Gly or Leu or Pro or Gln or Arg or Val
ttttttttttggtgcaaatatatcccatgcaatatttgggacctgcttactctaaaaaatgatttgttgttwatctgaaattcaagktaaamctggmakcctgycttttcacttgctatgtatgaragttccgtgtgggggttatcagtgtgcatttgtgagttcsnacgtgaaggactctctccaagtgtctgtaggtgccaggatggagatggacagagaagatcctcttgggctgctttagtggcacctagaggctgtggggttggacacttcagccccaggggcctgggcagcactgtccagcact

SEQ ID NO: 3486 - DNA, 365 bp, Homo sapiens
  CDS 92..364
  misc_feature 286: s=g or c
  misc_feature 291: k=g or t
  misc_feature 326: m=a or c
  misc_feature 335: k=g or t
  misc_feature 337: m=a or c
  misc_feature 338: h=a or c or t
  misc_feature 353: k=g or t
  UNSURE 67: Xaa=Cys or Phe
  UNSURE 79: Xaa=Lys or Gln
  UNSURE 82: Xaa= *  or Cys or Gly
  UNSURE 83: Xaa=Phe or Ile or Leu
  UNSURE 88: Xaa=Cys or Gly
aactatgatgtacttagaagatagggaggaatcaaagggaatttcaaacagattccaggcaaatggtaaaattactcatccataaaggtaaatgttaaggaaacaaagtgagatttttttaaaaagagacagggtctcactgaagtgcaatggctcaatcacagctcacaactttctaggctcaggtgatcctccctcctcggccatccaggtagctgggactacaggtgtgcgccactatgcctggctaattttttatttttttttttcaagagagggggtttcsccttkttgcccaggctggtctcgaactcttgggctcaagmagtccacckgmhttggcctcccaaagkgttgggagttac

SEQ ID NO: 3487 - DNA, 415 bp, Homo sapiens
  CDS 178..414
caaaatcaagaaaatccaacatagatggtcaaaatattcataggtgactgagagtatccaaatgggccaggtgactgagaatacgcaaacaggccagaataatatctgtgttaaatttgaccctctattttattaacatatctgtcatgacctttctctgtacctgctgtagtactcatgtatagactcagtcttatagcaggccctgggtcctatcctgtgctaagatggggagtttgggacatccctagttcattagttcaagtgacttaccatcagcccaacctcactacaaatttggatctgcctttgttcttcagttgtagtatctcggctacccattcttgtgtcaagcctccatctgtaattattggtatctcttctttcctgagctttccttatcaaactttggtat

SEQ ID NO: 3488 - DNA, 238 bp, Homo sapiens
  CDS 7..237
  misc_feature 92: s=g or c
  misc_feature 98: h=a or c or t
  misc_feature 190: k=g or t
  misc_feature 191: w=a or t
  misc_feature 222: h=a or c or t
  UNSURE 29: Xaa=Ala or Gly
  UNSURE 31: Xaa=Ala or Asp or Val
  UNSURE 62: Xaa=Asp or Phe or Val or Tyr
  UNSURE 72: Xaa= *  or Cys
acatgcatggtctcggggaagaagcttcctctggcctggcgcaggccgttccatctgcctcccaggtctgcgtccctaaccccttccccagstttgghtgttttaccccgaaacaggaaggaacaggggtcctgtagaacaggggtcctggggaaggtgtccagggcagggtcctgggaagggtgtccckwctgcttcctctccagctgtggctccatctghccagcttgcctgcctc

SEQ ID NO: 3489 - DNA, 282 bp, Homo sapiens
  CDS 6..281
  misc_feature 254: v=a or c or g
  misc_feature 255: k=g or t
  misc_feature 256: n=a, g, c or t
  UNSURE 84: Xaa= *  or Ala or Glu or Gly or Leu or Ser or Val
ttcagatgactctcccgaaaacttacaccatagctaatcaatttcctcttaataagctcactgaacttctccgacatgacatggcagccgctggcttcactgaagcacttacctttgccctgtgctcccaagaagatattgctgataaactaggtgtggatatctctgcaacaaaggcagtccacataagtaatcctaaaacagctgaatttcaggtggcacgcactacccttcttcctggcctcctgaagacvknagcagcaaatcgtaagatgccccctt

SEQ ID NO: 3490 - DNA, 320 bp, Homo sapiens
  CDS 113..319
tatttccactgttaatcatccaccttcactatactgttgttctgtctgctttgggcagggtgtaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccac

SEQ ID NO: 3491 - DNA, 377 bp, Homo sapiens
  CDS 179..376
  misc_feature 24: s=g or c
  misc_feature 363: b=c or g or t
  UNSURE 62: Xaa=Ile or Ser or Thr
aaatgagttagcgagttcagcgasagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgaccabcagcaggggcctgc

SEQ ID NO: 3492 - DNA, 429 bp, Homo sapiens
  CDS 117..428
  misc_feature 272: k=g or t
  UNSURE 52: Xaa=His or Gln
ttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccakacagttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaacatt

SEQ ID NO: 3493 - DNA, 372 bp, Homo sapiens
  CDS 5..370
taatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgtt

SEQ ID NO: 3494 - DNA, 304 bp, Homo sapiens
  CDS 56..304
  misc_feature 277: k=g or t
  misc_feature 283: k=g or t
  misc_feature 293: m=a or c
  misc_feature 295: r=a or g
  UNSURE 74: Xaa=Asp or Glu
  UNSURE 76: Xaa=His or Gln
  UNSURE 80: Xaa=Lys or Gln
acttttcctgcaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgakaggcakgacatgtatmartgcttggta

SEQ ID NO: 3495 - DNA, 264 bp, Homo sapiens
  CDS 67..264
  misc_feature 12: n=a, g, c or t
  misc_feature 35: n=a, g, c or t
  misc_feature 55: s=g or c
  misc_feature 188: w=a or t
  misc_feature 202: s=g or c
  misc_feature 217: y=c or t
  misc_feature 222: m=a or c
  misc_feature 228: s=g or c
  UNSURE 41: Xaa=Ile or Asn
  UNSURE 46: Xaa=Leu or Val
  UNSURE 51: Xaa=Pro or Ser
  UNSURE 52: Xaa=Asp or Glu
gacgcagtcggncgcggcggccctagcgacgcggnttactagggagcggcgagcsgagacggctacatggacgccactatcgccccgcaccgtatcccccccgagatgccccagtacggggaggagaaccacatcttcgagttgatgcaggtattaaccacctgggtgtctgccctgcacccacagawcatgctggagcaastcctgatccaccagyccgamgatccsatccccttcatgatccagcacttgcatagagactcc

SEQ ID NO: 3496 - DNA, 320 bp, Homo sapiens
  CDS 124..318
  misc_feature 2: m=a or c
  misc_feature 55: y=c or t
  misc_feature 74: m=a or c
  misc_feature 138: m=a or c
  misc_feature 258: r=a or g
  misc_feature 272: m=a or c
  misc_feature 316: k=g or t
  misc_feature 318: n=a, g, c or t
  misc_feature 319: n=a, g, c or t
  misc_feature 320: y=c or t
  UNSURE 5: Xaa=Asp or Glu
  UNSURE 50: Xaa=Ser or Tyr
  UNSURE 65: Xaa=Phe or Leu or Val
amaagctcccagcctccagaggctctcaatgaagagtcaccttcatggtcgtctycaggaacaggacggatgamgaaggggtggggttaagactcaggggcacctgagggtctgagcccccttatgagtacccaagamggactgtctatgcatgcacacccacaagcctatacaccatttatatacctacacgcacgcaagagacgcggagagataggcgatgcagactcgcgattcaatgatcgatatgctcataaragtgctcaattatmttttctgtattttgtatgctgtattttccaagacgtatattatktnny

SEQ ID NO: 3497 - DNA, 185 bp, Homo sapiens
  CDS 7..183
cacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactcc

SEQ ID NO: 3498 - DNA, 293 bp, Homo sapiens
  CDS 30..293
  misc_feature 48: r=a or g
  misc_feature 49: r=a or g
  misc_feature 50: k=g or t
  misc_feature 51: y=c or t
  UNSURE 7: Xaa=Asp or Glu or Gly or Lys or Asn or Arg or Ser
  UNSURE 8: Xaa=Pro or Ser
agtcaagttgccggtggaattggcccaggatgacagctggagaatggrrkycagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtgaacag

SEQ ID NO: 3499 - DNA, 286 bp, Homo sapiens
  CDS 85..285
cggcgccacggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttcca

SEQ ID NO: 3500 - DNA, 257 bp, Homo sapiens
  CDS 71..256
gcttcacggtgatcgagacagatcccttgatgttggaaggccacagcctggtgtggaggaggtcacccgaatgggacctagcctgctacaggatgcacgcctctggacctcggtgtccccagcacctgggaagtggccactagctgaacaggtgtcctgcccgggacgctcttccccagtgcccgcctgcgggactccagctccttgttccggctcctgctgcactagctcctggcgactgaggcttctcccgacac

SEQ ID NO: 3501 - DNA, 354 bp, Homo sapiens
  CDS 198..353
ttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagctg

SEQ ID NO: 3502 - DNA, 433 bp, Homo sapiens
  CDS 100..432
  misc_feature 86: m=a or c
attcacagcggcagacgagcgccaggaaagggttatttgatctgatccctcaagttccggaggcagcagtatcaagataaagaggmagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatcttt

SEQ ID NO: 3503 - DNA, 394 bp, Homo sapiens
  CDS 100..393
cttttccggcccgcagcgcgcctgggctcccgcgtgtttaaaagtgcgcttgtggctgctgctgtcttaactcctgtgcttggcggacagacaggcgagatggcggcggaggtgttgccgattgcgaggtggcagtattgtggggcgcccgacgggagccagagagctgtactggtccagttctccaacgggaagctacagagtccaggcaacatgcgctttaccttgtatgagaacaaagattccaccaaccccaggaagaggaatcaacggatcctggcagctgaaacagataggctctcctatgtgggaaacaattttgggactggagccctcaaatgcaacactttgtgcaggcactttgtgggaattttgaacaagacctctggcctta

SEQ ID NO: 3504 - DNA, 358 bp, Homo sapiens
  CDS 164..358
  misc_feature 282: w=a or t
  UNSURE 40: Xaa=Glu or Val
ttggtaataatcactaaaaatggaattttgttcattaagtgttaaaagcttgtcattgaaaatgaaaatacatatgggtaaaggtgataacacctattttccccctttgaaaggtgataggttgcagtgatgtaatatgcaaatgtgaggcagaaatggtgatatggtgtttcttcattacctcccagaacaactgtgtctgagcatgctgggcagctggagaggtcaccctggacagttaaccacgctctttatttccaaatccatgatcaaatggcaggwggcaaaatccatccgttgtcagtgcaggaaggacccactcaatggggttcctctctgcatttgggcgtcttcggta

SEQ ID NO: 3505 - DNA, 299 bp, Homo sapiens
  CDS 55..297
gaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccgc

SEQ ID NO: 3506 - DNA, 361 bp, Homo sapiens
  CDS 122..361
ccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatac

SEQ ID NO: 3507 - DNA, 309 bp, Homo sapiens
  CDS 118..309
  misc_feature 27: n=a, g, c or t
agacacacaccagcccaaccagaagcnagtcccagcccccagccctcccctggcctaccttttggggcccttctctgaaccaggctcccctgtcctgcaactctgtcattcacagggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggcctca

SEQ ID NO: 3508 - DNA, 231 bp, Homo sapiens
  CDS 75..230
tattttgccttagcagcctgggcttcggaactgggcttgccctgtagcaggtcacttgcacctttctgccacagatgacggaaacatttaaagttatggattgtgtctctgcatcctcttcccttcacaccagccaatgtgtttttcatttctcttggctggctcaatttcccacatgttctcccaagctcttcctctccactccccagggcttcccaccacaaaccgcac

SEQ ID NO: 3509 - DNA, 311 bp, Homo sapiens
  CDS 115..309
  misc_feature 90: y=c or t
  misc_feature 95: s=g or c
  misc_feature 98: k=g or t
aacttcgggagttgagccacgagctgttgtgcatccagaggtggaattggggcccggcattccctcctcgtcccgggctggcccttgccycccascckgcaactcctggttgagatgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatcc

SEQ ID NO: 3510 - DNA, 385 bp, Homo sapiens
  CDS 180..383
caatacctgttacttatatacttttctttgtctaaaaaagaaataagatctgtctagatgactgattaacttagggagattctgattaacagaatttctagaaatggctttcagcaggcaaagagaaaattatattttgtaccaatttatataaagttcatctagctcagcttttggagatgtccctggggctagagatgaaatatcgttttcctgtccacagacagcggtctgcagttcaccccatgaactcatacaggtcagaattaaaccccgagctttgtttatggagggtgagatatatttccaagtatttctttctcttttcacattttccacatcattaccatcatcattgtcgtcatcatcattgtcatcatccaat

SEQ ID NO: 3511 - DNA, 174 bp, Homo sapiens
  CDS 5..172
tttaatgccttataaagaggcttcacactgcgtctgctcctttttggcctttaaccttcctccacgtaaggacacagtgaacaaggtgccatcttggaaacaaacagcagccttcaccagacaccagaccttctggcaccttgaccttgcgctttccagcctccagaaccgtgt

SEQ ID NO: 3512 - DNA, 368 bp, Homo sapiens
  CDS 112..366
  misc_feature 147: w=a or t
  misc_feature 148: m=a or c
  UNSURE 12: Xaa=His or Gln
  UNSURE 13: Xaa=Ile or Leu
gatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcawmttcctgctcctggtgctgggctccctgctgctctacctcgctgtgtcactcatggaccctggctgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacga

SEQ ID NO: 3513 - DNA, 388 bp, Homo sapiens
  CDS 121..387
  misc_feature 183: b=c or g or t
  misc_feature 268: v=a or c or g
  UNSURE 50: Xaa=Glu or Lys or Gln
cccctaaccctgaggctgccgcgcggcggtcactgcgccggggtagtgggccccagtgttgcgctctctggccgttccttacactttgcttcaggctccagtgcaggggcgtagtgggatatggccaactcgggctgcaaggacgtcacgggtccagatgaggagagttttctgtactttgcbtacggcagcaacctgctgacagagaggatccacctccgaaacccctcggcggcgttcttctgtgtggcccgcctgcaggattttvagcttgactttggcaattcccaaggcaaaacaagtcaaacttggcatggagggatagccaccatttttcaaagtcctggcgatgaagtgtggggagtagtatggaaaatgaacaaaagca

SEQ ID NO: 3514 - DNA, 295 bp, Homo sapiens
  CDS 16..294
  misc_feature 87: m=a or c
gtgacggactgttctatgactgcaaagatggaaacgaccttctatgacgatgccctcaacgcctcgttcctcccgtccgagagcggmccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgaccc

SEQ ID NO: 3515 - DNA, 327 bp, Homo sapiens
  CDS 47..325
  misc_feature 307: m=a or c
  misc_feature 309: m=a or c
  UNSURE 87: Xaa=His or Gln
  UNSURE 88: Xaa=Ala or Asp
agggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccamgmtccagtttgggcccccat

SEQ ID NO: 3516 - DNA, 398 bp, Homo sapiens
  CDS 166..396
  misc_feature 310: r=a or g
  UNSURE 49: Xaa=Gly or Arg
acgactctagtttccatccagctcacaactgtcatcaagatcccagtctctggaggaaagggggcagggcggctttccaccctcaactcctcacttaaggggcgtctgagaagaacctaacgaaaagcggggggcagaaagcactgggacaatgagcaccagtccatgtgccgacccgggctggtcacctactcccaggtgaaacccacgctgggcgcaccggggcgagccacagagctgcggccccaaaagagcagcaggcgcgcccccctcgcgttgacatttccctggtgtgaagtgccggagattrggatgcaagagcgggattacggtcccgaagctcagctgcacttggaagcactcggagtccccaaaccctgggcgacttccccatcggc

SEQ ID NO: 3517 - DNA, 224 bp, Homo sapiens
  CDS 10..222
gtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggc

SEQ ID NO: 3518 - DNA, 360 bp, Homo sapiens
  CDS 13..360
  misc_feature 116: r=a or g
  misc_feature 129: k=g or t
  misc_feature 284: w=a or t
  misc_feature 310: n=a, g, c or t
  misc_feature 311: v=a or c or g
  UNSURE 35: Xaa=Lys or Arg
  UNSURE 91: Xaa=Ile or Lys
  UNSURE 100: Xaa=Ala or Cys or Asp or Gly or His or Asn or Pro or Arg or Ser or Thr or Tyr
aaatctcctaccatggaggaagaaggcggcggccgcagctgtgggaccactagggagctgcagaagctgaagcagcaggcgatggagtactaccgggagaacgacgttccgcgcargctggaaagagckgctcaactccaccttctacctccagcctgccgacgtctacgggcacctgggaggaaggatactattacagagaaacctattgcgcctgcagagcctgttgagcctgtactcagtggcagtatggccataggggccgtgtcactagctgttgccawagcctgtgccatgctgcttaataaanvtctgtacttaaatatcgctctcctgaagcacaatcaggaacagccaaca

SEQ ID NO: 3519 - DNA, 249 bp, Homo sapiens
  CDS 23..247
aagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagaagaggaaccaagggcaacatcttttcttcccaggcgttcttctctgggtgctttattctcttctttttctttatttcgcccccacccccatcccctgcctttttttt

SEQ ID NO: 3520 - DNA, 328 bp, Homo sapiens
  CDS 32..328
  misc_feature 100: y=c or t
  misc_feature 240: w=a or t
  misc_feature 241: k=g or t
  UNSURE 70: Xaa=Ile or Lys or Met or Asn
cattctagcgggaaatattattcacagtttaatgaagtctgatctagtggaatatttcactttggaaatgcttcacttgggaaacaatcgtattgaagtycttgaagaaggatcgtttatgaacctaacgagattacaaaaactctatctaaatggtaaccacctgaccaaattaagtaaaggcatcgtccttggtctccataatcttgaatacttatatcttgaatacaatgccattawkgaaatactgccaggaacctttaatccaatgcctaaacttaaagtcctgtatttaaataacaacctcctccaagttttaccaccacta

SEQ ID NO: 3521 - DNA, 245 bp, Homo sapiens
  CDS 34..243
tcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggcctt

SEQ ID NO: 3522 - DNA, 307 bp, Homo sapiens
  CDS 72..305
  misc_feature 7: y=c or t
  misc_feature 20: d=a or g or t
  misc_feature 56: k=g or t
  misc_feature 78: k=g or t
  misc_feature 132: k=g or t
  misc_feature 210: w=a or t
  misc_feature 211: r=a or g
  misc_feature 212: d=a or g or t
  misc_feature 224: r=a or g
  misc_feature 225: w=a or t
  misc_feature 226: w=a or t
  misc_feature 277: s=g or c
  misc_feature 301: k=g or t
  UNSURE 3: Xaa=Leu or Val
  UNSURE 21: Xaa=Ala or Ser
  UNSURE 47: Xaa= *  or Cys or Lys or Asn or Arg or Ser or Trp or Tyr
  UNSURE 52: Xaa= *  or Lys or Leu or Met
  UNSURE 69: Xaa=Ala or Gly
  UNSURE 77: Xaa=Cys or Phe
gtgtggyggccgcagcgctdagggagccggtgccatctgtgggggctttgggccakgggtctccggacagcatgagcktgggcttcatcggcgctggccagctggcttttgccctggccaagggcttcacakcagcaggcgtcttggctgcccacaagataatggctagctccccagacatggacctggccacagtttctgctctcaggwrdatgggggtgaarwwgacaccccacaacaaggagacggtgcagcacagtgatgtgctcttcctggstgtgaagccacacatcatcccctkcatcct

SEQ ID NO: 3523 - DNA, 203 bp, Homo sapiens
  CDS 5..202
cgacatgcaccgcaaattcgtggtgcatctgttcgccgaggagtggggccagtacgtggacttgcccaagggcttcgcggtgagcgagcgctgcaaggtgcgcctcgtgccgctgcagatccagctcactaccctgggaaatcttacaccttcaagcactgtgtttttctgctgtgatatgcaggaaaggttcagaccagacc

SEQ ID NO: 3524 - DNA, 361 bp, Homo sapiens
  CDS 36..359
  misc_feature 359: h=a or c or t
acttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgttttggccctgaggccctggagcttcagtgcctcactcacaccggtggccctgggcagtgcccttgcctacagatcccacggtgtcctggatcccaggctcttggtgggttgtgccgtggctgtcctggctgtgcacgtggccggtaatttggtcaacacttactatgacttttchaa

SEQ ID NO: 3525 - DNA, 386 bp, Homo sapiens
  CDS 76..384
gtaattaggaggaaggtcggctgggaatacggatatagcctccgggtgaggagttgtgactggtgtttaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggcat

SEQ ID NO: 3526 - DNA, 451 bp, Homo sapiens
  CDS 38..451
actcccgcgcgtactcggccgcctgagcgatactaaaatgtctgatgatgctggtgacaccttagccactggagacaaagcagaagttactgagatgcctaatagtgattctttacctgaggatgcagaagtgcattgtgattcagctgcagtttcacatgagccaacaccagctgaccccagaggggaggggcatgaaaatgcagctgtgcagggtgcaggggctgccgccattgggccccctgtgcagcctcaggatgccaacgccctggagccccctctcaatggagacgtgactgaggatacacttgctgaatgtattgattccgtcagccttgaggcagaacccagatccgaaatacccctgcaagaacagaattatctggctgtggattcccctccaagtggaggaggatgggcaggctggggatcctggggcaaatctctgctc

SEQ ID NO: 3527 - DNA, 399 bp, Homo sapiens
  CDS 237..398
  misc_feature 289: w=a or t
  misc_feature 290: d=a or g or t
  misc_feature 365: n=a, g, c or t
  UNSURE 18: Xaa= *  or Phe or Leu or Tyr
aaaaattagatcaatacttagaccaatataatgagctgatgtttagagagcaaaacaggcctcctgcagcctctgcacccatgagcctagcttagggtcagtaacttgtggtttagcaaaaaacagacttaactttataatgttagcaaaaggattaagttttaaatatatcagaatcgagatgggaaagaaacctaacaaagtgctaataaaaaatagaattgggtaaaaatattatgtttcatgaaagaagccagacacaaacagctatatattgtatgattgcatwdataagaaatgttcagaatagacacatctatatagagaaaaggcagattagtggttgtaggaggctgggagagggngaatgggaagtgactactaacaggtacaggaaga

SEQ ID NO: 3528 - DNA, 308 bp, Homo sapiens
  CDS 113..307
  misc_feature 131: n=a, g, c or t
  misc_feature 141: m=a or c
  misc_feature 153: n=a, g, c or t
  misc_feature 294: v=a or c or g
  misc_feature 295: s=g or c
  UNSURE 7: Xaa=Gly or Arg or Trp
  UNSURE 10: Xaa=Lys or Thr
  UNSURE 14: Xaa= *  or Leu or Ser or Trp
  UNSURE 61: Xaa=His or Pro or Gln or Arg
tcctataatgctgagaatttttttgagtgataggatgtcttttattatttataacaaccccctttctgatcataataggtaacttagggtggggccctgagatggcatcaggatggggctggtcgccaganggaccaagamattaagagggtngggacttttgtctcacccagtgacctctgggaaagggacagaggcctggagattgagtttttgggttggtgaacacatcaagttgctgggagggtggcattcctggacagggcatggaagccccactgctctaccctcccvscgcccccgctccc

SEQ ID NO: 3529 - DNA, 199 bp, Homo sapiens
  CDS 35..199
  misc_feature 119: n=a, g, c or t
  misc_feature 129: w=a or t
  UNSURE 29: Xaa=Leu or Met or Val
  UNSURE 32: Xaa=Ile or Asn
acacgtgtttcgtgtttcggtgagtgtggcggagatggagagccgggatcccgcccagccgatgtcgcctggagaagcgacgcagagtggcgcccggcctgccgaccgctatggcctantgaagcacawtcgcgagttcttggacttcttctgggacattgcgaacctgagcaggagacgcgacttgcggccacggacg

SEQ ID NO: 3530 - DNA, 468 bp, Homo sapiens
  CDS 273..467
  misc_feature 149: v=a or c or g
  misc_feature 154: k=g or t
  misc_feature 156: k=g or t
  misc_feature 161: r=a or g
  misc_feature 412: k=g or t
  misc_feature 413: k=g or t
  UNSURE 47: Xaa=Gly or Val
aggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgcvaacckckggttraaggccagctacgctgttttctaaaacttactgttaatagagtcatatggaagattgcaaagcctcccacttgtgtacttgtccgagtgagatggtggggagaaacatcagatggaaccaaaagctgtgagaacaactacacgttacgctattcgttgtggtccaaaacagtttacctcttatctaacagatatggctgtgctggtgctggaagtaatcaccaaacttgatggtcttccaattggtagagkkcagatcaatggactagctcaactttctccaacccatcaaatcaatggattttttt

SEQ ID NO: 3531 - DNA, 227 bp, Homo sapiens
  CDS 9..227
aattcaacatggcagccatgcgctggcgatggtggcagcggctgttaccttggaggttgctgcaggcccgtggctttccacaaaattctgcacccagcctgggcctaagagcgaggacttattcccagggcgactgctcgtattcgcgcacggcgctgtatgatctgctcggcgtcccctccacagccacgcaggcccaaatcaaggcggcttactaccgtcagtgc

SEQ ID NO: 3532 - DNA, 414 bp, Homo sapiens
  CDS 228..413
  misc_feature 379: r=a or g
  misc_feature 398: r=a or g
  UNSURE 51: Xaa=Asp or Gly
agctgccgccgtccatcctgctcaagatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggrcaaactcactgatgaaggrctcaagcagctgggtt

SEQ ID NO: 3533 - DNA, 225 bp, Homo sapiens
  CDS 63..224
gggacgtgggaaaatgactacgcgtcactcgtgatgtcgcgcatccgataggcccttttcagatggcaaaaggcctgagggtgaatctgggcgagctggttgagtccatgcgtttgtgcttcctctcagtccactttcgcttacgatggggcgactcttgtccatcgtcacctcaccgggaaacttttcctgccgggccagttaatggtcccctgtaccaccccc

SEQ ID NO: 3534 - DNA, 473 bp, Homo sapiens
  CDS 142..471
  misc_feature 26: s=g or c
  misc_feature 125: k=g or t
  misc_feature 126: s=g or c
  misc_feature 132: y=c or t
  misc_feature 395: h=a or c or t
  misc_feature 396: n=a, g, c or t
  misc_feature 397: n=a, g, c or t
  misc_feature 398: s=g or c
  misc_feature 412: n=a, g, c or t
  misc_feature 413: n=a, g, c or t
  misc_feature 414: n=a, g, c or t
  misc_feature 415: b=c or g or t
  UNSURE 85: Xaa=His or Leu or Pro or Gln
  UNSURE 86: Xaa=Ala or Cys or Gly or Pro or Arg or Ser or Thr
  UNSURE 91: Xaa=any one of the twenty amino acids
  UNSURE 92: Xaa=Leu or Val
accgatgctggaagggtttctttggscctgagtgaagagagacccagagggaacactgaggtgcctgcccaaccactctgtcccggtttccttcagcaggaccagccatgctggtcgttcagatksctttcytcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcgataggccgcctggggaaccaggtgggcgagtacgccacactgtatgccctggccaagatgaacgggcggcccgccttcatcchnnsccagatgcacagcnnnbtggcccccatcttcagaatcaccctgccggtgctgcacagcgccacagccagcaggat

SEQ ID NO: 3535 - DNA, 385 bp, Homo sapiens
  CDS 74..385
  misc_feature 125: y=c or t
  misc_feature 129: k=g or t
  misc_feature 132: h=a or c or t
  misc_feature 135: s=g or c
  misc_feature 325: n=a, g, c or t
  misc_feature 326: k=g or t
  misc_feature 381: r=a or g
  UNSURE 19: Xaa=Gly or Val
  UNSURE 20: Xaa=His or Leu or Pro
  UNSURE 21: Xaa=Ser or Thr
  UNSURE 84: Xaa=Ile or Met
  UNSURE 85: Xaa=Asp or Tyr
  UNSURE 103: Xaa=Glu or Gly
aaatgatcatattgaacagttcctgggtacatgtgcaagacgtgcaggtttgttacataggtaaacgtgtgctatgatggtttgcttcacctatcaacccattgtctctggaatcggtggtttcytggkcchcastgacttcaagaatgaagccgcagaccctgccggaatacaacttacaagggaaatgaaggacctcttcaaggagaactacaaaacactgctcaaggaaataagagaggacacaagcaaatggaaaaatattccatgctcatggataggaagaatcattatcatgaaaatggccatactgcccaaagtaatnkatagattcaatgctatcccaatcaagctaccatttactttcttcacagaattggraaaa

SEQ ID NO: 3536 - DNA, 316 bp, Homo sapiens
  CDS 93..314
  misc_feature 123: y=c or t
  misc_feature 131: y=c or t
  misc_feature 186: y=c or t
  misc_feature 187: m=a or c
  UNSURE 11: Xaa=Arg or Trp
  UNSURE 32: Xaa=His or Pro or Ser or Tyr
tggaaggtttcatacgggaagtgacatgttaagatctggatcttaaagaacttggggttcccgaagaagctcggtgccatcaacaggaaaggatgagactttggattccagaagaacactgcygggggttyccccccgagtctgccacttgctgtaacctcagaggatccagaacggcagctggtymttgctggactgttcctgtccatgtgcctggtcatggtgctggggaacctgctcatcatccggccatgagccctgactcccacctccacacctccatgtacttcttcctctccaacctgtccttgcctct

SEQ ID NO: 3537 - DNA, 347 bp, Homo sapiens
  CDS 119..346
  misc_feature 38: r=a or g
  misc_feature 71: s=g or c
  misc_feature 77: r=a or g
  misc_feature 92: r=a or g
  misc_feature 114: r=a or g
  misc_feature 126: s=g or c
  misc_feature 127: y=c or t
  misc_feature 130: k=g or t
  misc_feature 131: r=a or g
  misc_feature 142: n=a, g, c or t
  misc_feature 143: k=g or t
  misc_feature 254: h=a or c or t
  misc_feature 255: n=a, g, c or t
  UNSURE 3: Xaa=Ala or Gly
  UNSURE 4: Xaa=Ile or Met
  UNSURE 5: Xaa=Asp or Asn
  UNSURE 9: Xaa=Phe or Val
  UNSURE 46: Xaa=Cys or Phe or His or Ile or Leu or Asn or Pro or Arg or Ser or Thr or Tyr
atgggccggaggagagccccggccggtgggtcgctggracgggcccttatgcgccatcagactcagcggascgaagrccatcgtcacactgrctcctggttgcacacaagtgarctcaatgatggsyatkrattggggtcgnkttaatcttcagtcagtgactgaacagagctcccttgatgacttccttgctactgcagaacttgcaggaacagagtttgtagctgaaaaacttaatattaagtttgtgccthntgaggctagaactggactactgtctttcgaggagagccagagaattaagaagctccatgaagaaaacaaacagttcttgtgtataccgagga

SEQ ID NO: 3538 - DNA, 332 bp, Homo sapiens
  CDS 161..331
  misc_feature 143: r=a or g
  misc_feature 279: d=a or g or t
  UNSURE 40: Xaa=Cys or Phe or Tyr
caggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggratctgattttaaaccgaatggattatctgcaggtgggagtaacatctcagaagactatgaagctaattcctgcctcaagacacagagctacacaaaaggtggttattggagatcatgatggggtagttatgtgctdtggcatgaagaaaggagaagcagcagcagtgttcaagactttaccccggccaa

SEQ ID NO: 3539 - DNA, 246 bp, Homo sapiens
  CDS 82..246
  misc_feature 101: r=a or g
  misc_feature 115: m=a or c
  misc_feature 149: k=g or t
  UNSURE 7: Xaa=Lys or Arg
  UNSURE 12: Xaa=Lys or Gln
  UNSURE 23: Xaa=Cys or Phe
agtgtgtgaagtaaagggattaaaggctagtctcaggctggggatggctcctgtctatttcttctctctcagagactgcagatggcttttccctgccgcargtccctgactgccmaagactctggcctgcctcctggtgggcgtgagtktcttagcactgcagcagtggttcctccaggcgccaaggtccccgcgggaggagaggtccccgcaggaggagacgccagagggtcccaccgacgacta

SEQ ID NO: 3540 - DNA, 245 bp, Homo sapiens
  CDS 39..245
  misc_feature 134: s=g or c
  misc_feature 211: n=a, g, c or t
  misc_feature 225: w=a or t
  misc_feature 226: m=a or c
  UNSURE 32: Xaa=His or Gln
  UNSURE 58: Xaa=Ala or Glu or Gly or Val
  UNSURE 63: Xaa=Asn or Ser or Thr or Tyr
gttttcttgtagttgcgggtccctcgcgaaagctcatcatgccccactgggggaaggtccacgcttcccccatctgcaggggtcttttggcaccagccgcaagacataagaccagtatccttggaatagcgcascagggaaagtccttgagccaggaggtctggaaggagcattggagcttctgcattagagacttgggccgcgcgagggnaagtgctggacagwmtctccttcgccagcccctc

SEQ ID NO: 3541 - DNA, 318 bp, Homo sapiens
  CDS 151..318
tttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgt

SEQ ID NO: 3542 - DNA, 213 bp, Homo sapiens
  CDS 8..211
  misc_feature 198: y=c or t
  UNSURE 64: Xaa=Leu or Pro
tgatacaatgatatatgtgacagataaaggacaaaaaaagcattttcagcaagtattccaaatgctgaagatcatgggatatgactgggcagaaaggtgccagcacgtgccctttggagtagtacagggaatgaagactcgaagaggagatgtcactttcctggaagatgttttaaatgagattcaattaaggatgcyacagaacatggcacc

SEQ ID NO: 3543 - DNA, 384 bp, Homo sapiens
  CDS 84..383
  misc_feature 10: m=a or c
  misc_feature 11: y=c or t
  misc_feature 15: m=a or c
  misc_feature 16: n=a, g, c or t
  misc_feature 325: r=a or g
  misc_feature 367: m=a or c
  UNSURE 81: Xaa= *  or Trp
  UNSURE 95: Xaa=Asn or Thr
aaagcggagmyaggmngggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttrgttcaaagaaagtgatccttccaagctgcagttcaatactamcaactgtcgtagtgata

SEQ ID NO: 3544 - DNA, 359 bp, Homo sapiens
  CDS 140..358
  misc_feature 19: k=g or t
  misc_feature 68: k=g or t
  misc_feature 215: m=a or c
  misc_feature 216: n=a, g, c or t
  misc_feature 269: k=g or t
  misc_feature 279: k=g or t
  misc_feature 302: r=a or g
  misc_feature 304: m=a or c
  misc_feature 305: s=g or c
  UNSURE 26: Xaa=His or Ile or Leu or Asn or Pro or Arg or Ser or Thr
  UNSURE 44: Xaa=Asp or Tyr
  UNSURE 47: Xaa=Leu or Arg
  UNSURE 55: Xaa=Gly or Arg or Ser
  UNSURE 56: Xaa=Glu or Gln
gttttctgttacctctgckaatagtaaagagcatggtgcagatattcaaaataaaatgatttataackacccagaaggtacaagtgctatcaggacaagttcctcatagcacagtcatgtcatttggaacacaagctgtatgttgatgtctcatcttgaggaaccaaaagtaacagaagatgaagaaccacccacagaacaagataagaggaaamncatgctggccctgaaggaccctgttcatacagtgtcactgcagcagttcatckacgagaagckcaaggcacagcaggagatgctargmsaacaaggtttccagtccctcatggaaacagtggatacggagattgtcacccagc

SEQ ID NO: 3545 - DNA, 340 bp, Homo sapiens
  CDS 14..340
  misc_feature 193: k=g or t
  misc_feature 282: r=a or g
  misc_feature 307: s=g or c
  misc_feature 313: s=g or c
  UNSURE 60: Xaa=Cys or Trp
  UNSURE 90: Xaa= *  or Trp
aaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgkcgctgcagtggaactattggaaaggccttcactgcacaggtatgcttgcatcctaaagtggagtctgtcgcccaggctggaatgcattrgcacaatctggctcactgcaacctscacctsccaggttcaggtgattcttttgcctca

SEQ ID NO: 3546 - DNA, 301 bp, Homo sapiens
  CDS 54..299
  misc_feature 272: k=g or t
  misc_feature 273: n=a, g, c or t
  UNSURE 73: Xaa=Lys or Asn
  UNSURE 74: Xaa=Ala or Pro or Ser or Thr
tttccagttcatcccagcacggacctagctatgatgtgtataacccattctatatgtatcagcacatttcacctgatttgagtcgacgctttcctccccgttcagaagtgacgagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaaknctcaggggagtaacagaagcctggatat

SEQ ID NO: 3547 - DNA, 438 bp, Homo sapiens
  CDS 53..436
  misc_feature 376: s=g or c
  misc_feature 397: s=g or c
  UNSURE 108: Xaa=His or Gln
  UNSURE 115: Xaa=His or Gln
tatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatcacaccctgccttggctgctacagctttttcactccastgccctaggggagttcagcasctaatgatctctatctctgaacatctcttcatccatgctcc

SEQ ID NO: 3548 - DNA, 398 bp, Homo sapiens
  CDS 125..397
aggaggagggagaggtttgcgagagggagcgaggccgcgttaccgccggcggtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggt

SEQ ID NO: 3549 - DNA, 314 bp, Homo sapiens
  CDS 100..312
tttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttcctt

SEQ ID NO: 3550 - DNA, 278 bp, Homo sapiens
  CDS 70..276
tagcatattatgaattaaatcagagggttggagaaaccttccatgcatcacagccctcactcactgtagatggctttacagacccatcaaattcagagagggttctgcttaggttcactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcg

SEQ ID NO: 3551 - DNA, 220 bp, Homo sapiens
  CDS 45..218
  misc_feature 95: m=a or c
  UNSURE 17: Xaa=Lys or Asn
tttcttctctgtgtttctgttattatcaggcaggctgtctccacatgagagctcccagaaactctagcctactctcatattctccagctagcaamcctcagcaatacaaaagccagtttttcccaaagtcccggcaaaaatcccaaaccctgattctaatcagggttgtatcctcagtcctgaaaaagatccttgaggcaaaggaatatgcccatcggtg

SEQ ID NO: 3552 - DNA, 243 bp, Homo sapiens
  CDS 47..241
  misc_feature 107: s=g or c
  UNSURE 21: Xaa=Glu or Gln
ctcggtggcggcggaggcggcggaggccagggaggaagatgtcgtaatgagcgatccacagaccagcatggctgccactgctgctgtgagtcccagtgactacctgsagcctgccgcctccaccacccaggactcccagccatctcccttagccctgcttgctgcaacatgtagcaaaattggccctccagcagttgaagctgctgtgacacctcctgctcccccacagcccacaccgcggaa

SEQ ID NO: 3553 - DNA, 242 bp, Homo sapiens
  CDS 83..241
  misc_feature 231: r=a or g
  UNSURE 50: Xaa=Asp or Gly
aaaagctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgrccgtgacggca

SEQ ID NO: 3554 - DNA, 384 bp, Homo sapiens
  CDS 121..384
  misc_feature 329: n=a, g, c or t
  misc_feature 330: n=a, g, c or t
  UNSURE 70: Xaa=Ala or Asp or Glu or Gly or Val
ctttcagatattaagggactgattaaatacttgggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggagtagctatccagatcacaaggaaggggaggaccccaataaggctgaggagttgccctcagaaaagaacttggaatatgatgatgaaaccatggaattgattctgccttctggtgccagagtgggtcatgnntccttgatgagatactacaaacagcgatttggcttgtcaagagctgtggcagtt

SEQ ID NO: 3555 - DNA, 286 bp, Homo sapiens
  CDS 59..286
  misc_feature 146: s=g or c
  misc_feature 147: s=g or c
  UNSURE 30: Xaa=Ala or Gly or Pro or Arg
tctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagssacagacagcaccagctcaagttcctcaaggctttaatgtttttggaatgtccagttcctctggtgcttcaaattcagcaccacatcttggatttcacttaggcagcaaaggaacatctagcctttctcaacaaactccc

SEQ ID NO: 3556 - DNA, 260 bp, Homo sapiens
  CDS 50..259
atagaagacagtagtatcgcaacttgaggttgtgactaaatttagggacatggcagctttgggagcaggtgagatggaatatagatttatgctaaaacaaggagaaaggagagaggagcaatcagcttatgatgaaaaggcatcaaccatacaacagaagttttattggccaaactggaagcaggaatcaaggggagatcaagagggattagacaatgtggtgggctggaaagctgaaaatacaaatcaactgaagagga

SEQ ID NO: 3557 - DNA, 309 bp, Homo sapiens
  CDS 72..308
  misc_feature 82: k=g or t
  misc_feature 230: v=a or c or g
  UNSURE 4: Xaa=Leu or Trp
tgctgagatgtgaaaactaaccattccctcctgcctacctttttggccactgggcggcagagaatggcgctatgtgcagttkggcccctggcaccatgggcctttggcctgcctgctgcagagtagccctgcctgggcagtctccaggcactgagcaggccatctgtggccaggctgagagaatgactggctcgcttaccagcgtgcatgggacaaggagctttggagcvtcaaggggttgttgctggcctgggctagagggaaaggtgaccatccgtctgtcctcctgtctttctattagcgcctcct

SEQ ID NO: 3558 - DNA, 434 bp, Homo sapiens
  CDS 127..432
  misc_feature 43: r=a or g
  misc_feature 252: y=c or t
gattgcatttttcctgttttaacaacggctgtgctagacgaartggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatattycataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggccgaacaccaatggatctcagttcttcatc

SEQ ID NO: 3559 - DNA, 243 bp, Homo sapiens
  CDS 24..242
taaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgcta

SEQ ID NO: 3560 - DNA, 211 bp, Homo sapiens
  CDS 22..210
taagcaggtaagtatcaaaaaatgatggacttcctacagactattttttattattattatactttaagttctagggtacatgtgcagaacatgcaggtttgttacataggtatacacgtgccatggtggtttgctgcacccatcaacccgtcatctacattaggtattactcctaattttcccctactccccaaccccctgacaggcccta

SEQ ID NO: 3561 - DNA, 333 bp, Homo sapiens
  CDS 55..333
cacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggag

SEQ ID NO: 3562 - DNA, 341 bp, Homo sapiens
  CDS 32..340
  misc_feature 71: k=g or t
  misc_feature 72: w=a or t
  UNSURE 14: Xaa= *  or Glu or Leu or Val
ggcagggggggcttctgcgctgagccgggcgatggacgacagcggcgagctgggtggtctggagaccatgkwgaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggactgtggacccttcagtgcaacggtcattcacccaggtcacattaccttccttctctccctcagc

SEQ ID NO: 3563 - DNA, 358 bp, Homo sapiens
  CDS 99..356
  misc_feature 141: r=a or g
  misc_feature 196: m=a or c
  misc_feature 316: n=a, g, c or t
  misc_feature 317: b=c or g or t
  misc_feature 318: b=c or g or t
  UNSURE 15: Xaa=Ala or Thr
  UNSURE 33: Xaa=Lys or Thr
  UNSURE 73: Xaa=Ala or Asp or Glu or Gly or Val
  UNSURE 74: Xaa=Ala or Pro or Ser
tgaacattgagaaagaactaccaaagccaagacacgttttcagaaggaagacagcctcctccaggagcatcttacccgacctcttgtcaccgtaccaaatggcgatccgagcaaaaagactggaagagagccgagcggcgrcgctccgagagctccaggagaagcaggctctgatggagcagcagagacgagagamaagggcactgcaggagtggagagagcgagcccagaggatgaggaagaggaaggaagagctcagcaaactcctgcctccgcggaggagcatggtggcatcaaagattccctctgccacagnbbcgatagataacaggaaagtaccactgaatccgcctggaaa

SEQ ID NO: 3564 - DNA, 359 bp, Homo sapiens
  CDS 91..357
  misc_feature 2: w=a or t
  misc_feature 290: m=a or c
  misc_feature 303: h=a or c or t
  misc_feature 341: r=a or g
  UNSURE 67: Xaa=Ala or Asp
  UNSURE 71: Xaa=Asp or Glu
  UNSURE 84: Xaa=Asn or Ser
awagttcatcaaagaatataaatggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctgmttattcaagagahatgaaactgtatatccacaaaagagacttgtacacaarcattcacagcagctatta

SEQ ID NO: 3565 - DNA, 341 bp, Homo sapiens
  CDS 22..339
caggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaa

SEQ ID NO: 3566 - DNA, 342 bp, Homo sapiens
  CDS 157..342
  misc_feature 297: h=a or c or t
  misc_feature 298: h=a or c or t
  misc_feature 299: y=c or t
  misc_feature 313: r=a or g
  UNSURE 48: Xaa=Leu or Met or Pro or Ser or Thr
  UNSURE 53: Xaa=Ala or Thr
cagaatctttaggtgggcctgttggtgaggtcacttttccctaatggtatattccagttcctgtagatcctattccagttcccaggacatattccaacctcgacctccagccaactttgaacccctgaagttgtgtgctgatgtgtttctaacaacatggtctcacccaaagatcttcctcttgtgcttttgcaggacattaaagttcccagctccatgactggatcacatgctggaaaccctcatatagaaaggaatgatctccccagacatggttctcctcaattttttacagghhygacttgtgcttctrcaaacccatctcagtgtctggcagcattt

SEQ ID NO: 3567 - DNA, 182 bp, Homo sapiens
  CDS 22..180
gcaggaaatgcagccgggaggatgggcaggttgtgggatgctccgccgttccgcgaccacccgcctccccggcccagcagaaccgggtccaggctgggggaggtgctagcggtgtatgcacctaagtccacctgggcctggaggaggacaggtgtgcaaaagaaaatatctcgggacccccc

SEQ ID NO: 3568 - DNA, 306 bp, Homo sapiens
  CDS 95..304
  misc_feature 32: y=c or t
  misc_feature 41: y=c or t
  misc_feature 48: m=a or c
  misc_feature 77: m=a or c
  misc_feature 78: s=g or c
  misc_feature 79: m=a or c
  misc_feature 121: r=a or g
  misc_feature 136: r=a or g
  misc_feature 142: m=a or c
  misc_feature 143: b=c or g or t
  misc_feature 175: m=a or c
  UNSURE 17: Xaa= *  or Gly or Arg
  UNSURE 27: Xaa=Asp or Glu
ttaagtctttaatccgtcttgaattgattttygtataaggygtaaaamatgctcatcatcactggccatcagagaamsmcaaatcaaaaccacaatgagataccatctcacaccagttagratggcaatcattaaraagtcmbgaaacaacaggtgctggagaggatgtggagamataggaacacttttacactgttggtgggactgtaaactagttcaaccattgtggaagtcagtgtggcgattcctcagggatctagaactagaaataccatttgacccagccatcccattactgggtatata

SEQ ID NO: 3569 - DNA, 399 bp, Homo sapiens
  CDS 233..397
ttggattctcatctcgaggaggagctgtttcagagctggtgtgcgctattatgtaagaggaattgattcggaaggccatgcagctaactttgtagaaacagaacaaattgtacactacaatgggagcaaagcttcgtttgtacagactcgaggatcaatacctgttttctggtcccaaagaccaaacctcaagtacaaaccactgccacagatcagcaaagtagcaaatcacatggacggtttccaaaggcattttgattcccaagtaattatttatggaaaacaagttataatcaatctgattaaccagaagggctcggagaagccacttgagcagacatttgcaacaatggtgtcttccttgggaagtggaatgatgagatacattgcctttgactt

SEQ ID NO: 3570 - DNA, 333 bp, Homo sapiens
  CDS 171..332
  misc_feature 68: m=a or c
  misc_feature 69: w=a or t
agaatctttcggttccccttcgggctgggctccccgcaggaaccaggaacgggctggccaggaggacmwgatggaccgggagaaggtgacagaggcaaagccagacccttcctgttccatcttgcagaggctgtcccaacgcgaggggctatcaaggactcacaaactgcatgatggccgccctgccggaggacactgtagtttttgagaagcctgtgaagaccatccactggaacgggtccttccaggaggcagcctttcccggggagacctttccagtgtcggtagagtgtgaggatggagaccggttcccggcgcaccatgtcatcgtca

SEQ ID NO: 3571 - DNA, 359 bp, Homo sapiens
  CDS 93..359
  misc_feature 109: r=a or g
  misc_feature 292: s=g or c
  misc_feature 347: r=a or g
  UNSURE 6: Xaa=Asp or Gly
  UNSURE 67: Xaa=Ala or Gly
gaaaaacaaggtcaaggaactcaaggtttcgctgccgtggagtggatgccaatagaaactggaaagtgaagtggtgtgatgaaggagcttctatgcacccttgtgatgrcacatactgtggcccttttccagaatctgagccggaagtgaaggctgtagctaacttccttcgaaaacacagaaagcacattagggcttatctctcctttcatgcatatgctcagatgttactgtatccctattcttacaaatatgcaacaattcccaattttagatgtgtggaatctgcagsttataaagctgtggatgcacttcagtcagtatacggggtacgatacagatatggrccagcctccaca

SEQ ID NO: 3572 - DNA, 299 bp, Homo sapiens
  CDS 59..298
  misc_feature 123: m=a or c
  misc_feature 130: y=c or t
  misc_feature 131: w=a or t
  UNSURE 22: Xaa=Asn or Thr
  UNSURE 25: Xaa= *  or Lys
gtttccggcggtgtggaagcggacctgaggagtcgcaattgtgaacaggctcagcgatatgaggcagcatcgacaatttatggaccgcacgcattatctgcttacattcagctcttcagaaamcttggcywaaggctattgctacggacacggtagccaacctgagcagaggtccagaacctccctttttcaaacaattatagttccattaattcctagtattgtggatagagcaccaaaaggcagaactttcggggatgtcctgcagccagcaaaacctgaatacagagtgggggaaa

SEQ ID NO: 3573 - DNA, 226 bp, Homo sapiens
  CDS 69..224
  misc_feature 123: r=a or g
  misc_feature 130: m=a or c
  misc_feature 134: s=g or c
  misc_feature 139: r=a or g
  UNSURE 19: Xaa=Gly or Arg
  UNSURE 21: Xaa=Asn or Thr
  UNSURE 22: Xaa=Phe or Leu
  UNSURE 24: Xaa=Asp or Gly
ttttataactctgaacaagtttctttgactctctgcctcaatttacttacttgcataatagtaacgacatggtacctaccatgagggtggttgtgatgattaagcaagataaggcttgtaaarggcttamcttsagggrcctacaaaaagtgcgtaaaacatggttccagctgggcgtgatggctcgcgtctgtggtctcacactttgggaggccggggcgggcat

SEQ ID NO: 3574 - DNA, 306 bp, Homo sapiens
  CDS 70..306
  misc_feature 118: s=g or c
  misc_feature 126: w=a or t
  UNSURE 17: Xaa=Gly or Arg
  UNSURE 19: Xaa= *  or Tyr
gtagtagtgagtacgtgctgaggagcaaaggagtaaccaagagatccagtgaccgacagagcaagagccatgccgcgccggggcctggtggctgggccagacttggagtattttcagsgtcgctawttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagtc

SEQ ID NO: 3575 - DNA, 283 bp, Homo sapiens
  CDS 60..281
  misc_feature 131: k=g or t
ttttcggtgctcgactcgcccgtgctgctgccgccgccgaaggaggggcaaagctcaagatggcggacaaaacgccaggcggatctcagaaggccagttcaaagacgagatcatcagatgttcattcatckggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacc

SEQ ID NO: 3576 - DNA, 371 bp, Homo sapiens
  CDS 61..369
gatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgacccttatgaaattatgtggtttaaaaattttgtgcaccgagggcggcctgagcctctggatcttcactt

SEQ ID NO: 3577 - DNA, 380 bp, Homo sapiens
  CDS 125..379
  misc_feature 370: n=a, g, c or t
  misc_feature 374: n=a, g, c or t
  misc_feature 379: m=a or c
  UNSURE 82: Xaa= *  or Tyr
  UNSURE 84: Xaa=Ala or Pro or Ser or Thr
  UNSURE 85: Xaa=Lys or Asn
actagaccaagtggccccttatctcctttctgaaccgcttgaataggccacccttccttcaaactatcttcacaaaacaatttttttaagcatctaggatacctgctcccacacataattttctatgtctcatttcttggccttggattttatactgctgcttttctacctgaagactagaatccgaattcctcatctagctgtaaggccactctactaccagttatccttcttggcctccttttctttcccaactccaaggtctccatcaacttctgtttccctggaatggaatgaacaagagctttggcttagcattggtaatctttacaaactggttcctcatgcatccccatgcccctgtagttancccnctaamc

SEQ ID NO: 3578 - DNA, 357 bp, Homo sapiens
  CDS 158..355
  misc_feature 116: y=c or t
  misc_feature 318: m=a or c
  UNSURE 54: Xaa=His or Pro
acagccttgttcagacgcccagtgacctgccgaggtcggcagcacagagctctggagatgaagaccctgttcctgggtgtcacgctcggcctggccgctgccctgtccttcaaccytggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcmtggcaaatacagcgcctatgggggcaggaagctcatgta

SEQ ID NO: 3579 - DNA, 329 bp, Homo sapiens
  CDS 109..327
  misc_feature 85: m=a or c
  misc_feature 278: r=a or g
  UNSURE 57: Xaa=Glu or Gly
taccgtggcttcctggtgcagacaattgagtttgctgaacagcggatccctgtattaaatgaatattgtgtggtttgtgatgagmcacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgrgccatatccttctgtggtagatcctaatgatcctcagatgttggccttcaa

SEQ ID NO: 3580 - DNA, 297 bp, Homo sapiens
  CDS 5..295
  misc_feature 29: y=c or t
  misc_feature 92: y=c or t
  misc_feature 106: m=a or c
  misc_feature 113: m=a or c
  misc_feature 115: w=a or t
  misc_feature 116: h=a or c or t
  misc_feature 117: n=a, g, c or t
  misc_feature 124: v=a or c or g
  misc_feature 129: m=a or c
  misc_feature 131: s=g or c
  misc_feature 135: s=g or c
  misc_feature 175: k=g or t
  misc_feature 221: s=g or c
  misc_feature 229: m=a or c
  UNSURE 9: Xaa= *  or Arg
  UNSURE 30: Xaa=His or Tyr
  UNSURE 37: Xaa=Arg or Ser
  UNSURE 38: Xaa= *  or Lys or Leu or Met or Pro or Gln or Arg or Ser or Thr or Trp
  UNSURE 42: Xaa=Lys or Thr
  UNSURE 43: Xaa=Ala or Pro
  UNSURE 44: Xaa=Ala or Gly
  UNSURE 57: Xaa=Phe or Leu
  UNSURE 73: Xaa=Ala or Pro
tattatgaatttttgtaagaaaccgaggygatgccacgctttgctgctaccgccctgggctggactggaggtgggcatgcgaccctcacaayacacagctggggcmaaagccmgwhngctggcvagcamgscagsttggatgggagtgggcacctcagaaagtcaccaggacttkgggtcaggaacagtggctgggtgggcccagaactgcccccactgtscccctacmcaccgatggagcccccagatagagctgggtggcctgtttctgcagcccttgggcagttctcactccta

SEQ ID NO: 3581 - DNA, 293 bp, Homo sapiens
  CDS 72..293
  misc_feature 186: m=a or c
  UNSURE 39: Xaa=Ile or Leu
caatcaacaagtgcttactgaaggcccacagggtgcaaagaaccctggactaagtgcttaaacttgactccatgtgccttactgtgttattgcacaagtgctggagtaaggttggagttttcccagattccaggtacccaatgactacagtagattatgaaagagcagttcaggtgagagccaagmtagaaacacacacatgcaaacctcagaaaaaaaaggattcccaaaagtcctctattttgtcatggagacttttttctccatttcactggtcccacgaaaaggccctc

SEQ ID NO: 3582 - DNA, 302 bp, Homo sapiens
  CDS 60..302
  misc_feature 69: m=a or c
  misc_feature 79: s=g or c
  misc_feature 92: s=g or c
  misc_feature 93: s=g or c
  misc_feature 258: s=g or c
  UNSURE 4: Xaa=Pro or Thr
  UNSURE 7: Xaa=Ser or Trp
  UNSURE 11: Xaa=Asp or Glu
  UNSURE 12: Xaa=Leu or Val
  UNSURE 67: Xaa=Gly or Arg
acctcagactctgcgcgcacccaattcagtcgcccgctcccgttcggcacctcgaagccatggcgggamctgggggctsgagggacagggasstcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaatasgaaggcgagtgagagtgaataaatatcaaaaatctgttgggtgc

SEQ ID NO: 3583 - DNA, 322 bp, Homo sapiens
  CDS 83..322
  misc_feature 87: w=a or t
  misc_feature 103: k=g or t
  UNSURE 2: Xaa=Phe or Tyr
  UNSURE 7: Xaa=Arg or Ser
agaattgggaggccacctggtgggcatagtaacttagcttgtgccctgaaaaaagccagtaagaggagaaagaggcggaaaaatgtwtttgttcataagaagkaaacgctcctctgcatctgttgataataccccagcgggctctccccagggaagtgggggtgaagatgaggatgacccagatgaaggggatgatgattccctaagtgaaggcagtacatccgagcagcaggatgagctacaggaagaatcagaaatgtcagaaaaaaagtcatgctcctcttctcccacccaaagtgagatatccacatcgctgcctcaa

SEQ ID NO: 3584 - DNA, 259 bp, Homo sapiens
  CDS 82..258
acttcctgcagcctcttccgctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtaacc

SEQ ID NO: 3585 - DNA, 295 bp, Homo sapiens
  CDS 141..293
  misc_feature 20: n=a, g, c or t
  misc_feature 38: s=g or c
  misc_feature 52: y=c or t
  misc_feature 53: s=g or c
  misc_feature 62: k=g or t
  misc_feature 67: y=c or t
  misc_feature 71: h=a or c or t
  misc_feature 72: n=a, g, c or t
  misc_feature 73: n=a, g, c or t
  misc_feature 104: s=g or c
  misc_feature 184: r=a or g
  misc_feature 185: s=g or c
  misc_feature 201: k=g or t
  misc_feature 217: d=a or g or t
  misc_feature 219: b=c or g or t
  UNSURE 15: Xaa=His or Gln or Arg
  UNSURE 21: Xaa= *  or Gly
  UNSURE 26: Xaa=Ile or Asn or Ser
  UNSURE 27: Xaa=Asp or His or Tyr
aaaggccaggacgctccgcngctgttggggaagaggasctgcctcctgggaysgagaaattkaaggytgchnngttgctggggagcgtcggcgatgctcttggstacagaaatgtctgcaaggagaacagcactgtaggcatgaagatccaggaggagctgcaacgttccgggggcctggaccrsctcgtactctcgccakgagaatggcccgtgadtbacaacaccatcatgcacatcgcaaccgccgaggccctcaccacagactactggtgcctggatgatctgtaccggga

SEQ ID NO: 3586 - DNA, 337 bp, Homo sapiens
  CDS 116..337
  misc_feature 113: k=g or t
  misc_feature 230: n=a, g, c or t
  misc_feature 275: k=g or t
  UNSURE 39: Xaa=Ala or Pro or Ser or Thr
  UNSURE 54: Xaa=Ala or Ser
attcctgctcggcgcaatcctgaccctgctctgggcgcccacggctcaggctgaggttctgctgcagcctgacttcaatgctgaaaagttctcaggcctctggtacgtggtckccatggcatctgactgcagggtcttcctgggcaagaaggaccacctgtccatgtccaccagggccatcaggcccacagaggagggcggcctccacgtccacatggagttcccggggncggacggctgtaaccaggtggatgccgagtacctgaaggtgggckccgagggacacttcagagtcccggccttgggctacctggacgtgcgcatcgtggacacagac

SEQ ID NO: 3587 - DNA, 426 bp, Homo sapiens
  CDS 3..425
  misc_feature 358: m=a or c
  misc_feature 392: y=c or t
  misc_feature 393: b=c or g or t
  UNSURE 119: Xaa=Ala or Glu
  UNSURE 131: Xaa=Ala or Pro or Ser
agatggatatggatcacattatgacctgggccactgatgtagccaaaggaatgcattatttacatatggaggctcctgtcaaggtgattcacagagacctcaagtcaagaaacgttgttatagctgctgatggagtactgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggmaaaaaacgagagattaaccattccaagcagttgybccagaagttttgctgaactgttacatcagtgtt

SEQ ID NO: 3588 - DNA, 361 bp, Homo sapiens
  CDS 113..361
  misc_feature 292: k=g or t
  misc_feature 307: w=a or t
  misc_feature 308: n=a, g, c or t
  misc_feature 315: m=a or c
  misc_feature 323: d=a or g or t
  UNSURE 60: Xaa=Asp or Glu
  UNSURE 65: Xaa= *  or Tyr
  UNSURE 66: Xaa=Leu or Met or Val
  UNSURE 68: Xaa=Ser or Tyr
  UNSURE 71: Xaa=Asp or Asn or Tyr
cttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgaktacatgtgttattawntgtcgtmcttagttdatcttcagactctgaactggttgaagcttttggtggaa

SEQ ID NO: 3589 - DNA, 308 bp, Homo sapiens
  CDS 129..308
  misc_feature 85: b=c or g or t
  misc_feature 87: k=g or t
  misc_feature 277: d=a or g or t
  misc_feature 286: n=a, g, c or t
  misc_feature 287: d=a or g or t
  misc_feature 288: k=g or t
  UNSURE 50: Xaa=Cys or Phe or Tyr
  UNSURE 53: Xaa=His or Leu or Pro or Gln or Arg
  UNSURE 54: Xaa=Ala or Ser
atcttggatccgcgggacaagaaaattcatgcgagggagacgtggtgggcggtccttcctgtgacacgacccttgagtgacagtbckatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtdtccacatcndkcagaaaaagatatgctggcc

SEQ ID NO: 3590 - DNA, 311 bp, Homo sapiens
  CDS 116..310
aacagaaggagcagaaagaaccaatgatgatagctcagctgaaactattgaaaagaaagaaaaagccaacctagaggaacgggccatttgtgagtacaatgaaaacccaaaaggtatgagcacatttgataacatacatatatacatacatacatacacacatatatatgtgtatgtatgccataattgggtaattataagcttacatataagtttacatatatgctataatttttactgtcacatgatcctcataacaagctatgaaatatgtgatacagacttatctgttcttatatataaccaccagc

SEQ ID NO: 3591 - DNA, 383 bp, Homo sapiens
  CDS 170..382
tattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttcccctcccaccta

SEQ ID NO: 3592 - DNA, 312 bp, Homo sapiens
  CDS 130..312
catggattgatttgttatttggggattaaattaggcagggcacatagtagggcctccttggatgtttgatggctgttgaatgaacgtaagtgaatctgttcagttttagggttttattgcatttttgatatggattgtgccagtatatctgtaaagttcacttctatggctaccatgcatgacttgagtcagttctgggcttctagaggagaggttacaaactggtggccagtaggacaaactagcctaccactgttttatttggctttcatggtgtttggttctttttttcctttaatttcctgccagccc

SEQ ID NO: 3593 - DNA, 315 bp, Homo sapiens
  CDS 10..315
agagaaaaaatgaagagcaatgaagctgcatccaaggaactagcttctaaaaaatccctacctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcattt

SEQ ID NO: 3594 - DNA, 385 bp, Homo sapiens
  CDS 55..384
  misc_feature 67: r=a or g
  misc_feature 280: r=a or g
  misc_feature 281: w=a or t
  UNSURE 5: Xaa=Asp or Asn
  UNSURE 76: Xaa=Glu or Lys or Met or Val
caactgtataataatagtgtggtctgttctttcttgccagaagttatctacaagatgagacaaacaratcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttccccatgcaaaaggattttgtatccccggcctacttgaagrwgtggtcagctaaaggaatccaggttgttggttggactgttaatacctttgatgaaagagttactacgaatcccatcttggttccagctatatcactgacagcat

SEQ ID NO: 3595 - DNA, 311 bp, Homo sapiens
  CDS 62..310
attcaggactcctcgcctggctcggaaggttttgtagtgcatccctgagcatgagcacagaatgaagcggcgtttggatgaccaggagtcaccggtgtatgcagcccagcagcgtcggatccctggcagcacagaggcttttcctcaccagcaccgggtgcttgcccctgcccctcctgtgtatgaagcagtgtctgagaccatgcagtcagctacgggaattcagtactctgtaacacccagctaccaggtttcagccatgccacagagctccggcagtcatgggcccgctatagcagcagttcatagca

SEQ ID NO: 3596 - DNA, 316 bp, Homo sapiens
  CDS 87..314
  misc_feature 248: n=a, g, c or t
  UNSURE 54: Xaa=Lys or Asn
cagatgctttcctcaaagcagatgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaanagggaggactatgaatctcttccaaaagaggttgccagtgctaaacccaaagtattgctagacgtgaa

SEQ ID NO: 3597 - DNA, 261 bp, Homo sapiens
  CDS 24..260
  misc_feature 68: r=a or g
  misc_feature 70: r=a or g
  UNSURE 15: Xaa= *  or Trp
  UNSURE 16: Xaa=Lys or Arg
catcttaattgggcacgaaagagatgatgataattccgaagaaggcttccacactattcattcgttgrargcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcacccc

SEQ ID NO: 3598 - DNA, 399 bp, Homo sapiens
  CDS 60..398
aagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgcccagcaggcggcagcatcttacagaaggtaggaagacccaacctccaattacaaatggacaac

SEQ ID NO: 3599 - DNA, 314 bp, Homo sapiens
  CDS 11..313
ccctatcaagatggtcaacttcccccagaaaattgcaggtgaactctatggacctctcatgctggtcttcactctggttgctatcctactccatgggatgaagacgtctgacactattatccgggagggcaccctgatgggcacagccattggcacctgcttcggctactggctgggagtctcatccttcatttacttccttgcctacctgtgcaacgcccagatcaccatgctgcagatgttggcactgctgggctatggcctctttgggcattgcattgtcctgttcatcacctataatatccacctccgcc

SEQ ID NO: 3600 - DNA, 319 bp, Homo sapiens
  CDS 2..319
catgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagc

SEQ ID NO: 3601 - DNA, 296 bp, Homo sapiens
  CDS 108..296
aacccactcaggtccgcttccacactgtggaagctttgttcttttgctctttgcaataaatcttgctactggctgggctctttgggtccacactgcttttatgagctatgacactcaccgcaaaggtctgcagcttcactcctgaagccagcgagaccacgagcccactgggaggaaggaacaagtccagaggcgccaccttaagagctgtagcactcaccgcgagggtccgcggcttcattcttgaagtcagtgagaccaagaacccaccaattccagacacaactgcgcccagc

SEQ ID NO: 3602 - DNA, 311 bp, Homo sapiens
  CDS 140..310
  misc_feature 277: r=a or g
atgttatcatgtttttaatcactaaatcattgcagtggttatagatttacagtcttggggtattacagagaggagcaacggcggctatatatatgcctttaaattacaccaatgtaaactgagtgcggcagctgtgaatatggtcggcagacatctattccctcccccaccaagttctttctccctctgtgatttttctcccaaatttcttggtttgcttaaaataagctacccctctcttcccctgtattgtctcttcgccacctcttccaaaaarattaattttcattttagacctttaaccccagaag

SEQ ID NO: 3603 - DNA, 303 bp, Homo sapiens
  CDS 68..301
ttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtccc

SEQ ID NO: 3604 - DNA, 262 bp, Homo sapiens
  CDS 105..260
  misc_feature 48: k=g or t
  misc_feature 50: y=c or t
  misc_feature 52: y=c or t
tcgtatgtctacttctttctacacagacacggtaacaatctgatctckcytyccttttccccacatttcctccttttcttttcgacaaaaccaccatcgtcatcatggcccgttctcgatggtcactgtctcttcggagctgttgggtacacctgcagaaaggctgtcacttcacacttggaagattgcacagcggccaggcagaggcgctcctcacttcccagccaaggcggccgggcagaggcgctcctcacttcccaga

SEQ ID NO: 3605 - DNA, 298 bp, Homo sapiens
  CDS 77..298
gtttccaagggaaggagcagcgtgtgggaaagcacagaagagtgagaaggaagcgactaaattttatttactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccccc

SEQ ID NO: 3606 - DNA, 362 bp, Homo sapiens
  CDS 58..360
  misc_feature 342: k=g or t
  misc_feature 343: k=g or t
  misc_feature 344: b=c or g or t
  misc_feature 345: y=c or t
  UNSURE 96: Xaa=Ala or Cys or Phe or Gly or Ser or Val
agcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaaccckkbyatcagtgatgacagccg

SEQ ID NO: 3607 - DNA, 358 bp, Homo sapiens
  CDS 41..358
tgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcagggtgtccaccaaaaacttctccttcaaaagagaagactccgtgcttcagggctatgacatca

SEQ ID NO: 3608 - DNA, 317 bp, Homo sapiens
  CDS 14..316
  misc_feature 287: m=a or c
  misc_feature 288: m=a or c
  UNSURE 92: Xaa=His or Asn or Pro or Thr
catcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttcmmtgatgaatttcacctccagactttgaatc

SEQ ID NO: 3609 - DNA, 168 bp, Homo sapiens
  CDS 7..168
ttaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaccc

SEQ ID NO: 3610 - DNA, 287 bp, Homo sapiens
  CDS 38..286
gaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggctc

SEQ ID NO: 3611 - DNA, 394 bp, Homo sapiens
  CDS 139..393
  misc_feature 36: y=c or t
gcggggaggccaaacttcctgctgaagctctgtggyctcttttggggtgggggcgggggtccaggcagaaagaaaccgtctgctgctcaagacccacaggacgccgggaagactaaatgatcactgcccccagtgaatatggtgaagaagctggtgatggcccagaagcggggagagacacgagccctttgcctgggtgtaaccatggtggtgtgtgccgtcatcacctactacatcctggtcacgactgtgctgcccctctaccagaaaagcgtgtggacccaggaatccaagtgccacctgattgagaccaacatcagggaccaggaggagctgaagggcaagaaggtgccccagtacccatgcctgtgggtcaacgtgtcagctgccggca

SEQ ID NO: 3612 - DNA, 461 bp, Homo sapiens
  CDS 103..459
aacagcaagtaacaggcaggaggagtgttaagcctgaggctccatcttcagggaagaaaacatcccaactagagaagaagggacaccttcccctcctaacaaatgaatgagcgggcaattgcaggggctctcattgctgacttcttgtctggcctggtacactggggtgctgacacatggggctctgtggagctgcccattgtggggaaggctttcatccgacccttccgggagcaccacattgacccaacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggct

SEQ ID NO: 3613 - DNA, 457 bp, Homo sapiens
  CDS 158..457
  misc_feature 235: n=a, g, c or t
  misc_feature 302: n=a, g, c or t
  UNSURE 26: Xaa= *  or Cys or Trp
  UNSURE 49: Xaa= *  or Glu or Lys or Gln
ctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgnttgctcacagatgaagtggccattctgcctgcccctcagaacctctctgtactctcaaccaacatgnagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcact

SEQ ID NO: 3614 - DNA, 239 bp, Homo sapiens
  CDS 63..239
caataaatagagtcatcagaatgctgtcttcttacattcttcatcgtggtaagagcttatagatggcttccatgcacatatcatctttatgctataggaagtcacctgtatgctctaaggtgctcaaacccattacttccagcctaggcatctctccttacattcaaacttacctgatctctcatagctggttaatcacaaagtactgccacatctgcctcctgagtgttttgccagcc

SEQ ID NO: 3615 - DNA, 296 bp, Homo sapiens
  CDS 71..295
  misc_feature 46: s=g or c
  misc_feature 52: s=g or c
  misc_feature 81: s=g or c
  misc_feature 84: m=a or c
  misc_feature 98: m=a or c
  misc_feature 99: m=a or c
  misc_feature 117: h=a or c or t
  misc_feature 133: k=g or t
  misc_feature 136: n=a, g, c or t
  misc_feature 137: h=a or c or t
  misc_feature 149: m=a or c
  misc_feature 210: v=a or c or g
  misc_feature 216: m=a or c
  misc_feature 258: m=a or c
  UNSURE 4: Xaa=Ser or Thr
  UNSURE 5: Xaa=Lys or Thr
  UNSURE 10: Xaa=Lys or Pro or Gln or Thr
  UNSURE 16: Xaa=Ala or Glu or Val
  UNSURE 22: Xaa= *  or Cys or Trp
  UNSURE 23: Xaa=Arg or Trp
  UNSURE 27: Xaa=Lys or Gln
  UNSURE 47: Xaa=Lys or Arg or Thr
  UNSURE 49: Xaa=Ala or Asp
  UNSURE 63: Xaa=Asn or Thr
agagcctggctgctggcggccgggagcgccgggacggggcgcgaascggagstccgggacgtggatacagatgaaaagaascamagaattgataactmmaaatcatagtcaagagghaacaagtattcttcgktgnhggaaatgtagamaatgtatagcaagctctggttgttttatggagtatcttgagaatcaagtgattaaggatavagatgmttcagttgatgctcaaaatatttgtcatgtgtggcacatgamtgtagaagcccttccagaatggataagctgcctaatcc

SEQ ID NO: 3616 - DNA, 358 bp, Homo sapiens
  CDS 168..356
  misc_feature 93: m=a or c
  misc_feature 296: y=c or t
caaaaagcacttacctgaaaattaaagctgaaggttttctttactgatttgaagggcatctgggaatttcatttcgtagaaactccacttaamcatggcaagagtttctcaagatataaaaattctccctgattgtaacaagtactgagacagtgaacaaatcctgtatgtcacatttgatgaccttagcaattatacagacagggaaaatgtttatcttgatttctgctacagcaacactgaagccagaggtgtctgagctttggctaatgtcacttgatgtaggtcagccctaytgtgagtgtcaaccctggtttctaaatgtgctgctggaggaatccacttcacttccagttta

SEQ ID NO: 3617 - DNA, 228 bp, Homo sapiens
  CDS 70..228
  misc_feature 137: s=g or c
  misc_feature 138: s=g or c
  misc_feature 160: k=g or t
  misc_feature 161: k=g or t
  UNSURE 23: Xaa=Cys or Ser or Trp
  UNSURE 31: Xaa= *  or Gly or Leu or Val
agaaattgttccggatctcgggtcggacacggaagtcttcctgcagtgtttctggatgcggggacagggatgcgcaggaattccagtctcagtttccagatggagcgacccctcgaggagcaagtccagagcaagtsstcgtctagtcaaggccgcacakkaacaggagggtctgatgtcctccagatgcagaacagtgaacaccatggacaaagcatcaagactcac

SEQ ID NO: 3618 - DNA, 395 bp, Homo sapiens
  CDS 209..394
  misc_feature 277: v=a or c or g
  UNSURE 23: Xaa=Asp or Glu
aatgtttaacgtgcccaagtcccggcccactgatactggaggctgctgccccaggttgtggagggtgtgcggtgcctggcgttggctcctgtggccccacctgccaccgcggctgctggaactgccttgaaggaaggcggacagcctgagggccctgagtgtcaggttaccaaggaaaccaagccagccaaccaaggtctggagaaggatgatgccccgtgtggcccccgtggccctgcctgcagtgtgcagtgtggggctgggcagagaggaagavtcctggttagccagaggtgccaccgcagactccccaggcagggttgatggccctgctggggttcccctggctccactggcttgctgtgactggggacattccttagctttgaggcaac

SEQ ID NO: 3619 - DNA, 353 bp, Homo sapiens
  CDS 140..352
  misc_feature 7: k=g or t
  misc_feature 88: d=a or g or t
  misc_feature 100: w=a or t
  misc_feature 130: k=g or t
  misc_feature 148: k=g or t
  misc_feature 253: d=a or g or t
  misc_feature 333: b=c or g or t
  misc_feature 334: d=a or g or t
  misc_feature 335: v=a or c or g
  misc_feature 341: r=a or g
  UNSURE 3: Xaa=Ile or Met
  UNSURE 65: Xaa=Leu or Pro or Arg
  UNSURE 66: Xaa=Glu or Lys or Gln
  UNSURE 68: Xaa=Ile or Val
tactttkctcttaaagtctcatgaagcaaacagcaatgcagtgagatttagagtgtgcctgctcataaacaagcttttgggaagtatdccagaaaatgcwcagattgatgatgatgtgtttgataaaatkaataaagccatgcttatkagattgaaagataagattccaaatgtgagaatacaggcagttctggcgctttcacgacttcaggatcccaaggatgatgaatgcccagtggttaatgcatatgcdactttgattgaaaatgattcaaatccagaagttagacgggcagtgttatcatgtattgcaccatcagcaaagactttgcbdvaaattrtagggcgcacac

SEQ ID NO: 3620 - DNA, 322 bp, Homo sapiens
  CDS 67..321
  misc_feature 264: n=a, g, c or t
  misc_feature 265: n=a, g, c or t
  misc_feature 301: n=a, g, c or t
  UNSURE 67: Xaa=Asp or His or Asn or Tyr
  UNSURE 79: Xaa=Ala or Pro or Ser or Thr
acaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctnnacagtgctgagaatcagaacctagggcattcagagnctatagacctcaatcttgatt

SEQ ID NO: 3621 - DNA, 437 bp, Homo sapiens
  CDS 58..435
  misc_feature 92: y=c or t
  misc_feature 100: r=a or g
  misc_feature 101: r=a or g
  UNSURE 12: Xaa=Phe or Ser
  UNSURE 15: Xaa=Glu or Gly or Lys or Arg
agttagtgcctggaccaggaccatcacactggggaccggcttctctgctctcccgttatgggggtcgggggaatgatgggtcaagggtcttyccgaagarrgcgagaaaggaacaggcgccttcaaaagcccacttggcgatgggttacagtaagaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttccccctcccggatagcgcctccttccagaaagaggatgtggtc

SEQ ID NO: 3622 - DNA, 362 bp, Homo sapiens
  CDS 168..362
  misc_feature 96: w=a or t
  misc_feature 101: v=a or c or g
  misc_feature 104: m=a or c
  misc_feature 109: r=a or g
atttccacaactttaaagggccaagattaggcattcttgggctggaaattcaaatccccataaggaagagaggctgcccaccttggtcaaacaatwaagavgamaagargaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctactt

SEQ ID NO: 3623 - DNA, 374 bp, Homo sapiens
  CDS 77..373
agcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggt

SEQ ID NO: 3624 - DNA, 288 bp, Homo sapiens
  CDS 50..286
  misc_feature 34: k=g or t
  misc_feature 87: y=c or t
  misc_feature 91: r=a or g
  misc_feature 106: s=g or c
  misc_feature 267: s=g or c
  UNSURE 13: Xaa=Ala or Val
  UNSURE 14: Xaa=Ile or Met
  UNSURE 19: Xaa=Ile or Met
  UNSURE 73: Xaa=Arg or Thr
tggaaaatacttgtattcggcagttgacggccakccccctcgaagaggaatggactccgcccagagggaagccttggacgacattgycatrcaggtcatggagatsatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggasgcacgcgtatttacagcctca

SEQ ID NO: 3625 - DNA, 341 bp, Homo sapiens
  CDS 156..341
  misc_feature 224: w=a or t
  misc_feature 298: w=a or t
  misc_feature 307: r=a or g
  UNSURE 23: Xaa=Arg or Ser
  UNSURE 48: Xaa=Phe or Tyr
  UNSURE 51: Xaa=Asp or Gly
tctgtggccaagaaaagagtgattctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagwgaacttagagaacgagtccaaacacaatgtgactgttgttttttatactggcatcgagctgtcttcccaatttwtttagatgrtgtatatgaaatgctgttgatgcagcagatacat

SEQ ID NO: 3626 - DNA, 382 bp, Homo sapiens
  CDS 103..381
  misc_feature 207: d=a or g or t
  UNSURE 35: Xaa=Asp or Glu
cccatctccccaccctctcttctccaccagccaacgtccgggaaaaacgagtttttcacgactgaaataacatagcaaaataagccaagatgtctggatccaatgacctacgaggcccagttctttggcttcacgccacaaacgtgcatgcttcggatctacattgcatttcaagactacctatttgaagtgatgcaggccgttgadcaggttattctgaagaagctggatggcatcccagactgtgacattagcccagtgcagattcgcaaatgcacagagaagtttctttgcttcatgaaaggacattttgataacctttttagcaaaatggagcaactgtttttgcagctgattttacgtattccctcaaacatcttgc

SEQ ID NO: 3627 - DNA, 423 bp, Homo sapiens
  CDS 72..422
  misc_feature 380: v=a or c or g
accgactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtvgctgtcaccagttcccccaatgccatcctgggcaagtaccaac

SEQ ID NO: 3628 - DNA, 386 bp, Homo sapiens
  CDS 121..384
aaactgaagcccaacctaggcaacggggcagacctgcccaattaccgctggacccagaccctgtcggagctggacctggcggtccctttctgtgtgaacttccggctgaaagggaaggacatggtggtggacatccagcggcggcacctccgggtggggctcaaggggcagccagcgatcattgatggggagctctacaatgaagtgaaggtggaggagagctcgtggctcattgaggacggcaaggtggtgactgtgcatctggagaagatcaataagatggagtggtggagccgcttggtgtccagtgacctgagatcaacaccaagaagattaaccctgaagaattccaagctgtcagacctggacagtgagactcgcagcat

SEQ ID NO: 3629 - DNA, 391 bp, Homo sapiens
  CDS 6..389
  misc_feature 232: y=c or t
  UNSURE 76: Xaa=Ala or Val
tgggaatgaagctgtcagaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagyactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccgt

SEQ ID NO: 3630 - DNA, 401 bp, Homo sapiens
  CDS 205..399
  misc_feature 142: m=a or c
  misc_feature 372: h=a or c or t
  misc_feature 373: n=a, g, c or t
  UNSURE 56: Xaa=Asp or Glu
  UNSURE 57: Xaa=Ala or Pro or Ser or Thr
ccgtgcatttttatttctcctcatctgctgtaccttcttaccaaccgatctcttatcttgtccactcctctctaccacagacttctcctaagaatttcctcttctcatttttgcctttttattgtattgaacaatggttgcmatccctagccctaccacttggccgattctgcatcatagaaactagcttagcagcatattatcatggatgtgaatatatttttgagtagggaatatgatcaagagttctatagtatctttccaaaaacattttttagagacaaatcttttctcccaaatattcatttagtttggaacatctctgctcttactgtaaatcacagtgacattatccagggggtatctagggahnccccctggatagtctgctttttgatcac

SEQ ID NO: 3631 - DNA, 247 bp, Homo sapiens
  CDS 55..246
  misc_feature 142: s=g or c
  misc_feature 145: s=g or c
  UNSURE 30: Xaa=Gly or Arg
  UNSURE 31: Xaa=Leu or Val
tttgttgttgtttttgagactgagtttcactcttgttgcccaggctggagtgcaatggcaccatctcggctcactgcaacctccacctcctggttcaagcgattctcaggcctcagcttcccaagtagttgggattacaggsgcstgccaccacacctggctaattttgtatttttagtagagatggggtttctccatgttggtcaggctggtctcaaactcccgacctcaagtgatctacccgcac

SEQ ID NO: 3632 - DNA, 365 bp, Homo sapiens
  CDS 130..363
aaaatcaatgtgcaaaaatcacaagcattcttatacaccaataacagacagagagccaaatcatgagtgaactcccattcacaattgcttcaaagagaacaaaatacataggaatccaacttacaagggatgttgaaggacctcttcaaggagaactacaaaccactgctcagtgaaataaaagaggatacaaacaaatggaagaacattccatgctcatggataggaagaatcaatatcatgaaaatgcccatactgcccaaggtaatttatagattcaatgccatccccatcaagctaccaatgactttcttcacagaattggaaaaaactaaagttcatatggaaccaaaaaagagcccaca

SEQ ID NO: 3633 - DNA, 219 bp, Homo sapiens
  CDS 62..217
  misc_feature 122: m=a or c
  misc_feature 127: s=g or c
  misc_feature 128: k=g or t
  misc_feature 132: m=a or c
  misc_feature 134: m=a or c
  misc_feature 137: s=g or c
  misc_feature 143: b=c or g or t
  misc_feature 180: d=a or g or t
  UNSURE 21: Xaa=Ile or Leu
  UNSURE 23: Xaa=Ala or Ser
  UNSURE 24: Xaa=Lys or Thr
  UNSURE 25: Xaa=Pro or Thr
  UNSURE 26: Xaa=Asp or His
  UNSURE 28: Xaa=Phe or Leu or Val
  UNSURE 40: Xaa=Cys or Phe or Tyr
tatggatagattttcaaactcagtaccaacccagcttctcctaactgagtaaattagaggcatgcaatctgatggtcttggttgccactttaggcagagtatatataccaccccccacccamtcctskccamamccsacccabtctttccttctttcctactttatcaggtgaagacatdcagtgaagcttgcctgatggtaaggaaaccagcccattc

SEQ ID NO: 3634 - DNA, 469 bp, Homo sapiens
  CDS 216..467
  misc_feature 132: r=a or g
  misc_feature 134: n=a, g, c or t
  misc_feature 407: v=a or c or g
  misc_feature 408: b=c or g or t
  misc_feature 412: m=a or c
  UNSURE 65: Xaa=Asp or His or Tyr
  UNSURE 66: Xaa=Ala or Asp
ttaaggccagggcaacaaagtcaagaggtcaaggtgtagggccatgaggcctggacctatgctgcaggcaagggtttccatccccgctgccctaggcactctcttcccaaggccaggttgggcacctggggrangtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtgcvbatgmccctccagccctgcgtttccattctgccttctcagagtgcccttgctgcacccagac

SEQ ID NO: 3635 - DNA, 460 bp, Homo sapiens
  CDS 121..459
  misc_feature 130: m=a or c
  misc_feature 132: w=a or t
  misc_feature 143: k=g or t
  misc_feature 334: d=a or g or t
  misc_feature 335: h=a or c or t
  misc_feature 336: s=g or c
  UNSURE 4: Xaa=Ile or Leu
  UNSURE 8: Xaa=Met or Arg
  UNSURE 72: Xaa= *  or Ala or Asp or Glu or Phe or Ile or Lys or Leu or Met or Asn or Ser or Thr or Val or Tyr
gaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttamtwccacatgtgakgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacagdhsacagaaatcttgaatgaatatttttactcacacctcagcaacccctaccccagtgaagaagccaaagaggagctggccaagaaatgcagcatcacagtgtcacaggtatccaattggtttggca

SEQ ID NO: 3636 - DNA, 417 bp, Homo sapiens
  CDS 163..417
  misc_feature 301: k=g or t
  misc_feature 302: d=a or g or t
  misc_feature 360: r=a or g
  UNSURE 47: Xaa= *  or Glu or Gly or Leu or Val
aaaaatctttctggatctaaactcccagtgcgctttgcgccccaagtggccatcgcgcctgcgccccgcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacgaaccaccgcggggtccccggcaagcctkdaagagttgtgactcttgttgaagatcctgcgggatgtgtatggggtgttgcttacagrttgccagtaggaaaggaagaagaagtaaaagcataccttgacttcagagaaaaagga

SEQ ID NO: 3637 - DNA, 361 bp, Homo sapiens
  CDS 175..360
  misc_feature 337: h=a or c or t
  misc_feature 338: n=a, g, c or t
  misc_feature 339: b=c or g or t
  UNSURE 55: Xaa= *  or Cys or Phe or His or Ile or Lys or Leu or Met or Asn or Pro or Gln or Arg or Ser or Thr or Trp or Tyr
ctcaagaacggtttgcgctgaaaattcttcttgatcgtccaaaagctagaaatgaggtacgtctgcacatgatgtgtgccacacacccaaacatagttcagattattgaagtgtttgctaacagtgtccagttttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctthnbaaggataactctttggatgccc

SEQ ID NO: 3638 - DNA, 409 bp, Homo sapiens
  CDS 203..409
  misc_feature 122: s=g or c
  misc_feature 133: s=g or c
  misc_feature 239: s=g or c
  misc_feature 306: h=a or c or t
  UNSURE 13: Xaa=Ala or Pro
  UNSURE 35: Xaa=Leu or Pro or Gln
atgggcccccttcgtctcagctgtgcgggaacggccgagggtaacatcccgggctcgcgggaggctgtcggggtaatggccacacgctgacagaaccagccgagtggaaaaggggagcgaascgttcctctgsaaccccttccccaggcctgaggccttcccgcttggtgctgccgccgccactgccggctgaggaggggcgatgagttggttcaacgcctcccagctctccagcttcsctaagcaggccctgtcccaggcccagaagtctattgacagggttctggacatccaggaagaggagchgagcatctgggccgagaccattccgtatggagagccgggaataagttcccctgtcagtggaggatgggatacttcaacctgggggttgaaatcaaacactgaa

SEQ ID NO: 3639 - DNA, 214 bp, Homo sapiens
  CDS 27..212
  misc_feature 142: k=g or t
  UNSURE 39: Xaa=Gly or Val
caattgaagcagttcaagcaatttctatgttcaatgggcagtttttatttgatagacctatgcatgtgaaaatggatgacaagtctgttcctcataaagagtaccgttcacatgatggtaaaacaccacaattaccacgtgktcttggaggcattgggatgggacttggtccgggtggacagcctattagtgccagccagttgaacataggccc

SEQ ID NO: 3640 - DNA, 193 bp, Homo sapiens
  CDS 6..191
  misc_feature 137: w=a or t
  misc_feature 138: w=a or t
  misc_feature 139: m=a or c
  UNSURE 45: Xaa= *  or Lys or Ser or Thr
tgaatatgtttaaatatttaatttctcattttggggggtttttatttttttattttttagatggtgtctcacgctatcgcccaggctggagtgcagtggcgcgaactcggctcactgcaacctccgcctcctggggwwmaagcaattctccttcctcagcctcccaagtagctgggattacaggcatgcacca

SEQ ID NO: 3641 - DNA, 491 bp, Homo sapiens
  CDS 157..489
  misc_feature 132: r=a or g
  misc_feature 137: w=a or t
  misc_feature 145: v=a or c or g
  misc_feature 397: m=a or c
  misc_feature 398: n=a, g, c or t
  misc_feature 448: r=a or g
  UNSURE 81: Xaa=Ile or Lys or Leu or Pro or Gln or Arg or Thr
  UNSURE 98: Xaa=Ile or Val
gtcacttggaaaaagcagtggttcttgaacttaccttgaagcatgtgaaagcactaacaaacctaattgatcagcagcagcagaaaatcattgccctgcagagtggtttacaagctggtgagctgtcagggrggaawtgtcgaavcaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgmnagtcatccagcggactttcgctcactcgagtggggagcagagcggcagcrtcacggacacagacagtggctatggaggagatcggagaagggc

SEQ ID NO: 3642 - DNA, 276 bp, Homo sapiens
  CDS 115..276
  misc_feature 141: s=g or c
  UNSURE 9: Xaa=Asp or Glu
ccttttataaacattttgtttaacttttattgtggtaaaatacacataacacttctcttcttttagacctgggctggtaagaagtgctgaagatgttttttagagatttgtggtatgacaaattccactggggtttctgascttctcagtcatgcttgtcttggggtcaccactccttggccctctcctatggcacctgtccctcattctgctcaagcccctatgccttcccaacaacttgcctttagctctgggcagatgtctttgcttgcactc

SEQ ID NO: 3643 - DNA, 456 bp, Homo sapiens
  CDS 135..455
  misc_feature 357: n=a, g, c or t
  misc_feature 361: r=a or g
  misc_feature 362: k=g or t
  misc_feature 409: b=c or g or t
  misc_feature 426: r=a or g
  UNSURE 75: Xaa= *  or Glu or Lys or Gln
  UNSURE 76: Xaa=His or Gln or Arg
  UNSURE 92: Xaa=Leu or Ser or Trp
  UNSURE 98: Xaa=Ile or Val
gaacatttatgatcataatatgcagagccaaatttctgttccccttgaaaatatgaatatcccgcctggaaatgatggtattgctgtgagttttattattactagtatatttataaggctttacaacttataaaatgctttcctataaattacctcatttgattcttgtggcttgcttttcttttttgtacccaaagagaactagtatgcactttttcttttgttctcctggcaattccaattttttgaacatgaatgagggggccagccgcggtggctcatgcctgtggtcccagcactttgggaggctgaggcgggcggatcacctgaggtcaggagttcgagaccggcatggcnaacrkggcgaaaccctgtctctactagaaaatgcgaaaattatctgggtgtbgtggcactcgcctgtgrtaccagctactcgggaggctgaggcaggga

SEQ ID NO: 3644 - DNA, 356 bp, Homo sapiens
  CDS 82..354
  misc_feature 42: y=c or t
  misc_feature 142: b=c or g or t
  misc_feature 143: y=c or t
  misc_feature 288: h=a or c or t
  UNSURE 21: Xaa=Ala or Phe or Leu or Pro or Ser or Val
  UNSURE 69: Xaa=Asp or Glu
agtgtctcctgtaccagcagaagctccagaactctcacccgyattgcctgcctctgctgcgtctttgcccactgaacagccatgagaaggcaactccggtccagaagggctccatcctttccttacagttatcgctacagabycgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggahgaggaagagggtcaaggtcagccaacaggcaatgcctggtggcagaaattgcagatcatgagtgaata

SEQ ID NO: 3645 - DNA, 425 bp, Homo sapiens
  CDS 143..424
  misc_feature 136: k=g or t
  misc_feature 137: k=g or t
  misc_feature 142: r=a or g
  misc_feature 152: m=a or c
  misc_feature 153: m=a or c
  misc_feature 405: r=a or g
  misc_feature 409: k=g or t
  UNSURE 4: Xaa=His or Asn or Pro or Thr
  UNSURE 88: Xaa=Asp or Gly
agcctccgcggaggacccaggagagccggactaggaccagggccctgggcctccccacactccccatggagaagctggcggcctctacagagccccaagggcctcggccggtcctgggccgtgagagtgtccaggkkgcccratgaccaagmmctttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgrcgtkggctattactcctgga

SEQ ID NO: 3646 - DNA, 315 bp, Homo sapiens
  CDS 106..315
  misc_feature 123: r=a or g
  misc_feature 125: k=g or t
  misc_feature 129: k=g or t
  misc_feature 134: s=g or c
  misc_feature 142: r=a or g
  misc_feature 162: k=g or t
  misc_feature 248: s=g or c
  misc_feature 249: r=a or g
  misc_feature 271: v=a or c or g
  misc_feature 272: w=a or t
  misc_feature 303: n=a, g, c or t
  UNSURE 7: Xaa= *  or Leu
  UNSURE 8: Xaa=Ile or Met
  UNSURE 10: Xaa=Pro or Arg
  UNSURE 13: Xaa=Gly or Arg
  UNSURE 19: Xaa=Asp or Glu
  UNSURE 48: Xaa=Arg or Thr
  UNSURE 56: Xaa=Glu or Ile or Lys or Leu or Gln or Val
  UNSURE 66: Xaa=Asp or Glu
caagcagtttgaaaagaaccaaatggaagttctaaaaggaaagttttaatttagttcaaattttagttgaattttaatttcaactaaattaaaaacttagtatgcatgtttaacagaagattrtkaatkaaccsaaagcggrgacttcatgagctaaaagakaaatatgaatacagtatacagaatgctgcctggaaagacatagatttggaaaacctggaaaaagggttaagagacataaaggctasrataggaaaatccaacatgagcvwaattagagtgccagaaggagaagagatggantggagcagaggc

SEQ ID NO: 3647 - DNA, 352 bp, Homo sapiens
  CDS 78..350
  misc_feature 136: w=a or t
  misc_feature 143: w=a or t
  misc_feature 146: k=g or t
  misc_feature 152: m=a or c
  misc_feature 160: h=a or c or t
  UNSURE 20: Xaa=Asp or Val
  UNSURE 22: Xaa=Phe or Leu
  UNSURE 23: Xaa=Arg or Ser
  UNSURE 25: Xaa=Asp or Glu
  UNSURE 28: Xaa=Phe or Ser or Tyr
atctgcatccatattgaaaacctgacacaatgtatgcagcaggctcagtgtgagtgaactggaggcttctctacaacatgacccaaaggagcattgcaggtcctatttgcaacctgaagtttgtgactctcctggwtggcttwagktcagamctcccathcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccaa

SEQ ID NO: 3648 - DNA, 321 bp, Homo sapiens
  CDS 61..321
agcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgt

SEQ ID NO: 3649 - DNA, 189 bp, Homo sapiens
  CDS 28..189
  misc_feature 124: r=a or g
  misc_feature 126: m=a or c
  UNSURE 33: Xaa=Ala or Thr
acacacttactgagcgtctaacaatgaatgggtcaagcccttcgtaggcactggcaatgggaagatgaccaatacagacggctgaaccttgctttcaaggccttcataaagcactggaagatgrcmaaacacggtccgatacaaagggtcgggttcaggactccaaccattattatcaaagagccacga

SEQ ID NO: 3650 - DNA, 288 bp, Homo sapiens
  CDS 65..286
aatcaaagaggacacaagcagatggaaaaacatccaatgctcatggataggaagaatcaatatcatgaaaatggccatactgcccaaaggaatttatagattcaatgctattcccattaaactaccatcgacattcttcacagaattagaaaagactaatttaaaattcatatggaaccaaaaaacagttcacattgccaagacaatcctaagcaaaaagaagaaagctggaggtatcacactatccaacttcaaactatactacaagtccacagtaaaaaaaaaaaa

SEQ ID NO: 3651 - DNA, 310 bp, Homo sapiens
  CDS 144..308
  misc_feature 133: k=g or t
  misc_feature 137: y=c or t
tagtgcaaaacagttgaaactgtcttgtttacagtttataggattgaatatggcagctttacttgaagcaaggtctcttgatgttttaagcgatggtgttttgaaggatctttctgagttttaccggaaaatkgatyccagcaatggatagaagagtcattacaccatatcaagatggaccagatattagctatttggaagtagaagatggagatatcttcttgaaagaagaaataaatatggaacaaaatcattcggaaactatgttcaagaaagcaaaaacaaaagctaaaaagaagccacgtaaacg

SEQ ID NO: 3652 - DNA, 412 bp, Homo sapiens
  CDS 114..410
  misc_feature 308: r=a or g
  misc_feature 309: n=a, g, c or t
  misc_feature 370: n=a, g, c or t
  misc_feature 409: m=a or c
  UNSURE 66: Xaa=Leu or Met or Val
  UNSURE 86: Xaa=Ala or Asp or Gly or Val
  UNSURE 99: Xaa=Ala or Glu
agacacgaagcctcccgggtggcttacagacgctgccagcatcgccgccgccagaggagaaatgtctgaagtaagacccctctccagagacatcttgatggagaccctcctgtatgagcaggctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgarntggccatgcacagcctgggtctggctttcatctacgaccagactgaggacatcagggatgntcttagaagtttcatggacggtttcaccacacttaaggmgca

SEQ ID NO: 3653 - DNA, 412 bp, Homo sapiens
  CDS 129..410
  misc_feature 30: b=c or g or t
  misc_feature 32: n=a, g, c or t
  misc_feature 119: s=g or c
  misc_feature 387: m=a or c
  UNSURE 87: Xaa=His or Asn
ctaagaccttctccccaggaccccagagcbgntacgtgtgccggctgaatcggagtgatagtgacagctccactctgtccaaaaagccaccttttgttcgaaactccctggagcgacgsagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagmacaagggtgagcttcagacagacaa

SEQ ID NO: 3654 - DNA, 350 bp, Homo sapiens
  CDS 65..349
  misc_feature 95: s=g or c
  misc_feature 96: r=a or g
  misc_feature 119: r=a or g
  misc_feature 231: s=g or c
  misc_feature 232: r=a or g
  UNSURE 11: Xaa=Glu or Gly or Gln or Arg
  UNSURE 19: Xaa=Asp or Asn
  UNSURE 56: Xaa=Pro or Arg
aacttctgcatccaatattgtctcagcaacttcagtacagaattttcaggtagctacaggacaaatggttactattgctggtgtcccaagtccasragcctcaagggtagggtttcagracattgcaccaaaacctctcccttctcagcaagtttcatctacagtggtacagcagcctattcaacaaccacagcagccaacccaacaaagcgtagtgattgtaagccagcsrgctcaacaaggtcaaacttatgcaccagccattcaccaaattgttcttgctaatccagcagctcttccagctggtcagacagttcagctaactggacaagctaacataactccatctt

SEQ ID NO: 3655 - DNA, 164 bp, Homo sapiens
  CDS 9..164
  misc_feature 56: r=a or g
  misc_feature 58: r=a or g
  misc_feature 88: m=a or c
  misc_feature 96: k=g or t
  misc_feature 108: s=g or c
  misc_feature 122: r=a or g
  misc_feature 123: r=a or g
  misc_feature 125: y=c or t
  misc_feature 134: k=g or t
  misc_feature 135: r=a or g
  misc_feature 140: k=g or t
  misc_feature 142: y=c or t
  misc_feature 146: s=g or c
  misc_feature 148: k=g or t
  misc_feature 154: m=a or c
  UNSURE 17: Xaa=Glu or Gly
  UNSURE 27: Xaa=Ala or Asp
  UNSURE 30: Xaa=Ala or Ser
  UNSURE 34: Xaa=Ala or Pro
  UNSURE 39: Xaa=Ala or Thr
  UNSURE 43: Xaa=Glu or Lys
  UNSURE 44: Xaa=Cys or Trp
  UNSURE 45: Xaa=Ala or Val
  UNSURE 46: Xaa=Cys or Trp
  UNSURE 47: Xaa=Gly or Val
  UNSURE 49: Xaa=Lys or Thr
ttaaaaaaatgaaagtaaaggaaaaaaaaaaaactgcaaatctagaaaactttttrgrgaaaaactatttaaaactgtcagatcctgmccagcaakcccccccccagscccccttccaagtrrcyccgggcctkragtgkgyctgsgkgtttamacccgtcccc

SEQ ID NO: 3656 - DNA, 283 bp, Homo sapiens
  CDS 54..281
  misc_feature 177: n=a, g, c or t
  UNSURE 42: Xaa=Gly or Arg or Trp
gaagagagaattaagacttcaggcatttgttttgtgcaaatgcagtcaggtctatgatcaagactgcccttattgataaagctactaaaccccagcctggaagggaaattataaataccatctgccggtttttaattgcaaaacagggaggaccgaatagtgggaaccctctgaatnggttttatcagtgctttgtccctgaaattaggaagtaccttgccagggtaggactgccttttaacgtttttttgatattggataatgcccctggccacccagcact

SEQ ID NO: 3657 - DNA, 415 bp, Homo sapiens
  CDS 176..415
  misc_feature 40: m=a or c
  misc_feature 85: s=g or c
  misc_feature 129: k=g or t
  misc_feature 166: d=a or g or t
  misc_feature 343: r=a or g
gtctctggccttccccttttaggaaacaaaggacccgtgmcagagcctacttatcccgttacagctcctggtgagaagggcgaasgatgtcagaaataatagaaaaggctttttcctttgaaattatckaaacgttcaaagatgggaacagccgcaggggggagadtactgtgctatgcaagttgatctgattttgtggaccatccatttccaattgggaagctcacttactttcaacttgaagcatcagaaaaccagacttacagcagcttcagcctataggggtttatttttctcatgtaacaagaagaacagaagtggacagaggccgagttctcaaggrctcagtttctttctgtcccaccaaccttaccatgttggattgtcatctttgtgcttgttgcctcatgatggc

SEQ ID NO: 3658 - DNA, 347 bp, Homo sapiens
  CDS 135..347
cacagccgaactagtcccaacgcgtttgcaaatattcccctggtagcctacttccttacccccgaatattggtaagatcgatcaatggcttcaggacatgggttctcttctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagc

(The sequence listing continues in the following parts.)

What is claimed is:

1. A signal sequence encoding a signal peptide comprising the sequence of amino acids −37 to −1 of SEQ ID NO: 7869.

2. The signal sequence of claim 1, wherein said signal sequence peptide is encoded by a nucleotide sequence comprising the sequence of nucleotides 51 to 161 of SEQ ID NO: 3792.

3. A purified and isolated nucleic acid encoding a polypeptide comprising the signal peptide of claim 1.

4. The nucleic acid of claim 3, wherein:
   (i) said nucleic acid comprises the full coding sequence of SEQ ID NO: 3792; and
   (ii) said full coding sequence comprises the sequence encoding said signal peptide and the sequence encoding the mature protein.

5. A method of making a cDNA comprising the steps of:
   (i) contacting a collection of mRNA molecules from human cells with a first primer capable of hybridizing to the polyA tail of said mRNA;
   (ii) hybridizing said first primer to said polyA tail;
   (iii) reverse transcribing said mRNA to make a first cDNA strand;
   (iv) making a second cDNA strand complementary to said first cDNA strand using at least one primer comprising at least 15 consecutive nucleotides of a sequence SEQ ID NO: 3792; and
   (v) isolating the resulting cDNA comprising said first cDNA strand and said second cDNA strand;
wherein the second cDNA strand is made by:
   (i) contacting said first cDNA strand with a first pair of primers, said first pair of primers comprising a second primer comprising at least 15 consecutive nucleotides of a sequence of SEQ ID NO: 3792 and a third primer having a sequence therein which is included within the sequence of said first primer;
   (ii) performing a first polymerase chain reaction with said first pair of primers to generate a first PCR product;
   (iii) contacting said first PCR product with a second pair of primers, said second pair of primers comprising a fourth primer, said fourth primer comprising at least 15 consecutive nucleotides of said sequence of SEQ ID NO: 3792, and a fifth primer, wherein said fourth and fifth hybridize to sequences within said first PCR product; and
   (iv) performing a second polymerase chain reaction, thereby generating a second PCR product.

* * * * *

UNITED STATES PATENT AND TRADEMARK OFFICE
CERTIFICATE OF CORRECTION

PATENT NO. : 6,783,961 B1
DATED : August 31, 2004
INVENTOR(S) : Jean-Baptiste et al.

It is certified that error appears in the above-identified patent and that said Letters Patent is hereby corrected as shown below:

Column 1,
Line 27, "kilobases (cb)" should read -- kilobases (kb) --.

Column 2,
Line 31, "fraes" should read -- frames --.
Line 31, "Biotech" should read -- Biochem --.

Column 15,
Line 15, "code of SEQ D" should read -- code SEQ ID --.

Column 16,
Line 24, "The "a" in the" should read -- The "/" in the --.
Line 46, "The "P" in the" should read -- The "/" in the --.

Column 18,
Line 8, "fingal" should read -- fungal --.
Line 55, "(Strajagene)" should read -- (Stratagene) --.

Column 21,
Line 33, "subunit a and" should read -- subunit α and --.

Column 22,
Lines 22 and 25, "convex"should read -- connvex --.

Column 23,
Line 58, "(SEQ IE Nos:3721-4100)" should read -- (SEQ ID NOs:3721-4100) --.

Column 27,
Line 33, "biotin-UJT" should read -- biotin-UTP --.
Line 34, "DIG-UITP" should read -- DIG-UTP --.

Column 28,
Line 49, "270:467470" should read -- 270:467-470 --.

Column 29,
Line 11, "Pictu" should read -- Pietu --.

Column 31,
Line 8, "bioinfomatics" should read -- bioinformatics --.

UNITED STATES PATENT AND TRADEMARK OFFICE
CERTIFICATE OF CORRECTION

PATENT NO. : 6,783,961 B1
DATED : August 31, 2004
INVENTOR(S) : Jean-Baptiste et al.

It is certified that error appears in the above-identified patent and that said Letters Patent is hereby corrected as shown below:

Column 32,
Line 29, "if the fall" should read -- if the full --.

Column 36,
Line 31, "Examples 14" should read -- Examples 1-4 --.

Column 37,
Lines 16-17, "(fraction G+C) 0.63% formamide-(600/N)" should read
-- (fraction G+C)-(0.63% formamide-(600/N) --.
Line 53, "Lower Dewees" should read -- Lower Degrees --.

Column 39,
Line 48, "Cutoff Score, Gap" should read -- Cutoff Score=1, Gap --.

Column 40,
Line 45, "Mismatch Penaltyl," should read -- Mismatch Penalty=1, --.

Column 43,
Lines 8-9, "78-8-3-E6-CL1_1C)" should read -- 78-8-3-E6-CL0_1C) --.
Lines 50-51, "108-004-05-0D10-FLC)" should read -- 108-004-05-0-D10-FLC) --.

Column 49,
Line 15, "DAIG" should read -- DAlG --.

Column 51,
Line 59, "blocling" should read -- blocking --.

Column 52,
Line 44, "CTLA41g" should read -- CTLA4Ig --.
Line 49, "pp, 846847" should read -- pp. 846-847 --.

Column 53,
Line 60, "IIα chain" should read -- II β chain --.

Column 54,
Line 16, "Hematogoiesis" should read -- Hematopoiesis --.

Column 56,
Line 53, "neuropatuies" should read -- neuropathies --.

UNITED STATES PATENT AND TRADEMARK OFFICE
CERTIFICATE OF CORRECTION

PATENT NO. : 6,783,961 B1
DATED : August 31, 2004
INVENTOR(S) : Jean-Baptiste et al.

It is certified that error appears in the above-identified patent and that said Letters Patent is hereby corrected as shown below:

Column 57,
Line 58, "inhibin a" should read -- inhibin α --.

Column 61,
Line 45, "arc inserted" should read -- are instead --.

Column 64,
Line 30, "pug/ml." should read -- µg/ml. --.

Column 65,
Line 13, "semifuantitatively" should read -- semi-quantitatively --.

Column 69,
Line 25, "with 2 using" should read -- $P^{32}$ using --.
Line 26, "kinase Pharmacia)." should read -- kinase (Pharmacia).

Column 70,
Line 44, "Ma ping" should read -- Mapping --.

Column 71,
Line 11, "region are surrounding" should read -- region surrounding --.
Line 14, "14:574584" should read -- 14:574584 --.

Column 73,
Line 35, "Acids Positional" should read -- Acids, Positional --.
Line 57, "posifioinal" should read -- positional --.

Column 76,
Line 13, "DEAE-Dextrar" should read -- DEAE-Dextran --.
Lines 63-64, "fragments a of" should read -- fragments of --.

Column 77,
Line 61, "semiualitative" should read -- semi-qualitative --.

Column 78,
Line 15, "rhodailne" should read -- rhodamine --.
Line 25, "example 1251" should read -- example $^{125}$I --

UNITED STATES PATENT AND TRADEMARK OFFICE
CERTIFICATE OF CORRECTION

PATENT NO. : 6,783,961 B1
DATED : August 31, 2004
INVENTOR(S) : Jean-Baptiste et al.

It is certified that error appears in the above-identified patent and that said Letters Patent is hereby corrected as shown below:

Column 80,
Line 53, "CLAB" should read -- CL-4B --.

Column 82,
Line 18, "DNTP" should read -- dNTP --.

Column 86,
Line 28, "gel shill" should read -- gel shift --.

Signed and Sealed this

Tenth Day of May, 2005

JON W. DUDAS
*Director of the United States Patent and Trademark Office*